United States Patent 11,001,841 (CCCTC-BINDING FACTOR (CTCF) RNA INTERACTOME) - sequence listing, part 8

SEQ ID NO: 18452 - DNA, 1048 bp, Homo sapiens
gtttttttgtttgttttttgggggtctttagactcttgaaggcaactcagggtattgtccacgcagctctctggttagacttctcccaggctatgatcctggcatgtcctttataaggtatacttggattggccgagacctggcctggcatcaggagtccaaacctctgaggtctgatctctgctctgtcaaggactttcggcaagtctcgtgacctctggctctttcacttcctccccacctgccaaatggggataaataatcttacctacctcctggggggaggggaagttctgagaatggagtcattcttagtgttcaggtgctaaaggttgttctcctgggggaacagagtgactgaaactggcttgtttgctacaagccctaccctccactctttcattccttgaaagcagtttgcctggtcagtcagcttttgggggtccatcaaaggaggttgctgacctgaccgtgagtgcttcagtatctggtttgtgtcagaaccagacgccaactttgtactgcatttgggatcatatctttccccttctctgtcccccattctctgaatgctgctttctctggcttgtttcctacagtgggggcctgtggggttgagtcttgaggaatcccctcaaatgagaaggccttgggagaaggcctcatctctggctgtttcatgagcaactcattcctagagttcattgtttgcatgggtttctcacaagcgtccttcctcataggaaggctcatcaactgaatttagtgacatgtacacagtagatgctcaagcagtgtctgcaaggacacaagctgagctttctccttatggggcaaacctatgtctaaccagatacagaccaattagtttagatcaaatcaccttccacttgggctacttgtgactttccaacctggtaacttccactgaattctggaaagagaaattcttgaggaccctggcaagttgggccctgacctttctgttgctgtctcttgctggtgaagcaataccagcagttcctgtaataccacaatatcgttccat

SEQ ID NO: 18453 - DNA, 1035 bp, Homo sapiens
ccaccccctgggcagggagtttgcacgtagttgtgagctgtgagtggttagtgcattgctggtattgctgaaggcagggttgatccctcacttgactgatacttgcattcaagagaatctagattgtgttgggggagggactgactgtactcatggctaacttaaagtattaaaataaggctgtcccctacaaccttcttagtcacacaggatccctgtagccaaaacagtatatgatccagctgcagagagcagactgctctcagcttgcacagcaccttaggcgagggaagaatatacggatagggaatggggtggagaaaggatgggaatgttgtcatccaggtggctttagggtcctaaggagtggagaaggatggcactggggaggtctggatggatctgtgtaggagttccctgtagataaattactgatcccccatctactatccccagtatgtaatggctgaattaatatgtaatcaactgcattgtatctaaagccttagaactagtcaggtgctccctccacccaataccatttcttaccctctaatcctacctgatctttaacaaagcattaataattctaaggataatctctattttgttgtgcttttttgtaactgttttaaataaatcaatttgtactgtatatttgtacttttgtgagatcctttttgctgttttaccattttaagtctctgtacttggctacacacagattgtatttttattgttaatgctcttcttatggatacctgcatttaacttgtggactatgtaaacacaatatctatcaatatctatatatctatatatctatctatataaactactagcttttccttttggtgtttgcgccttcttcctatcccagccttagatggtggccatggggtgggggatagaaacctttgtgggagcagttgtaatggaacacaaatggtggctttatttgtgcggtgagctcaagggagatggcatgagcttgtcctcaagcatggtctttcccctctgttggtgtggatttca

SEQ ID NO: 18454 - DNA, 1025 bp, Homo sapiens
aactcaacagcataaactttgaggagggtcgggacccaggagctgtaggttaattacaaaagacactgtctgtcgtagtaaacttaaagtctggtcttagatctttaggggaaacttgaattttaaaattatgtgtaatattttaactttttattatggaaaatttcaagcagacaggagtataatgaattctctcatccagcttcaaacacgatcaactcatgcctaatcttgttttatctatacccttcctatgtctgtatttttctaatttaataatagttgaaatatatatgtatatatttccctctcctttcccagtagaagccttttggcttttgtacctacaagccaatagtttgtgggaaatttgcttcctcagaacttctgggatagggggacttggtaatagtcattagaagataaaactggccagatgtggtggctcacccctgtaatcccagtacttggggagggctaggtgggatgatcacttgagcttgggagttggagaacagcgtgggcaacatagcaaaatcccgttctctacaaaaataaaaacagccaggcgtggaggcccgcatctatagtccaggaggctgaggtaggaggattgcttgagcctgggaggtggagattatagtgagtcggtaatcgtgccactgcatttcagtctggaggacagagtgagaccctgtgtaaaaaaagaaaaaaaaaaagaaattaaaacacttcctctttttttgtatttatttttgtttttgttctgcagacgggggtctcactctgtttcccaggctggagtgctgtagtgcactccctgcagcttcgacctttcaggactcaagtgatcctcccgccccagccttgggagtagtagctgacactacaggcccacgcctggcttttttttttttttttttttggtcggggtcgggaggggagagtttcttaatgttgcccagactggtcttgaactcgtgggctcaagtgatcctcccaaaatgctgggattagaagtattt

SEQ ID NO: 18455 - DNA, 1078 bp, Homo sapiens
tgggcgaacagccgggcatggtggctaacgcctgtaatcccagcacttcgggaggccgaggcgggtggatcacaaggtcaggagatcgagaccatcctggctaacacggtgaaaccctgtctctactaaaaatataaaaaattagctgggtatggtggtgggtgcctgtagtcccagctactcgggaggctgaggcagaggtagtagtgagccaagattgcgccactgcactctagcctcggcgacagaacaagactctgtctcaaaaaaaaaaaaaaaaaaaattagctgggcgtgatggcagacacctgtaatcctagctacctgggaggttgaggcaggagaatcgcttggacctgggaggtggaggttgcagtaggctgaaatcgcaccattgcattccagcctgggcaacaagagtgaaactcggtctcaaaaaaaaaaaaaaagatcagaataaataaaataacacacgtcaaaaccaaaagcttttgtacgtattggagtgtctgtagccagtcttgaccttgctctctcccctcctcacttcgtacttttagagctacaaacactgagtttactcccttaggaagtctttttttttttttttttttttttggctacttttagctgctactactttgaatagagctttcaggatcactacttctgggcagcttcactattttgggcagcagttctgattcttttcctcctccagatatcctaagaggaaggactcagtccatggttttactttgcttattcaggatggggaggctaactagctcgcgaagtctcagcgagctgagtgataaaagaggaactagatgggtttgctatgccagtgttaagaattggagtaaagtgaaggattgggctgctgatccatgtgtgacactaataaaaataatggtgttacactaataaagataagtatatatgtatataaacagaataccgagaactaggattgtggtcactagttcataaccattttttagagtttatgttataattgcttacttgtcttatagttgtttttatgtcagctatacccatttgattgtgagcccct

SEQ ID NO: 18456 - DNA, 1031 bp, Homo sapiens
gtgttgggattacaggtgtgagccactgcacccagccagcatttttatagtagctgctttaaagtctttgtcagttaattccaacattggtgttgtctcaggttgatgtgtgagttgagattttcccagtgagtatcacccactttctgtctataccagcggtcccctttctagttcctcaagccaggactagagagctcttgatgctctttctctctgctgatgctcatttccgggtttcagcctgctgtgcatccaggctggggaacatcagagggaaaaatgataaactcgccgccagtttattggtacttcaaattgtggtcttcttcatccatctgctattatttttcatagttctcagatagctgctacatgcattctgttcaggttttacagcttcattcagtgaaagagacactgaacctagaaccctgttccttacatcttttgtttctatttttaaggaccatccatgttgctttaagtacagctgtttaattttgtctgctgcatagtattctgtcatgtttttgtcaaattttgtttgtcttttttttttttttttttttggatacagggtctcactctgtcacccaggcctggagtgcagtgtcatgaacatagctctctgttgcctccttgacttgacctcctgggtgcaagtgagcctcccacctcacccttgcaagtagctaggactacaggcgtgcacccccacagccagctaatttctaaatattctgtagagagggtcttgccatgttgcccaggctgttcttgaacaccggcctcaagcgatcctcctgcccggacctcccaaactgctgggattataggcatggaccaccgtacttggcctcatttgtcctcttgaaatgaacacttagcattcttctacttccttactaccacaaaatgcatacatgcgtcttcatggtgctgtgtacaaatttctgtggtggtgcgtgtccaggaatggaattgctgtgtcttaaggtatatgggtacctttcattaaagcatacttt

SEQ ID NO: 18457 - DNA, 1062 bp, Homo sapiens
gcctaacagttgctgaaaggcctgttaaaaagaaaatacagaatctgaaactgagaagcctaaatttgaatcttggctcgaccattttccgagttcatggccttgagcttgttgcctagttttgagttcctccaaaagtaaaataagatcacgaaaatggctagaagcctagagttattgtgagaatctagtgagattcacagaatggctttggaggctataaagtatatgaaacaaaagctaggattttgttggtttgttttaaagaatgttatattaatttttttccttgattagggaactagattctggtctggctgaatctgtgtctacattgatctgggctgctcctcgactccagtcagaagtggctgagttgaaaatagtgagtacaagtagtttcagtgatgtctgtagcttttcatattgttagaaaggttggttaatataagttacttctgctgatttgaccagatattttgtaccattcttatgttgcttttgaaataggttttgtaaatttgtttctccctttcagccttatatcgtagaatagaacagtgttttgcaaacttgagcagtttttttaaggagcaaagttttgtgtatctccagttttgtcttaatgttatttaactctatgcaaatagaaaagttcttatacaactgtaaaccagtaaagttaaaataacattaaggtgacagatgtttttgctttatttattaattccacaaatatttattaaataaattgtatgagctatgtaagtgctgggggtaacagtggtgaacaaaatatggcaccagccatactcctgtagcttagagtctagcagaagagacagacattaaccagaaaattgcacatcacaacatggatatggtactgactcctaggatacaaattcagttgtgttgttttctattttctacatctttgcctttctgttttatttcctaggagactgtgtcattcttatctctcaacccatctactgagatttccttcttttctaggtttttttcaagagctctttttaattctctgaatattttttatgg

SEQ ID NO: 18458 - DNA, 1052 bp, Homo sapiens
atacttggtaaacatgaaggcagtgtgtgggagcagtttattgtactgcttgtggcaattctagtgggtaccactgtattgctcagtatggggtttcacctttcatagtggggtgaggaggacagctgtgtggctggcagtgtggtccaatccttacacctgcccaattcctctggttactgtcattcctgactccacttccccactttgtatgcctcgtgtcatttgtgaaggttggaagtgaggtggggagaagggtggatgaattgaactgtggaaggcagcagtatcatcttttgccagcatctgggtcatgtgtaatgagaatgtgaaagagagacttgggtcctctgatgtgtcttgtgactctgaaaaaaatcatttaactgctctgaacctttttttccctcaatattacctgtaaaatgagaggagctaacttcgcatagtgaggtgaggattaggctggttggtatacatgcatcttagccctgggtctttttacttacagctaatgcacaagctgagtgtggaagccccacccaaaatcctggtggagagatacctgattgaaattgcaaagaattacaacgtaccctatgaacctgactctgtggtcatggtaagtttatcccagaatacaaagaaaaatgagtttgtaggtatgaccttctttggaaaacaaaaaaaacattctttgcactaacttaaatttgtgtgagtttaagcctttgtccagttagtacctttatgacaataaatgtgcctgcatatctcacagggtacttaaggaattagatgaatgacaacactttgagaaggtcaaaaccttgatacaaatgtaaaatggcactattattgctactttttggtgaacttcaggaattgagaaacctcctgttcatagcaagaaatgccccaagacccaaacagttcccgaaacatttattgggtacccaccatgtgtctgatagtgcacagaaagctgaggatacagggataaaaaatcatccaccagttggccaggtgcggtggctggctcacgcctgtaa

SEQ ID NO: 18459 - DNA, 1784 bp, Homo sapiens
agaagcactccagtaaacttgctttatgctaatctccatctcagactccgctttctggggaacctggccttggacatgggttaatgacctgggtttctctttttttctcaggcagaagctcctcctggggtagagacagatcttattgatgttggattcacagatgatgtgaagaaaggaggccctggaagaggagggagtggtggcttcacagcaccagttggtggacctgatggaacggtgccaatgcccatgcccatgcccatgcctatgccatctgcaaatacgcctttctcatatccactgccaaagggaccagtaagtatatataagtgtggatgtaagctttagaaaatgttatagataacaagttggctctgtgaacacactcaggaatcataggttgtcaggagccattagcagtaagaacatttggtattagctggcagtcatcttgtggggaaaaaacacattggattcagagaaggtcttctagttcagctgtaggaaaatctatagagttggtgctagaaaaacacttttcatataggtttactgaatatctttgggatctgttatagtcatactagtagttttttccacaaatgaataaaccaccaattattaccaggcagaacaacctttgtagataagatggtcattggtagtaagaaagtctcgttagagttttcccttgtaaacactgaagcacttgattcaataaagaatagcctttggctctagatctttaaaaatctggaatcctgaccacatgtggtccttttgggcatttttaaggatcttgaatatttatatatatttagtatgagaatataaatgtatttctttctcccttcccatacccaaaccttcgagattgcaaactggaggcagtgtctctgatgttgcctttctcctcttacagtcagatttcaatggactgccaatggggacttatcaggcctttcccaatattcatccacctcagataccagcaactcccccatcgtatgaatctgtaagtgcctgagcctcttttataagcaacaggagagtgaatgccatgaagagcgagcaaaataatgaccacagggaaggcagagttttgatcaactcctagtactgtcatcatttttgctttgggattcttgtgttgctttataacactaccctggaaatgtggagtgggtggtgatggcagtatcattggtggcaatgctttgtctgcaattaagccaggaatcaggaaggaactgcagatttcttagaaagttgtagtgctctatgagggcacttagccagttgttttgaccgactaggcagataatcacactgagctgatacaatcgtggtgctaaagtatcataattattaaaatattagtcctatgtgttctcaacacatgtaaaggaagagtgaccagattgatcttaatcagaaatgtccagttacatgtcggccgacagcattgatttcacattttagtattctagttaaaatttgctaatgaatagctaatataatacctcgaactgtaggtggttcaggttacttgtttttgaccagccttgtttcttcagttactgtaggccttttgagacctgtctccatctagtattttactgagaaacaaattggtgtggcatttgctatgtaaattactcatctaggaagatcttcctgttcctgagcttgctttctgttctttcctttggttcccatctgtagctgatgtgttctaccttgggcctgagtttttcttatgctttggttttgcatgcgtc

SEQ ID NO: 18460 - DNA, 1023 bp, Homo sapiens
caattggagactgaggccagagcaactggctcctggcagctgtgcttgtccgtttcctgtcagagtgatcccaggtttcctcctggcccgtcccatggtccctccacaggagtgtgagaggatgggggaagcactgtgggaagaccaccaaagatggctggacagtgggagagagcacgttgtgaagcatcccagcctcgtgttgaggttccagacttagaaacagacccctctgtacagggggattgtggtgagtgagaatcaaggccaccttgtgtgttttctcactctcgaatgcaagtgggagagggaaaatgactcgggacgccattgtaacggttcctggaagctgggccctctcattggcatatacagtactcctcgctgcagggcactgtcccaccgggatccagttgcaaagtttgtcttgacagttgaaggcctcgcttagttgtactggattctcagggagccctctgtggccttttgctttgcgtgctgtttcccttgtaccagagggcggcaccgtggaaattctgttttccctgtagcatattgtgttggattgcattactggcagagaaaggacaaggtgccattcaagtcctagggtgggcttccagctgccttaatagaagtactcaagtcttttgggtagtgagctggaaagcctacaggaaaagaggggtacctgttttcatttgaaaactttgattcatggaacctttaaaactaatctcagaaaaatttttggtgcccatgcagctgtagttgttcactgctttcctggatggatgggactcttatgtcataacttctgttactcctttggcccatagctaaggtcatccttccccacaggggtggctttgggattggatgatacagcttttgcttctgtgtagtatacctgtacatacttgtttcaggcagcctttctttaatgttttcagttggtttgtattctgtagctcagtagctgctaataaagttaaagatcctgtgtcctgctttctctactgt

SEQ ID NO: 18461 - DNA, 1092 bp, Homo sapiens
catggaagccttggcagtttcctttcgagaggcttcttaccaaatgggaggacatcagaatgatgagtgtgaaaatgcaaacaagaagccctcagaactctggtgggaagggtcactgttataaattaaaggggccttcaccgcattttctcttcctaccttagactcctcttcactatctgattatatggtgttgagcagacgtgtcatttcccctgactggccatgctcacacactaacaggcactgtaggctcagaaagagcactccgttaaggtgtcctcacctcagactgctagtttgagagccctggaaccagtgtaaaatgggagtgaataatgagtggggtgcagagatggggtgaatttagaaggaagtgcggggtgcctgagggtgcaagctgtgtctgtataaacacagatgacagagacaggcaaacctgacctctgaggtgttgtcctcaacacctctgcgtgggcccacacttgcagcagctcatttagaatgtgactcagactttttaaccggtaaccaggattcttgatttcacaactttcctggtttggctctccacccttcacctatgtcaggcatgttagaatcccccgggggtgcacttggaatattcagatgccctggcctggtgccagaccagtttcaccgccacatctgagagcaggacctgaaagctgccaggggcctttgtggtgcagctggagctgagaaccacggtcctggaggaaggcccctacacatcttgcctaccagtctcctgaggtgctgtgagcattctcaccttcatttgttgctcttccttcttggagcatctctcttaatcccctgcttccaggatccgaccgtgttcaccccgggaggcctttgctagtctcctgaaaggtcgctggagcccatcagtcagttctgcccagctgaacatcttccttcctctggttccccgtgggaggctgggggacgtggctggggcttcttgccagcccggatgaggagggacacagctggagctgatgtttattaagctgattaaagggttttgctgcttgacacgccttggtttcagggaagcactatcta

SEQ ID NO: 18462 - DNA, 1031 bp, Homo sapiens
attctgtgtattaaccccttgctaaatatgtgatttgcaaatattttctcccatactggaggtggcttttttactctgttggtactgtgctttgaggcacaaaaattttaaattttcatgatgcccaacttgtctattttttcttttctttcttttttttttttcctcgctctgtcacccaggctggagtgcagtggcacaatctcggttcactgtaacctctgcctcctgggttcaagcaattctcgagcctcagcctcccgtgtatctgggattacaggtgcatgccaccacatccggctaatttttgtatttttattagggatgggttttcaccgtgttggccaggctggtctcgaactcctgacctcaagtgattcagcctcctcagcctcccaaagtgctgggattacaggcatgagacaccacgcgtggcccaattttttgttgttgttgcctgtgcatttggtgtcatagctaagaaatcatttggaatagaatagcctgctccacactattttgtttcctgtagctttgtagtaagttttgaaatgaagaaatgtgagtactccacctttgctcttctttttctaggctgttttggctcaagattctgtgtgaatttgaggatgatttttctgtttctgcagaaaatgctactgagattttaatagggattacatcgaatctttgtatcattttgggtactgttgacaattttaacaatattaagccctccaactcacagacatggaatcttcgcatatatttatgtctttataaattttcctcagcaatgttttgtagttttcattgcacaagtctttcatctaggttatctgatttgttggcatacagttgttcatagtcttcgcttataatcctttttccttttcttttgttccttttgtttttttttttttttttttttgagaagtgggatctcactatattgcccaggctggacctgaactccttgaaatcctctcacctcagactcctgagtagctggaactgtaggcatgtgtcac

SEQ ID NO: 18463 - DNA, 1067 bp, Homo sapiens
ataacctaaggtcacaaagattttctatcttttctccttatccatgtgtgaaaaaaatataaaactggacctctatgtagcatgactttaaggcagactgtacacccaaaatcccttttagcaaaataataaagtttttagaagataatatagaggaatattttcatgaccttggggtaggggggatttctttaaaaaaaaaaaatcatttatgaggccaggcatggtggctcatgcctgtaatcccagcactttaggaggccaaggcaggcagatcacctgagcttgggagtttgggactagcatggccaacatggtaaaacctcgtctctactaaaaatacaaaatattagccaggcatagtggtacatgactgtagtctcagctacttggaaggctgaggcgccagaattgtttgaacttgggagttggagactgcagtgagcggagatcataccattgcattccagcctggttgacagcgtaagactcttgtctcaaaaaaaaaaaaaaatcatttatgagagcaggaaatgctgataaatttgactttactaggaacttcgtcagcatatcaaaaggcattacgaagaacacaaaatgcaagccacagagtaagaggaagtatctgcaacatgtataactagcaaagcactagcattcagaatatacaaagaactcctacattagagaaacaaattcaaatcacaatgagataccagtacaaaccttttagcagtactataatttacaaaattgacaatatcactctagtggtattcaaagcaactggaactttcatgcattgttagtgggagtgtaaaatggtatcatcattttagaaaacatttaggtaatgtattatcaattgctgcataataagttatatatatttagcagcttaaaacaacacacatttattatctcacagtttgtatgtgtcaggaatctagatgcagcttcactgagtcccctgcctcaaggactctatcaaagcctcaatcaaggtgtcagtcacacttggggtctcacctgaagctcaaacagggaaggatcctctttcaagg

SEQ ID NO: 18464 - DNA, 1056 bp, Homo sapiens
ccctaaccaaaaactttttttagaaaagaaaagtacacagccaattacacaaatggaaacaaatcctttagtatagaaaaaaaaagaatatttgaagctcctaccaaacaaggaggaaaagaaggggtacaaagaaaaaaaagccaaaagaaggataaataaaaaataaatgcacaaagctaacagacacaggtaactagaattatatgcctttaaaaagtttcaactccccaaccaaaaataatctgtgaggatcctaatgacccctagaatcccttgaaattctttctttagttttataaaataattctgcagctccctctaagaaatgaaggcagctaccttaagtgggagattataggacgggaggtgggagaaggaaagagaaagtggaattaagggacaagaaagagaaagtggaattaagggacaaggggagaaaagcttaggcgaatcaacggattgcaatctatcatctgctaggaatgaacaagacaacatcaaatgaggagctgtcagctggaccatacaaaaagctaaatgtacacaaaaggtttttttttttttttccttttaaatctaccatactgcttcagttcatttccaatgcaacaatctactcaacaccaaaaatggtcatatctatcataaatacagaaagtcagtttttaaaacttattttttttaagctacaagtcctcaacactctttgtgtgtgtgggttattatttttttttttttttgaaagtgggagtgcttaacttttccccttgaaattggcttcagcagaaaagctatccttaaaaatccccagaaagctaaagcagttcacattgtttttcttgaatactttctgcccatttttaagttaacaaaacaaaaaatcttttctggaacaaaaaaaaaaaaaaaaactgaaaaaacaataatatataaaacaatgattctgaaaacaaagtgtgagcgattgacctgagaataaaaagacattacatttctttttttcttttagcaagccattggtatctgaatgctaagatagcaagaaatttaaaa

SEQ ID NO: 18465 - DNA, 1029 bp, Homo sapiens
ggagctgtggtgtgggtggcggctgggctgctggcggcgggggaggctgctgcacctgtggttgctgctgctgctgctgctgctgggggggttgctgagggcccatcgccatcgtggcttgtgctggggttggggagctcagcgacgctgaggacggtttatttggtaatccagaagtggggaggccaggggaaggaacagttgtgctgggcagacccatcaagttcggcttaggagacgttaaagctgaaaggaatggagacagaaatcaccggtcagtctgggcaggggtagggctgaagctcaagacgttttaccggtgtcactggcacacagtttgagatgtcaaggcttgaaggatcctctcaaaacgaacatttccaacagaagtatcccaccaggctcagggctggacaaccttgtattctaatgaggactcagtcctaggtcagctcccatacttcccctttcagccaaacaacttccagaagtatcccaccaggctcagagctggacaaccttgtattctaatgaggactcagtcctaggtcagctcccatacttcccctttcagccaaacaacttccagaagtatcccaccaggctcagggctggacaaccttgtattctaatgaagattcagtcctggctagctcccatacttccccttccagccaaacaacttccaacaccttcctgcccaatgtgccacacccgctagttcacattttctttgccaagtactcccagctaccattcactctgcccaactgcaattagtctagaggccccaaagctagctgtttctagctggggcccatttgcaccaaaggccttcatcacaaaaatagtatggccacgaggtccccagagaagttatctggaggagagcggcaacaggagaagagagaacgaaggcaagaaagctagcacggccacatgaacaaaaacaaaacaggctctacaggtgttcctcctctctgacctctgttgctgcagctgactggatgctttcggagggtagagaga

SEQ ID NO: 18466 - DNA, 1072 bp, Homo sapiens
agtaaaatcccttcaggccaatcctttagaaaaatgaaaacactcaaactaccattctaactcaaaaatttacaaaaatatgaacgtcagggatttttgaagcattattgtggtgtcatttcaagttgagctatttccctgcttcccctccaacccgcatttttcaaaagcaccaataccctctggtcatctcgtcccaaattaccttaactagactcagcctggtactctgtggctggaaaccatgacgactacaggaattaaataaccatcttgctatgattctttgccaagagttcaatttttcccctaattattggtgataaagcatcacattaattgtatatcacttaacttattgcaaataatgattaattggataatcactgcattaatcattgctcagttgctgacacggggggctcttcattcgagaatacacacattcaaatctattctggtaaaagagaacaagggtcattttcatgtttcaaaagagaaaaccacaaagttggacagtggcaatggctgtgcattagggaagagaacaaagaaccttcctgtacccttcactggcccacaggagtacatcacactttccttgacaagatgtgcccgcaagggcctgttcatgtgctaccactcaccctcttggaactctcaggcggttgggactagtggatatcccctgtccatgtttcacagaggaggtacctgagccgaaagaggccaagtgcctcaatcaaggtcatctgctggctggtgggcttcctgactccaaatctagagtctttccacatcaccatcccgctttcagactgagcacaacgccagctccttacaagacatatatccatggttgataatccagttcattttgaacatcctggtggttatcgtgttactatgatcactgtacaatgtcaggagactgctactccttatacttagacatagatgaaaactagatctaatgatcaaactgaaaatgatccttctctgagagatggtatattggtaagagcttgggctctgtcctaagttagaataagtgcaaaagccagtgtgtaaa

SEQ ID NO: 18467 - DNA, 1028 bp, Homo sapiens
aacccagtaggattatatgacctttattgtggcatctttcaactttggaggtatctggagaataatacgaaggaggttctttctccatctttgagtctagctgaaggctcaggctcacttcctcacgcggaccctgtcccaggcgcaatgttggaggtgacctcacccagctcctcatattcagctctctgagtgggtttcctgcatttgtgtaaaactgtacggaaaccaaaataatagcaacaagatccatttgtttcactacagaatacctgtgatgatgtggaaatgcatatgcattcataagtagatttgtattcatgttacggatgacccgcttgcttccccaaggataggcaccatatggagtgttcactgtacacatctccataaacgcccaccatgctaattggtactcagtgctgtacccatggggaagagaggataatgagaatgataatgacaatgatgacgacaatgatgacgacaatgatgacgacactaaactgcagatgccgattccaagatgaagatagttctgggcatacagacatgcttaaccaacgaggaaggagggaagggagggagggagggaggatcagatcgcattgaaacactcagtgtaagtcctaaaccaaattccttccttccttccttttttctttttcttttcttttccttttcttttttatttgagacagggtcaggttctgtcacctaggctggagtgcagtggcacaatctcagttcactacaacttctgcctctgggctcaagtgatcctcctaagtagctaattagcctcccaagtagctgagactataggtgcatgccaccacactcagctaatttttgtttttttttgtagagacggggttttgccatgtttcccaggctggttttgaactcctgagctcaagcagtccatcagccttggtctcccaaagtgctgggattacacgtgtgagctagtgcactcggcctttttgtttgcttgttttaaagcataattactctattattaccta

SEQ ID NO: 18468 - DNA, 1060 bp, Homo sapiens
aaattatccttatattcttgaaattaatcctgcttggttgtgatgtatttttttaatacatttccagatttaatacgttaatattctcctttggatttttgcacatatgtcataaaatttcactcataattttgttatactgtctttttcttctcttactaagattaataaggcaaggcttggtggctcacgcctgtaatcccagcactttgggaggctgaggcaggcggatcatttgagttcaggagttcaagaccagcctggctaacatgatgaaaccctgtctctactgaaaatataaaagttagccgggcgtggtggcgcgtgactgtaatcccagctactcaggaggttgaggcaggatgactgcttgaacccaggaggcggaggttgcagtgagctgagatggtgtcactgcattccagcctgggagacagagtgagacgtctcaaaaaacaaacaaaaagattaatatagctttttttttggtagagactactatgggttttttttttgtagagactactgtgttgctcaggctggtcgtgaactcccagtctcaagcgatcttctcaccttggcctcccaaagtgctgagagtacaggtatgagtcaccatgcctggacaaaatacagctttttatttattttcttgagacagggtcttcccatgctggagtgcaaagacataactgtagtattttcaaattttttttaagttggcctctaacttaattgcatgataatcacagaacagtctgtatgatactgattgtttcgtttttatttatacttaatttgtggcatactacacagtcagttttcataaatatttcatttgtactttagaagtttgtataacaactgttgggtgagggggttggggaacgcagaaaaataaaaatgttgggtgaagttttattctgtatgtccttacatcaagcttatcagttatgttgtccaaatcttccatattttaccaacttttgatttttgttttgttctgttttgttttgtttgtttgtttgttgagacagggtcttgctttgttgcccaggct

SEQ ID NO: 18469 - DNA, 1044 bp, Homo sapiens
gcgccatctcggctctctgcaagctctgcctcccgggttcatgccattctcctgcctcagcctcttgagtagctgggactacaggcgcccgccaccacacccggctaatttttttgtatttttagtagagatagggtttcacagtgttagccaggatagtctcgatctcctgaccttgtgatccgcccatctcggcctcccaaagtgctgggattacaggactgagccaccacgcctggcctattttattttgtttttgtttctgttgtaatttctggaaacttgtacctggaagtgaaatctattcacagcacacttctccctgactatccccccaaaattgtgccccaaaatgcttatacctgtttagctctttgttagggaccatatctaccatttggccacaatttctctatgagttgttataagactaccacaggaaagatcgtatagcccctcctataaacttagtttgttcttagggaccaattaaataataagccagcaaagagctcgacccccactgcagaggacatttcgtaagaggggattcataggagccccactttctctttcccagccctctgttctgaagaatctgaatgtgtctaacttgtttcagagttcactgtttctttccatttttctttctgatgggatgattgcttctgccaatggctagactagagcataagaaatttttatcttggatcgacatctgagagctctaaaagaaaacaccaggcagtggggggacggggtgggtgggattttaagtcaggcctgcaagaggcagctagtcatgggtctgcactcagcctggtgcttttgcttccttggggtgctgccaacagaaaccgttaaataggcagcatgctggtgaggcctatacatctgtctgggataggatcccacagaggggtcttgtgtgggattgatccaataaccccatagtttgagtcaggtgacaggtcagcaggggcctgaattttcctccctcttctagtgatctgcagaataatcaaatgaccaataactaagcat

SEQ ID NO: 18470 - DNA, 1022 bp, Homo sapiens
aggcaggaggattgcatgagcccaggaggtcaaggctgcaatgagctgtgatcacaccactgcactccagcctgggcaacatagcaagaccctgtctcttaaaaaaaaaagaaaataaaagtgctgtggctctaataaatggtatctcatgttgttattaaattgcaatcagtttggccatcaaaaattgaattgtgggaatcctttttagccctatagctgggcctatgacattctttgtagttttgtaaaatggtggagtagattttcttaccttgtcagccataagagttgccccctgtgactccatttatctgctgtttataatatcagtcctttcaaccatctttgactccagcaggaactacagcccattgaacctattttcttctccctttccctcacgccctcatgcctgtacttttctccttaaacaacttaaattccatggtcagtcattataatgactgcctcatgtactacactctcaatcctcttcccctcttttgccttgtcacacttgcttggctaaatcacaactctggttaaatccaaatctctgcctactttgtgggtgtgcccctgggttagaagaaacactgagcacattcgctgtcctcactcttaattcatgattactaaccttaaacaggcccctaatgctgtctgggaatcctgctgtatttccacagttccttcattctccagcctcctagaggactcttccatactttctcctctcttttaaaaacacctttcttagcctttgttgatgaccttcctatttcattgagaaaacaatggcactcgccaccgtatccacccacgtgcttgtatatctgccttttccccctttcctgtaactaggtatgagttgtacatgatccttgcaagggccaatacctccatttgcaaacaaaatttcattcccacttcctgagtccatccagagtgctgctccaaccttcctctgctctctgctaaatattaccgctctagtggtacattcctattggcatact

SEQ ID NO: 18471 - DNA, 1018 bp, Homo sapiens
cctgtctctacaaaaattaaaaattagttgggcatggtggtatatgcctgtagtcccagctactgaggaggctgaggcaggaggatcacttgagccaaggtgttcaaggctgtagtgagctgtaagcatgctgctgcactccatctgggtgacagagcaagactccactggattaccatggaaggtttaagggtactattggcaatacatgtagagtctatttctggactttattctgtttttctttatacgtctgtccttaagccaataccatgttcctttgattactgtggtgttataataagtcttgaaatcaaatattattatttgatttctttattctttttttaaattcttatttagggtattctcaggctttcaaatttccatataaaatttagaatcaccttgtttatttctacaaaaaaaaaaaaaaaaggaatgcttgcaggaattttgattgggattttattgaatttaaggataaaattgaggaaagttaacatcttaacaatattgcaacttccaattcatgaacacggtatttctctagcttcatttaagtgctatttaatttttctcatcagtgttttatagttttttttttttttttttttgagacagcgtctcgctctgtcacccaggctggagtgcaatggcgcaatcttggctcactgcaacctctgcctcccaagttcaagtgattctcccacctcagcctccaagtagctgagattacaggcacaccaccatgcctggctaatttttgtatttttggtagaagcggggtttccccatgttggccaggctcatcttgaactcctgacctcaagtgatctgtttccctcggcctcccaaagtgttgggattacaggcgtcagctattgtgcttggcctatagttttagaataaaagtcttgtgcacattttaaaatatttacctctgaatgattcttctttgatgttgtttaaagattgttaaaattaattgtgacaaaatacacttagcataaaaatt

SEQ ID NO: 18472 - DNA, 1060 bp, Homo sapiens
gcatcttttgaagctttcatgatgagcagaatggatgatactgttgagatctgtattcatccaggatcttttgttcctcctgtttcagcaaactcttaagattggaactacatcagtagataggtgtgcaatgccagtcttttgcctcatttattaaacaaggcagccgggaagtactcagttttaatgtcacttggtcttcactcttttgtttttttgttttgttttgttttgtttttggagacacagtctccctctgtcacccaggatggaggacagtggcgcaatctagtctctgcctcctgggttcaagcgattatcatgcctcagcctcccaagtagctgggattacaagtgtgcaccaccatgcctggttaattttttgtatttttagtatagacggggtttcaccatgttgaccacgctggtctggaactcctgacctcaggtgatctgccacctaggcctcccaaagtgctgcgattacaggcatgagccagcattcctggcccactcttcttgtttgtgggtagatctcccccaccccagaccttctctccaattcaccttttcttccatctcctttaacattgtaaaaaatggtttctggaccccaaatctatgaatagaatgtgcttagaggcaggagagtactgagctgaaaacatctcactaaccactgattttagttagcatggcctttagaaaggagttaaagcactcatataacctgttttcctaatacaaaatttgggaagcaacaaaaccttttgctgacaaatgtggaaaagtctatgatgaggaagtggattggatcttgcttgtgaacacttattttcttccttctggtagctagatttcaagcttctcttattcctgagatgtagtgaccaagttcatatatgttgactatgattgcatatcatttacctagaagaatattctagggcagacttgaagcctatttttgttgtctgttgttaggcaacaaaacctacctcaaaacttaatggcttaaaacaacatctattttatatttgatcataattctatgacttgg

SEQ ID NO: 18473 - DNA, 1066 bp, Homo sapiens
acccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaa

SEQ ID NO: 18474 - DNA, 1046 bp, Homo sapiens
agaaaaaacaatcctaaaacttgtatgtaaccacaaaagaccccaaatacccaaagcagtcttgaacaaaaagaacaaagcttgaggcttcatactaactgtatcagtgcattctcacactgctataaagaactacctgacactgggcaatttatgaaaaaaagtttaattgactcacagttccacaagcttaacaagaagcatgactgggaggcctcaggaaacttatactcatggtggaaggcaaaggggaagcaagcagcttcttcacatggtaaccggagagcatgctagcaaagggggaagtgccacacacttgtaaaccgttagatctcatgagaactcactatcaggaaagcagcaagggagaaatccacccccatgatccaatcacctcccaccaggcccctcctccaattcgacatgacatttgggtggggacacaaatccaaaccatatcactagttgaattcaaaatacactacaaaggtatagtaaccaaacagcatattagcatcaaaacagacacatagacccacggaatagaacagagctcccagaaataaatccacgcatttacagtcaactgattcttgacaaaaggtgccaagaacacataatgggcaaaggacaatctcttcagtaaatgctggacgttcacatataaaataacgaaatacagaaaaataaactaaagacttaaatgtaagacctgaaactgtaaaacgactagaagaaagcagggatccatgacatcgatctggtcaattttttttttttaatctgacttcaaaagcacaggcaacaaaagcaacaacagacaaatgagattacatccaactaaaaagctcctgcacagaaaaggaaacaatcaaaagagtgaaaagacaacctttagaatggggagaattatttgcaaatcatagtctgataagggatatctaaaatataaggaactcagacaactcaatagcaagaaaacaaataacccaattaaagagcaaaggacctaaatagacacttctcaaaaagaagacttacatatg

SEQ ID NO: 18475 - DNA, 1084 bp, Homo sapiens
ctgtaattggtgagtgaagggatgcacaggaattgaagggatgcacaggaattggcaggatttagggattgttgccttttgtagtctgttttattatttgatatttggttcatttttcataaacttcaaacactcagctctcaaacatgacctacctaggcctcttctcatatagcatgctttgtaatctgtctaaccagtatagcttggaagccctaatacattcatacagcagtgctttttgagtacttactatgtataggcattggtgggtattggagatgtggtgatgaacaaaacatacaattcctgcccttaggagcttacagtcttgagagtgaagtcaaacatttaacaaatctaatgaacatgtgtgcacatatatgtgtctctctctttatatatacatatatttttcatattcaatgtagcttctaatattctattggaatactatagtcaattatacacacatatacacatatactccccctacccctcacacacacgtgcacacacacacgcgcacacacacacgcgtgtacatatacatacacatctgacatgaataaatgtaagaaggaacacagcatattaagaggaactgaaggaagtccagtgtgattggaatgcagagggcaagggggtgatagttggaagagaccagatattgtaagaaatcaagacttggtgattaggagctggttttactcatcattctgtctaggtggatgagagccctcctgattttgaaatacatataactatgtgtgatgatgatccacccacacctgaggaagactcagaaacacagcctgatgaggaggaagaagaagaagaagaaaaagtttctcaaccagaggtgggagctgccattaagatcattcggcagttaatggagaagtttaacttggatctatcaacagttacacaggccttcctaaaaaatagtggtgagctggaggctacttccgccttcttagcgtctggtcagagagctgatggatatcccatttggtcccgacaagatgacatagatttgcaaaaagatgatgaggataccagagaggcattggtcaaaaaa

SEQ ID NO: 18476 - DNA, 1022 bp, Homo sapiens
cattgcagggccggtggtattttgaatttattactttctgattgggcattactttttttttttcttagggcacaaaggactatcttgagtgacatggttttctaatacctacaagctttatatctttaattactcatcagagaaggcaggaaataaagtagttcctaagcatatacatatttcaggtatctatttctggaaagaagatttttacttgtttttaatttgttttttctttttgctgatatccttttgattattcacccccttacaattatctcacccttttgaggtgggcctagctcttgatggtggtgggtaaggcgcaaacagagtagtctgtgcagccacctgccacaacatgtagcaacccaagctgatgcagaaaagcttcctggagagtgatctccatcctgctcagggttcatctttagccctcatgtgacagtcctggccgaaaggaactgggtgagtcaatgtactttaggatatcctgtcttagttgttgtggttaaaaacctcacctgcaaaagaaacagcaggctggcaccatgtctgagacatatataagttctctggctgaacacattttctgataactggataacagagtcatggcttgtcaatatgactccagccattatcattgacacaaaatcctttctaaacttcaccctatctcctccctccttttggggtcttaagacttccagggccacacattcccgacctatttttcatgtctgcatcttcaagatgtagattgagtcatgtctaattctatttgaataagttttatttcttcaaagcaaatccatcaaaccagatatgtctcattgtgtaacagtacagagattttggtaatgtgtattttctatgtatacatttcttaatataactttgtattttaataaaataaatgtccttactgatcttgtcaggatattcaaatttagctttattttttcttttatcatgagcagtaagtatatgcagactctatttgcaatactgtaatagtg

SEQ ID NO: 18477 - DNA, 1099 bp, Homo sapiens
cacccggaagtgtgatgccaccgccgctacggggaagtaatggtatccggccaattgagattcggagttaaaacaggtgtttgtatatctctatttcctgaggcccagtagagtctcctcttttcggaaagtgttggaggggggacgtatttgggcatgattttggatgtctcgtcctattgaaatccgtggggaaatgagcagtaggagtgtgtccaagggggcctgactctataaaggcttttcagaagtttctttcaccgcccgtcaccctcgattcccctcccactcagggatgtgcagatggaggtcggaggagacactgctgccccggcccccgggggcgcggaggacttggaggacacgcagttccccagtgaggaagctagagaaggtggaggggttcacgcggtcccgccggatcccgaagacgagggcctggaggaaacaggtatgactccacttagtggggtcttaaaaggaatccttaggggttgtcattgttggacgggggaagggtcagtgggtgaccagtagggagtcttgggacttaagagaagtggcttaaaccatcgccgggtcaggaggaggtcactgtggacacatggtgtagtttacatcattgaggaagtcattggctgtcaacggatgttcactgggggtttggtgtgagtttaggtcattgaggaatcaaaaagggggctgttaggaccaaagagggtcactgaggatttagagtgtttagatcaaagaatgcgctgaagaaagtcaatagactcaacagaggaggactgttgagaagttagtgtttttgaggagtagggtgttatttattaaataatagaagtgggaaggggaatcagtggagttcgatgggcactcagagtatttacatcattgaagtcacttgtagactgttggggaagtctttaagggaccaaatgttagtggatgtgtaaagttgttcatttgagatttaatggaagtcactgagaagtctgtgccattgatcactttggaattagtggatgtaaatggagtcattgggaaggatcagtggacctcactgagaataaatgtggatggggaggttgaggac

SEQ ID NO: 18478 - DNA, 1143 bp, Homo sapiens
tatttctactggacagagtggctctagatgactcatgtgtggccaggacactaggacactggagaagtaatgatcaccccatgtacagatacagtctgtgtcctacccacatccttaggaccctaccattgcagtgagctccagatcacttccaacagccaacatttgcatctgtgttcctgcaggctttttccaaagccacagcaggccagctggaagtgacagggaattaatgtcccctacattaaccctcaaccaatgactgatgggattttgcatatcagtagctcaggttctttgccccttgggtgggataattctgagacaggtgttctgtacttgctcccaaactgaactaaactctgggtgcccgctgtggtggcaagtttcacacttcttttcattggctgccttcccttctttgtctcatttctccactcccataacaatgtgccctgtagattccaaataaataacttgaatcttgtctttaggtttctaggtaaaccaaattaagacactcctatatctaatccgtcgccaaatcgtactgaatttatcttctgaatatctatcaaatctagttcttctcatctctaccgacatcaacttagttaaagctgtcataaacgtctgaaaacttttgcatctatctggtaactattaccctgcaccatctctcttctatagccagagttatttttcaatataaatatcatcatattttcttgaggcactcaaatggcttcccattgttttttatgaaaaagatggatggctcttacaaggccgtgtcctggctcctgtctacctatctggttatgtgtagtaccatgagccccctccctgctcatccactcctacagcactggcctgtagaggctcagtttcagtccatgggtgcctcagaactcttgcacaagctgatccctcaatcatttccctttgcctggttacctcatacttattgttgaaggatgccttctctgacaccttagctaggttagttctccttgttataagctctcttggtgccatgtacctctacttcataactcctgtcatagttacaatatgatatccccttgattctttgattgatgtcccctcattctctggacttcaacttccataatggcacag

SEQ ID NO: 18479 - DNA, 1131 bp, Homo sapiens
gtgttttgttttgttttgtccagaccggtattgctcagtcatccaggctggagtgcaggggtgccatcatagcccactgtagcctctacctactgggttcagacaatcctctcatctcagcctcttgagtggctgggactacaagcgtgcactactatgcccgactaattttttaagtatttgtagagactagggtcgcaccatgttgcccaggctggtctcgaactactgggctcaagcaggccacctgcctcagcctccagaattgagattacaggcgtgagccactgcgcctagccaggagtattttttagtagcagtcctagatagcttcactatcatttcctgggaaagttttggaaaccccagcagagccttcatctttaactgtgtgaccttgggccattgaaataacgtttaatcttggttttttcacctgtaaaatgggttgatacgagggtcagttcaggcactgtgcgtaaagcacatagcaccgtgtctagtaggtactctctgttccttaactgtcgttccttgattgctcttaagatacgacagtgcctcttatatcggcaccttagaatcacctaggaaatgtcctaaatacacgttttgggtctccatagagaacctactgtagccgactctcaactttgggagtctctttttttaagctttccaggtgaggtggaatatcacctggttttgagaaacatggatgtaaatctgattttcagcatctgggaaactttttttgtaagagcctttttctgggccccacttccagagggtttttcttttttttttttcttttgagacggagtcttgctctgtcgcccaggctggagtgcagcggcgcgatctcggctcactgcagcctccgcctcccgggttcacgccattctcctgcctcagcctcccgagtagctgggactacaggcgcccgccaccacgcccggctaagtttttgtgtttttagtagagacggggtttcaccgtgttagccaggatggtctcgatctcctgacctcgtgatcctcccgcctcggcctctcaaagtgctgggattacaggcgtgagctaccgctcccggcctttttttttttttttttaaagacagggtctcgctcc

SEQ ID NO: 18480 - DNA, 1045 bp, Homo sapiens
gcacgtgccactgtccccagctaattttgtatttttggtagagacagggtttcaccatgttggccaggatggtctccatctcctgaccttgtgatctgctcccctagggctcccaaagtgctgggattacaggtgtgagccaccgctcccgacggcctctagatattttgagtgattcagcaaacctcctaaagttgaccccgtagctggggtcacagtcctctttctccttcttccccctacttccttcttatatctggctatctgggagagaaaaaatttaatacaattgattactttttagaagagttaatttttacttattactgtggattttttgttttttaacagtcacaccgaggagaagactcagtgggaacatccaaaaactggaaaaagaaaacgagtggcaggaggtttgtatgttgttgtctaaggatcttggatggaagcattaagtagatgaggaaatgtcactggcagagaggtgacaggttattgtgtgtttagggagggctctctggtagagaaccagactcccactctgaggagcttatgggatttggcagaagaagatgatgagatcatagggtggagtgaggatgatttcttactggtcttaaagtaccaaaatggccagatgtggtggctcatgcctgtaatcccagcacttcgggaggccgaggcggatggatcacctgaggtcaggagtttgagactagcctggccaacatgttgaaagcgcatctcttctaaaaatacaaaaattagctgggcatggttgcatgcgcctgtaattccagctactttggaggctgaggcacgagaagtgctcaaacccaggagctggaggttgcagtgagccaagatcacaccactgcgctccagcctcggtgacagagtgagatgctgtctgaaaaatagcgacaacaacaacaacaaaaaccagaaaataattgaggcctttgattcacagtttatgatgttttcctatcgttgcagtgtttataaaattgttcttggctatactatggaattaaatata

SEQ ID NO: 18481 - DNA, 1057 bp, Homo sapiens
gcacaatcatggctcactgcagctttgatctcttaggctcacgtgatcatcctcctacctcagcctcccaagtagctgcgactacaggcgtgtgctatcacacttgaaattttgtttagtgtttgtagagatgaggtctaactatgttgcccaggctggtcttgaactcctgggctcaagtggtcctcttgccttggcctcccaaattgccgagattacaggcgtgagccactgtgcccagcctccagtatattttaataccatttctacaagatttagatcaattccaaatcaaaatgagtgctcgtaggaggtatgagtgcagagtcttaaaatgaaaatcgttagaattttggtagttggcaggtttcttatttacaactaagactttatcattttgagttttctacttctctacgtctttaggcccttgcacagggctaagagatttaattgaaatctactgaaaagagtggctgacagatcttatagctacatttacatgaattacataaaagcccaaaaccttctcaagaagccttttttgagatctaaggatacatggcaatagttattgtatgttacagcgtatgttataggcagttctgaaggaaaggattcgatgactatctttttttggcacaaatgtgatccttctggaggccagaagatagattcagtgggccccagttctttcaggtttaaggaataagcattttggtctatgaaaaatggggttttcctaaagtataagattgtcttatatttataaatgcctgtgttcattgctgtgggttcactgctttctcttttgggcagccatataaataaaagaaccacctacttggacccaagactggcgtttactgtggatgataatccgaccaagccaaccacccggcaaagatacgacggcagcaccactgccatggaaattctccagggccgggatttcactggcaaagtggttgtggtcactggagctaattcaggaataggtaggctcttcacttagttatttatctttgggactgctataatgagatccacttagatc

SEQ ID NO: 18482 - DNA, 1050 bp, Homo sapiens
tctttcttttttttttttaatgccccatatgacgctgctttgttggaattgccattggtgaggatctcactgataaagaaggggacatccctcccttgatagactttagggttgcactagagccatgccccctttgaagtggcctctaagcaaactctgtcttgtcatcattttcctctctgcagctgtaagtgatacggagctgtattttgagtttttgatactgatattactaaggcaattggagggattcttaattcatctaaaaaaaatcagggattctgacagataaaaggatttggaggaaatgtcagaataaagcattgtgggttcatgaagtcctaggttttataattaaggtttataggcaggtattaccgctgctgactggattcaactgtctggattggagatgaacaaactgccatctctgggctaactctgacccactgcctgattttgtaagtagaattttttttggaacacagccatgcccatttattcccattcctataatgttgaactactgtttgtgtatattcagttatcccaaaataatatggccctttgcttgttaccagaagagtcgcccagttgtggcagagatcatctagctcgcaaaactgtaaatatttactctttggcctttcccagaaaaaagtgccgactgctatgttagatactccagttcattgaaagtgatatcaccctaacattctctaaattagccacagcttagatgaaatttaggcaaatggaatgccccaggccccaggaagactgtggcagcacattgtatgtaactgttggggatgttgcctgaaacccccgccttttttttaggcagctgcaaggattagaatgttgcctcctcagaaactaacactcttctctccttgacctttgtttaaccagctttctgaacctgaagaactttgtagattgaaagctgtagcttgtggacctctctctgtggagatcagcatctcagtatccagggggaagccatctcttcacccaaagcttccgctaggagatcaagaggcccgg

SEQ ID NO: 18483 - DNA, 1018 bp, Homo sapiens
aaaatagaccataatcaagtttaatatttgccataatgtcagtaaataaaggactgtaaagcagaggaaggtggggggaatgatagcgtgagtgtgatggagtcatcagcagggagccttccaaagttgtgacatttgatctgagacctgaatgaagtaggggtaagccatgcagatgtcaagagaagtattctcttagcagtgagaagagcatatgctaaggctcagaggtaggcacaagcctggagatttcaaggatcatcagggaagctagtgtggctggagatgaatggagtgggtaggagaggtgctgttgggggatgggtatctggtagactctgagatagcggtgaggaagacattagagggtttgagctagagagtgatgcgagctgtttgatttttgaaacatcgctggatttcagaatgaagtccagactgcattcattcacttttcattcattcacatattcatgaagtgcacctctgtgatgggtgctggggtctactgttaaggacaacagacgttgccactgtctttgtagagctttcagcctattgtggaagacaaatttagtcaaaaaacacagatcttaatgtaaacttgaaaaagcagtgagtggtcctaggaatcagtaatgatgccagggagttgggagacctttggggtccccaaggaagaagtgattgaactaagatctgaagaaagacctgaagagggtggagaagggtcagatggggtaggggaatggcaggtgcagaggccctgggaggagggggaggaggagatagagcagcgtgtttgggagcagagcctgaagggggctgggtacaccctgtggaggccgtcttcatttttgaatgctgtgaaagatttcttgccatttgaagaaatagactacagtgtacttaagaaaatttttggtactctggactgaaaagtagtgaaaataaagaaaaggaagatttatttctgctttttcagtgtatttatgatgaaatatttgaaattcagtat

SEQ ID NO: 18484 - DNA, 1045 bp, Homo sapiens
gtggtcaggagtttgagaccagcctggccaatatggcgaaaccctgtctctactcaaaatacaaaaagttagccgggcgtggtggcacgtgcctgtaatcccagctactgaggaggctgaggcaggagaattgcttgaacttgggaggcagaggttgcagtgagccaagatcgtgccactgcactccagcctgggtgacaaagtgagaccctgtctcaaaagaaaaataaataaaaagctttgttttaaaataagtttagattctcatagaagttgcgaagaatagtctatagtattcttcacaagggttctgggtacccttaacccagcttccccagtgatagtcacagcataacaatcaagtctgggaaattgacactggcatgataatattaactaactacagattttatccgagttctgctagtgtttgcatgtactcatttgtgtgcggctctctctgtgtgtgtgtagttctatgaaaagttataacatatatacatttggtttaccaacatcatagtcaggatacagaactgtcccatctccccaaagaaacaccctttaccttagtttttattctttgagttatatcttaaccaggttaactgagggtaattgtcttaggcaagttagtaccaaatgatgctcttggttccttgtctgtctttttgcccatccaacccacccttcacacatggccgagttatgccaaactttgcaagaggtgccaggtgggcacaaagaaaagaggactgcactcaaggaacttagtctttgaggccaagcacggtggctcatgtctgtaatcctagcactttgggaggctgacacaggcagatcacttgaggtcgggagttctagaccaacatggtgaaaaccagtctctactaaaaatacaaaaaattagctggccgtggtggtgtgcacccgtagtcccacctacttgggaggctaaggcaggagaattgcttgaaccgcggaggcagagattgcaatgagccgagatcgcgccactgcactccagcctggtccacacacagag

SEQ ID NO: 18485 - DNA, 1092 bp, Homo sapiens
gcatgaactggtttgggccagttatggtctgttacatccttgctgaaatggttggtgctaagatgagcacttggcttaggccagaccagtccctagcctgtggagaaggggcaatctcttatctgaaggcctaggaggtgcagggatgtttatatgggctgctagcgcttagtttcctgccacagggagacagtaagaaaggtgacgtcaatctgagatgagagagagagcaaaacagttcttttgaccaccttgaccccgaccttgaaataaggtggaactaataaatcccgctttgtgctggagcaagttttggctgagtttctgtcacttgcaaccaaatcagtcctatccagtatacctagtgactctctggtctccaaaggctatgcctgctgggtactgagtgtctccccgaccgaccccatgatggctacagtgcacatcccttccagccaactctattgtgcacacatattcgtagggtgagttgggccccaggtagagtgattggctcagatcctgcatcctttcagggtctgactgtaatcacactggcatggcagggggaaagtgtattggatttcagagtcaaaaaccacttggtatgaaacccagctcattttctatgtggatgtccaacctgagccagataattaatcttggagatgacgctgcatacttcatcaagttgtaaagttgactgctgtgataatggagaatgctggacaggctgcttttcatgtcatgggttcgctatactttagttcccattatatcatcctgccaatccccatttgttgtttttttgggacccagggtatcagtcatctgatcattgtgtgactttctcaaggacctttacttgagtcttgcacctctggtccacaatgtccacataccagcttgatggtgacttgtgtcattctccatccccttgttaagagaaaatctactttatgagccctctttccaaccgcagtgttgaggactagaccaggcaagatgatgccgctggaccactggatccagctggaccgctagaccacagagcccctggagcctcccaaggccaagcccgccagccacaca

SEQ ID NO: 18486 - DNA, 1133 bp, Homo sapiens
aggttttgggtgaggatttagaacaaggcaggttcttgatcctcggaagagattcttatctgagaggggatttgagaatggcattgcagagtgggaggcgctgctgtgtggaaaaatgaactggaataattattagaacagttctcagaatttacaggatatttgatcataggagtaactttcctcaggagtgatggatggaatgcctgtacttggaatatttttaaattaatctattttcattacattgaaagtatgacacacagagaacactaaaattggatgaggcactacctggaattatataaagaatgacaaagatgcggttatccatttattttctaggcaagttagttagcctctctgtgtttctatttctttgtttataaaagagggacaaaaataggacctattactatctaggtgacaggatcattcataccccaaacctcagcataatgcaatatactcatgtaacaaatctgcataagtacccccttaatctgaaataaaagttgaaattattaaaaaagaaaacgaaggccgggtacggtggctcatgcctgtaatcccagcactttgggatgctgacgcgggtggatcacatgaggtcaggaattcgagaccagtctggccaacatggcaaaactccgtctctactaaaaattcaaaaattaggcttggtggcacgtgcctgtagtcccaagctactcaggaggctgaggcaggagaatcacttgaacccagtaggcggaggttgcagtgagccgagatcgcaccactgcactccagcctaggtgacagagtgagactccgtctcaaaaaaaaaaaaaaaaaaaagaaagaaaacaaaaacaaataggacccatatccctggattgttgaggaaatacgtgaacatatgtggcacacattatagtgtctggcatacaataaatactttgtaatgttactggtgtcttcttaccgttattgtctcactggtgaccgtttgaaatgttgaagctttattgttacagataatggtggatatagtctcttccttgtttattttttgacagaatctttttttaaaaaagtttttatttgtttggtgagaatttacttgttacaggtctagtgctgttatagtt

SEQ ID NO: 18487 - DNA, 1010 bp, Homo sapiens
atccatttaaaaatgttaggtctacccagttataattctccaaagtagcctatctgtggtttaatatgttatctacattctctaaggcagtgttaatttccttttgtagttaatctatcctactaccaaatttagtatatttatagttaaagattctgttaagagctaagtgatttaagtacatctgggataaagtggccttggctttaactatgaaacaaattttctttatttcattctcttcactgataaatccatagtaactggaggcatttttagaattgtgggcaatttcagcctctaaagtttgattaaagatacttcagatattcctactgagaggctagagggctgaaaggaatttattttgggttctggccctagtgcagctcagtggaagagaacagacattgtgagtttaattcccacgctgccaatttcccacgagtctagggtgggtgttacttctcaagaaggcgatggtagaaccgctggagacttcttatggctgtggcaggggactcacacgtcacaaggagtccagaggcatggctttgaagagctcttttcattcattcttccttttgttcacttgtacatcaaatacatgctgtgggcctactgtgtgctgagcactgatcttgtcaggttcttggggaagacttcattgctgaggtgacctttgagctgagtgtatgagtgcaagagagagcgatcacacctgggaactgcttaataaagtccccggcatcttgaagccacttgcagaccttggcagttgctgttgctcctgctgctgctgctgctgctgcattgtcaagactacattgatgtcttggaaatatagaaaaaagaggctgctggactgtgtgcttagaatcagtgtgctaactctgttaccaacaccgtagagaagtggttccagaaggaagagttcagggtgagaatgaataacggagtggctttgcagtgggaacctggctttgcagcacagctaggattggagaaga

SEQ ID NO: 18488 - DNA, 1033 bp, Homo sapiens
gtgctttgtcacccaaagtcaccgcagctcctcttgagtgctttcaagatcagaccgaggggtcctagttcaagctaattcctacctgtgcgatcactagccaagtactgaacctctctgaacttcaattatctcatctgtaaaaggtgttggtttgtaattgttcctacctcttagggcttttgtgagagtttagatgataaaccaccaagcaacagtggctggcattctgtgcacaatcgaagtctgctgctgtcagctctgtggtcgctgtctgcactcccacccctgtcatcctccaagtctgatctcctcccgaagtctcttcctggacctcagccctcagggattgcacctccctctgaatatgctgtcccttctaatcatgccatttagccacactgcctagcactttcttttttgaatattcgtgtcccaggtccctgaaaaagttgctaagcctgctaaaagcaaggcaaggcctttctttctttgtaaccttaatgcccagcaacgctccattcagtttgaccctcagttggcttcatactttgattttatgtctttatttgtttcttaatgagctactttatcattgtgaaaacagttaaatatcaatagtcaatgaataaatattaccaaaaaaaaaaaaaggtttgtcgtttaaaaatttggagctgggctggaaactagggatactacttggtatattttagttctactgatatgacagtatttgatacttaatcatattcaagcagctttacagagactaccatgagaatgggttaaattaagaggattgtctttgctgtttagccaatatgggccaaagttcagtggtttgagacatggcggggtttggtagtagatgtaggatattgctggggaaagagtgttagaggatggaagattgcatgatatttctggctttgctctttgactgtgtgctgtttgtaaaatcacttaagtcccatgggtcattttcttccccatatcaagcacctgctatgtatcaggtgttgtgctcacg

SEQ ID NO: 18489 - DNA, 1033 bp, Homo sapiens
ggtgtgagccaccacacccagcccctctccctattttaatgcgaggtaattaacaaccttaatttcaccggtaacctgaattctcctttgccacgcagtctaccatattcacgggtttcagggattaggacctggacatctttggttgggaaatgggcatcattttgtctaccacaacgtgagagcccattgccctgcatccacagtcataaaagtctgttcccttcctccctgattcttcctaacttctcctgcctgccttgcaggatatgtggagttatcagttcctagcaccactggccaaagcgaggatagctgattgcactcctactttcctgctggtggaaacagcatgtatataggtacaactctggtgtggggaaaatgctaaagatataaagtagaaatagcctttgtgtgatgtgagcagcagaacaaaaatcgagggtgccaaataatcgtatgaagtggtgaactgcctaagatggaatattgctgttcctaaatcctggctgtgttgagacatgtgatcctgccgatgagatgagagctgaaccactctcttctcccagatgctgggcttccgaccttaatagagaccgagaaacttaacagagggctcagaagagaaatctattgaaagttactaggtgccaggtgtctcggaaagtgtttaacacatgcctgagacgttaaaggcaagattcatgcattctttcagcagacagtttcttcacttaccggggaagggggtgtaatatatgggggtatagggataaataattctgtgtgctgtgcaggccgtggagactcatcttctgcacaggtcaagttctgaagtcagcatataagctggaagtggagtgaagtcaaatgaccctcaaagatccttccagacttcatgcccttggcaactcagtttggacactcatatgctggtttcttccttgtatttatgcagcagcctccttttccacaaaaagcagaggccaacgtatctcaccccctcaatttttttactttccctctccct

SEQ ID NO: 18490 - DNA, 1048 bp, Homo sapiens
gaagtccttggcgtccaggactaaagtcatgtgcaatttaacaagatcttggtgagataaaggaagttgcgcttgaggaaacattgaaacacaccagatggaattttccaattccctcctacatgatagagactaggtgaagggagatagaccacaaattgattttgtgtaactcttaaattaagtggagcagagttaaaaaaaaaaaatcactggatttgaagttggcctatgttagattactccaaggaagttagttaatatgttaatatgaatctagatgaacattgagtgttttgctcttcttgttaatttgcgccatctactaatctctggacaatggagaaaaagtcgtaggttatgagttttttatttatggacattaagcaatatctttaaaatgtaaaatgaagccgacaaaatgcacagccagataacaacaacaaatctaatctaaagtgacaggaagagactctcccagacatttttctctttaatgtaacatgactttaaattgatgcaaccccacagtgattgaaaaactctcagagcttgtctcctatgattacatttctgatctgtacaacttaattttttaactcggtgagtctcagttttgcgaatgaacagttctcttttgctttctctctcatattatttgggaagacattatttggcaaccaggcagataaagctctgttaccacgacgaatactgagaagtcctaaaacaataaagaccccaagaactcaccctggaatatgtacctccaaatctcttctcttttccttctctccttctctttgtttttctttctcttcctgttctcttgttttatcttgacttctctcgactgtggtgacggtttgcatatatctgcgattgtactgaaacttaccaaacattgtacgttttaaatgggcaaaatgtatttgaactatatatatcacaataaagctataatactcttttaaagtgtctcctgaatcattaccagtataattattctgtgaactgtattttgatgaattcagaattaatttaaaat

SEQ ID NO: 18491 - DNA, 1084 bp, Homo sapiens
ctcgctgtggagcgcctccagaacatgctctcagaggagatgcaaataggctcagggttcagggggctgtccccttccttttgctcaaggctcagaggggagccagaggaatgcagggagggacgcactccctgtcattcccctttcagtctcaggagattctggttgaagctctggcatggactttcctgcccaagaagtgtccttgcggtgatcatttatgtgatttgggtacctgctgcttgtaggctgtgactgtcagtagcagaaataaatatattgcctttctcactgtgtacagtggtgctgtaccaagggtgactctgcccatcaagggacacttgtctggagatatttgggttgtcatatcttggaggagaataggctgctattagcatctagtgggtaagagcaagggatgctgtagaacttcctacaatgcacaggcgcatcctacaacagagaattgtctggccccaaaagtcaatagtgctgaggctgagaaaccctgcacttgtgtggaccatgcccttttatgcttttcaaccttgaagcactaataggtcagagaagaatgccagggatgtgttgatgggtctgcaagaggttgatgggggatgcttgagctcctaccaagtggaaggtggtgtaggcaaagagaaggatgcataggcacattggacggtggaaggcaggggctgctgaatgatgtggcaggaaacatgcaaagtgctcagcgtccctgggcggtgcagagtcttgggaagcaagaggatggagccatcctttcagtttccagcctgggtttcccaaaggagagggtgtttgagttcagtggcagagagagtggggaagagtgttggagcccagctgagtggccacctttgtcaaatggagctgagaaatgattttcacatggctggcgtaatggcggagtttccaaaacagcagcacaacaaaatagccatttacatgtcaagactatattcatagaatccatatgtctaaggtggggaagttgtcattattcctgttttatagatgaggaaacagaggcccagatggagtaagtgactgctgaagt

SEQ ID NO: 18492 - DNA, 1023 bp, Homo sapiens
tagcttcttccagcatgtgatcatacatctacctaacctctcccattggttgaatttaatatactagtgaattttccattgcaaagatgaggttacgaatcatagtgttcatactcagaaggactttataaatattttgcctttttgaagtatatacaagaaatgaaaaaaaaaacaggaataaataaaaagaataaaaagagccaggactagaacctacaattcctgactcttgatcaaattgcttttctttttaactctagttaaatattttccattctttttaactcaagaagcctttgtttttgttgtcatcgttttatgattaacttatatctggtcctttagacatttagattttttctgttttatctctctctatatgtatatctgtatatatatttatctatatctatatagagatatatatatatatataaaataatgaatgaaatggactgtttgcaacctcagatgtatttctaggacttagagtgattagcttgaggcgatggtagtttctgtttttggagtctctgtaggtctcagactcacagtctgtacttcttgttttgggggctaattaagtggacagtttcagtgttggtagctcatttaagccataaacatgcagaccatgtggaatcccattagtcaaaccttagcagagtgccttgatgagtacctccttttctttctgaattctattagttgatgctttgttctttctccccaagagccatatctcagctatttcttttcatttcttgtgtatagttcaacatctttctttctttttttttctaaacaggatctcactctgtcacccaggctggagtgcagtggcatgaccatggctcactgcagcctcgacctctggggctcaagcgatccttctgcaacagcctccctagtagctgggactacaggtgcatgccaccacacccagctaatttttatattttttgtggagatggggttttaccatgttgcctaggctggtctcgatctcctgggctctag

SEQ ID NO: 18493 - DNA, 1089 bp, Homo sapiens
ctgtgaagtcagaggcagagattggagtgatgcgtctacaagccaagagatgccacggtcatgggcagcccccagaaacgaggagagaaacctggcacggtttccacaaggagtcacccctgccaacaccttggtttcagacttctggtctcctgaactgtgagagtcagtttctgttgagcttgtgctgatacgctagggcagccctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgtctcaggatgacaacttgcaatttggggatctctcaacgtcctgacctccatctcagtgggcatgttcctcacctggctggctgcccctgcttactgatgcagcctcctgtcacacggtactcacctctattcactgtattccaccaacactggccttgggagccagcagtacccccattgtacagatgaaagtcttgtgactgtcaacattaaaatgagaatgatattgacccatgatacttacccacctgttcagtggattcggtgtgccgtcagcatggttcccagcacatagtaagtgctccgtaaatgtcagcatctattattatcatttgtgtttttttttccccttctctgccttcctttctctccctccttggtctgcttcctcctgttgctatcagagcctgcctgcctcatccttgttccagccttgatggtgatgatgattgtggttgctgttgctatttgtttttttggtttgtttgtttgttttgagagggagttttactcttgt

SEQ ID NO: 18494 - DNA, 1011 bp, Homo sapiens
ctgcccacctttcttttttttgccatgggtgcaaaagatgcctctggggatcccagaggactcagcattggtaaggatgcagtcctaatcctgaaggagggtacagctgaccagggaggtaacacatgaatgcagctgatagggccagttggacccagatttcaactgcaatctctatttccttcggatctgttgcatctgctcaaacactagttctgcaatttcccaacacctgccccctgccccttataaaagctcatggttccatgtgactttccactcctgcgtctctggccttggggcaggtcagtccgtggatcacctcactgtcctagggatgctcttctggtccacactgtgcctaccttggatatggagttccacttgttcccttacctttcacccacctgtgctcctcacccaagcaggcattgatggaggtctcatactttactgaagatgtgaggaaagaggacacttatgtagaacccaactgcaggtggagccttggcgatccatagccctctgtaaagtggggattgaagcacatatcttgcaaggcttgggcattgattgcagggagtaatgtgtatatgaatcatcagctatgcaacataatgctgatgctaagtactaacattgatggagtgttggcatgagctgggcagagtgctccatcctctatgtgtgtattagttcattcttgcactgctataaagaaatacctgagactgggtaatttatttaaaagacacctttaattggctcacagttccacaggctgtacaggaagcatgatgctagcatctgcttggcttctggggaggcctcaggaaacttacaatcatggtggaaggcaaaggggaaggaaagcatctcacatggtgcaaacaggagcaagagagggagcaagggggcaggtgcaaaacacttttcaacaaccagatctcaggagagccaactcaccacacagcatacgtgctaaaccatgcatgagaaatctgtccgcat

SEQ ID NO: 18495 - DNA, 1074 bp, Homo sapiens
ttgactttccaggctcaagtgatcctcccacctcagcctcctgagtagctgggactataggtgcgtgcccccacgcctggctaagtttttgtacttttagtagagacagggttttgccatgttgcccaggctcatctcgaaccccttgactcaagcgatctgcctgccttgtcatcccaaagtgctaggattacaggcgtgagccgccgtgtctggcttgctccacgattttcctctatgaattccacctttcccatggtgggaccaaggctggaagtacttcacaaaggctccatttgaaaagtggctacaaataaaagggaaaatatagtattccttaaaaaaaaagtagcattctatttttccccattggtaagtagtacaaatttgagaaagtgtaaatttgaattccttaataatcagatctctgcaatgtgttttgcttttatcatcctgggttgccatcttggccaagtgtagattattctgctcagggtagccatactgagatcctggtgtgcacaggaaaagagctaacctttgtggatgaaattgtagagtcactacctgcatttgctgtagctcttacaattattttatttttggaagacatcgagagcatggtccaaagctgcataggttgcaagtgggtagaggcagaatttctctccaggcctggtggattctaaagctgtttactcttcacccaccatttcctaggtctggtttcttggttaaatacgtggaagagtggatggacagaaagacagattgatcagttctccacaggcttccccaaactggccaggtagaaataagctaagcaaataaatgacttccccattttataattttctgcaagtcacataagccttcatgttgtttatttcttggttttagatttttttaattataaaagaacattattatacattatttgaataattttttaaaattatagagctgtctaaaggaggcattaaaaaaaccctttctattccttcatctaattctatccctctgaggcaaccatgattagtattttgtacttcttgtacatcctccttcatgtta

SEQ ID NO: 18496 - DNA, 1081 bp, Homo sapiens
agacacaattatattggcatatttggactggagaacccagcatctgacttaaagagtctgcttctcttcaaaattgcttaggtgttttcaaactacaaacaaatacactcccaaaacctcaatagattctcccagtataccctatattttggccaaactggaatcacatcctggtctccccaaacactgcttgctttttgttcctttcttgctcttccttctgattgcaatgaactccccatttccagtccccatcctccaatcccttcatgtccagctcctgctcatcctttgaaacccactggattttaagattccatctgacaagaatgatcactgttccttccagttcttcaagcactttttctgtttttgatgggatttatcacttgaaaatgcatattatagtaatttctgaattcatcctgattctcctactggtttctaaactcttcaggttagaattcctgttggatatccctctggcccgaaattcctgaatgagttaagcaggacacctagaactatgcagaggtaataccttccttgacctgtcccttttctgggtcagtttgcccttcatgatttcggcaggagtgtgtctccttccattctggtgaacacatccaatgttcaatgttgctcatcagggtaagagttctaagtccctatgtcttagagacaggggttatctagctttgtcttctgcattggcttcaggcttcacatccttcctggacatgttcaatgctgctttcgtttcttgggcgagggccctagaatcaccttagacaccttgctctagacatggccccatcgtggtattcccttttgagaagacaaagattttaaaaattctttctcccttaatgcctcatgaatgcccaagcagcacttcatggaagtacactgagtctctactgcttgcagggattaaacataacattctcaacagtggtaagagagcctttcccttctctttggctcgttttcagtttttattaatttcctgtgcttctggttcatgaatcccaagtcatgatgtgaatcagttcagttcagcaagcactgagctcccatg

SEQ ID NO: 18497 - DNA, 1749 bp, Homo sapiens
aatgtaatagagctattagaatccagtgtagtagattggtaatagtaaggaacaacagttgtcttcacattgttaaaataaaagtgagataccctttaatcttcgcaaagggaaataactcttctgctaaccctcctgcccaacctgagatgaagtatcaggggatgcagtatggatgtattttcctgacgattggtccttctgtcctgggacccaggtgtgagtgcatagggaaaagggaggagaaatttaatcctgtaactatctccttatggaaaacaggaaaccacagatgaatcaaatgaatccgtttcccctctttctgatcctctgcaaaagtcatcaaaatcactctgttctcaccaggcaactggagtttcgtcagctgagtctagagtgttccaggcagttacagctaatcatggcaggctctacccaactgggggaacaatttagctgttgtgggatttccctttaaattaaatatgttcttcaggtacagttttttaaaaccagtttttctcccccacttttaacctactttatcgtccattgctgggcctagaattgcatgtccattggcatggctgacgttatatataaatatttggaattgtagttgtaatgatagatattatatatatttcacatgttttaagattaacatattaacagtttgtgatattcaacaaagaatgcaataacttctgcgaaacaggtaagagaaacaaccagtcacttgatctggatattgagacgttacctgtaggatatgtattaggctgttcttgcactgctgtaaagaaatgcttgagactgggtaatttataagaaaagaggtttaattggctcacagttttgtaagtggtacaggaagcatagcggcttctgcttctggggaggcctcaggaaacttacaatcatggcagaaggcaaagagagagcagcaggtgacatggtgacagtgggaagtgacagagcgtggggtgggggtgggaggtgccccacttttaacccttttcctgtttaggaaaaaaaaagcgcagctcactgccagcgctcatttaattttacataaacatgctctttgaagctgaagcaaatgtgaccgattttcaaagtgataataaaatataaaaacagttcttggaaatatttctgaacagaactaacatcagaatcatctgaatcatcagaattgtgtattttggaaaaatcggattcatcaaatgaatcttcagccaacaactgttcgagaattatgttaacatcacatgcaggaatgctacattttctcggatttgacattttcagtgatggagaactattatattttgtaaatggaaataccactactaaaaacagaaggctataaatagaacgatatccttcgtttccaaagtcgatatgctagagtgatgtgaaaaaaataataaaagcgagatatttcatggcaaagcgatctcagggtaaacactgcacaccagtaagtattcttggggcaaatgggaaaagggttaaaatgaccagatctccagagatctcactcactatggtgaagacagcgccaagccatgagggctccgccccagtgattcaaatacctcccattacggacatgtttcaacatgagatttgggcggggacaaatatccaaactatatcaggatcccagcagactgggtgggtggaggttcagggatatctgggaaggactaagaatagctttttcttttagtagatcaggag

SEQ ID NO: 18498 - DNA, 1323 bp, Homo sapiens
accaagtcctttgcagaatttcctggtagaagtttaaatgcaatagatgcagtaaagaaaagggttggcttaagagttgacttacaaagcttggtcctaacagctttttcctttatctgtttcaagagtcatacgatatttgatctttcaaacttacgtatttcttccattatgtttagtattagtttcgttttctcaagatacatatttaacaactagcaaaatgttggaagcggtctcctctgctgtctatttagggaaaatggaactgatctttctgaaataggcatgcatgtaatgatgatgtcattaatgcttggctagctggtggacttaaacccagagggcacttctgaaaaggggcaaagtgcatctgcttctgctttgtttatagactgtcagccttggatctgtcactccctcagaagggaaggattgaggccaggcaaggtggctcacatctataatcccagaactttgggaggcgaggtgggaggatcacttgaggccaggagttcgagactaccctgggcaacacagtgagaccctgtctctactaaaaaaagagaaaacaaaattaaccgggctgggtggcacccacctgtagtcctttggaggactacttgggaggctgaggcaggaggatcacttgagcccagaagttcaacattatagtgagccactgtactccagctgggtaacagagtgagaccctgtctctgaaaaataaaaactaaaaaaaaaattaagttagaagggagggattacgaccctcatgtgtatcaagaaacaagctccatgaagccccataggatggctcagcaccagaacgaggtctgactgttaagcaaagtcaagtgcatgatggctgaacattgctgggggaagattttgcaattatgcattgtttgtgcctttagccagtaggtaaggacagtggtaccattctgacggactctcggatgcttggttttatggagggatcttaaaacagtaatcggcccatatgtgcagcaacctttgcgcctaaatagctgaggacaaagtaggttgcttacttcaagagcccttccctttctcttctttgtcaggcctgtaatgttcctcacccactgagtatttaatatctgtgttttcacatcaaagaacaagctttctgtctcccaggatagtatcttgtaaagccagcctctttattacttcaccagttttaaggctttattacttgcgacctaaagcctgctagtgaattatgcatgttagaactcacagcaccgtctctgcccactcttttgccacctttttgggggtccaaaaagtaca

SEQ ID NO: 18499 - DNA, 1039 bp, Homo sapiens
ctacactggaagtgtaatccgaggccttggaattggtcaaacaaaactcacttggcaacatttacttagagagcactctgcgagcactctgcgagcggacatgtcgatatcagctccctcctcgttcccccccccaccccccatcccatgtttatttgtaattaaagttaagatgcttgagaatggctttaccattaatctagaaacatagagttgtttcctggtgaatgatgtatgacagttttctttgtgcttcctctgaatagagagtagtttttgtggcattgttacagagaacagctttcctgtagggctcacaggctcaactgtttcaaactcctgttgttcggtaaatctgtcagaagggtctgcaagggaccgtatttatgaagagagtgtagagtggtcagtctaaaaagctccttagtgtagtactttgaattttaaattacacacataattcaaaggtaatgtaacttgccgtgtcggactttagtccattccgttaaatggagaaaaatgactgacgtgaagaatgacttattgattcttggtgggaaaatgacttctgtaatatgggaagtatggtaaaaggaatagcttaattatttagggagcacttttcaaaatgtgcttttacagcagtacaaattgtacgtatacaaatggtatgactaggttctttttttaaaaattctttcataggagaaagttatgagaaggcttatattatttcgttgctaaggcaaagtttaattttgcttaaattcctgtaagactaactaagaaaggtaggaggagtgatgagcagtttcttaaccctttaagaaatatgacttgttctaattgccttttcttatttacattatacttaggctggtgttaggatgccgtggctgccaagtttacacagtgcactttctctctctctttcttcttttggtttatgatgtttttcagtagtgtcatggaactcacttaatctgatttcatcaagtaaatatatgggaagttgagatgacatatttttatctgacat

SEQ ID NO: 18500 - DNA, 1303 bp, Homo sapiens
caattcattttttttggatggtgtttattaaagtcaagaaatcttttgcttatttgctaatgattctctcccctttctcttcttatatttttgaaggctgaattggtaaaattatctggcccaataaaaatatgtcctgggttggaaaagagcacaagtttctttttctagccctggagtgaggtggctctctggcctctgggttcgtttggtatcctggggagtcattgacacccacacactcctagtcacaagacctttccctcccatccagattgtgtttattttacggctctcgcacggagcatgcagctgtgtaaacctgagaatggtttctgcacagctttgatctttgcatggatcaacagttgcccttagtccctgaaccctgttccatggccccatatttcttggatttttccattttctagtaattatggcatcatgtagggagccttccaacagcatcccccacagctttgggtggagaatttggaaaaaatgccttaagtctgccatttgtagaaccatattaagtagtgatttccatttgatgccaaaaaaatatgccatttagtttcttcctaagaggcaatctgacaatttcgagtagactgctggagtctgacaaatttgaatgtattatggactgaataaatgtttattgaacaaatgccatttttttaactcttaaaatgttcagttcttccaccaaacatagatgacacaactgttggagacggagcaccggactgatgcagtgtagcattattttgtaatctacgaactgggagcctatggagacctatgcatggtggaatacaaaagtcatgacctgtctttatatcctagtatgggcaataaaaccctccctttaatagccttaaacatggtacaaggaaactgtgcaggagttccagggaaggtgccatttttccatatggagttgatatggtctgactgtgtgtccccacccaaatctcatcttgaattctaattgtaatccccatgtgctagggggagggacctcgtgggaggtgattgaatcatggagaccgttcccccgtgctgtgagtgagttctcatgagatctgatggttttgtgcggggcttttccccactttgctctgtacttctctgtttcttctccttcttgccaccaggtgaggaaggacatatttgcttctccttccatcatgaatgtaagttttctgaggcctctgcagccctgtagaactgtgaatcaattaaacctctttcctttataaaccacccagtcttgggtatttcttcttagcagcat

SEQ ID NO: 18501 - DNA, 1049 bp, Homo sapiens
caaaggtgaagcctgcacagtaagtaggccagtggtgggataagggatccattggcccaggaaattggagggacttggagaaggaccatctcacccgtccaaagaatggaggagtaagggaaggcttctggaaagaagttgtgttgaggctgtgtttggaaaggtgaataggagttaggccagtgaggaatggggtgaacaactgcaggaacttgagtgatactttggggtgaattctctctctctctctgtctgtctctctctgtctctgtttctgtctctctcactcacattttaggtaaagcagtgtttcttccccaggggtgattgtgtttgttacagtgtgatggagactggatactgcatctagcagatagatgctgtcaatcatcctacaatgtgcaggaccgtgcccacacaaagaatgacccgtccccaaatgtcaacagtattcaggctgagaaaccatgtactaaggcacaggacaagcatcgggttggataatggcagagaaaagtaccttacctccttccagaacctgagagtgtgtgactgtgagtgtgtgtgtgtgtgcacacacttgcgtaaagtgagaaaaatctggtgttttttcgaagtctgcctcgtttaggctctggactcctgctctctgttgactctgtccagagagtaagcgactcagcaggtgtgcctccccatgggcccccttcacggtgtcctcaccttgatttattagagcattttattcccccaacagtgtttatgacatccaaggacttggtggaaccatgaggaaatgagagtggacagtgagactactatcattcattttcactccccgtaaacatcttctgtttctgttttagaagacattgctaatcccctcatgcactggctttgcgaatttctttttcagcctgggtttgaaagcaaagtggtagtgactttttcctgatagctgctgaaaaggttccacagtatttggaccgctgcctgcttctaccctggagcacaaaagatccaggcgtagaaattggttctaacaatat

SEQ ID NO: 18502 - DNA, 1054 bp, Homo sapiens
accgtggcctttgtcattcaggtcatgctgctttcctcaaggcaaggaactgaggttttctgttggcagtgaggtggtggcttcttgtttccctggtcttagatactgctcaactcacagttgaaatgtagaagtgaaaagtcagacagcagcaggtgttgctgggaatgtggagaagttggaaccctcacacaccattggtggggatgtaaaatggtacagctaacttggaaaacagtcggcggttcctccaatagtcaagagttcccatatgacctagcaattccactcctaggtacgtatcaaagagaaatgaaaacatggaccaagacttgtacatgaatgttaatagctgcattgttcttaatagccaataggtggaaaaaaccctaatgtccatcaatggacaaatggataaatatgttgtggtaaatgcgtgtaatggaatattccattttatattcataaaaatggacaaagtcctgaggcattctataatgtgagtgaacctggtaaacatgaggctaagtgaaagaagttagttacaaaagtccacatatggtgagattccgttctgtgatatgtccagaacagagaaatttagagatagaaaatagatgagtgatgactcagggctgggggagttgggggtgggcgggataggaggggtagaggtgaaggtgatgaaaatgttttgcaattgtctgtgttggttgcacaactctaaatgtactaaaaatcattgaattatacaattttaaatgggtgaatcgtatggtatgtcaattatatctcaataaagctgttaaaaaatctgaaagtgtcaattaatctttgctcccagagaaaaccactcagggcccgagctgctcatgggcacaaaaacccattcctcagattccttggccatgctggaagcctggcttgtgtgagagcctcaagtctctgtaacagcctgggagtgttggtcccgtcacagggctgtggcagcctttaaagctagaaggcactgctcagaggaactggttcctttgaatccttttccgtcaccatg

SEQ ID NO: 18503 - DNA, 1051 bp, Homo sapiens
tggattggtttgatcaactttgttgcggtctaatttatgtaaaataaattgcatccatttaaatatacaattcaatgagttttgacagatgcacatgcccatgaaaccaacacgaaaataaaaaaaatagaacatttacatcacctcaaaaagatttcaaatgccacttctgtggtgtatgactctgagtccagacagcctcagctccaggaaaaccctggtctgttttctgtcactattgatgaatttgcattttctagaattttagataagtgaagttttctagtacttgttctgcatctggtttctttcattccacataattaccttgggatgtacccatactgctgcctgtatcagtggcttactcattgtcattggtgagtagtactccattgtgtggagaaatcacattgttttaaaaatacctaattacctgctgatagacatttgggttcttcccagtttttagctgttgtaaatggatactaatgtgaacgaagccaccgtgaatattgatgcactagtctttgtgtggacatatatctgttttatcttgggggataatactctggagtggaatgggcagggtggtccgtatagggctatgtataactttttaagaggttggcaaatacttccctaaagtggtcatcccattttacattcttgccaacagtgtttaaggatccacttcctctacatccttaataatacttgatattattggtcttctaaattttctgtttgggtacatagtggtattttgttgtatatttttttttaattgtgaaatatgtgagtatgatgagtaatgattttgaacatgaaaactatgcttattgctcatatctatgttattttattatttactttttttgagatggagtctcgctctgttgcccagtctggagagcagtggtgtgatcttggtttactgcaacctctgcctactgggttcaagcgattttcctgcctcagtctcttgagtagctggtgttacagaagcctgctaccatgcctggctaatttttgtgttgttttattttta

SEQ ID NO: 18504 - DNA, 1034 bp, Homo sapiens
ccaggtctgaaatctgctctctggagggaagtgccctgtccattatcctccatggtcccatctgaactggatctagagaagggttactctccttaggggaattagcagctgtcagcccacttcctgctggtgcatggttgaggctccgtttttttgtttttagcagttataggcttttaaggtcagattaatctttatttaatttcttaataatcttataggattcagatgtatttgtttcccattaattcatgagtagtggccacaccagtctttcctagacttgaatctcaagttgctttatttttctaatttgttatcatcatgcctctctttcagcacagtagcagctactatgaggctatttggaataatgagcttggtttgaaaagtagcatcattaatctgatatatgctactgggctgaattatttgaattcataatgggctattgtctctcaaagacttttgcaggcttattttatgctttttggactccagaatcaattgactttttcaactctgtaatgtcctaactttcatttctgcttgcacactggacaatgctttttttcaggaacacatctctttcttgtaatatctttgtaaaagcagcgtggagcagccagcacacaatgacattttagctcttccctagagcttcagactcaataggtactagatctaccttatgagttatggcagagcacaattttaccaaaagtctttcagtgtaaagacacagatccacatgggtgtctctgattgacagttggctttgtctatttggtgagtaggatatccaagctcatttcatttagtggctgtattgtcccctaggaacttattataacttaacgtttatctcatggaaggttgaagtatggggaacccaattcatatgagaaatagcccaggagttacattctcttctgctcagtgaccattagtggaaatgtaaatatctcacctcaatgcagtgtgggttaggaaatgtggctttctgtctagtcaacctctttttcctatgctgt

SEQ ID NO: 18505 - DNA, 1049 bp, Homo sapiens
accttggcgaggcctttcaccaagtccatggtaagagaacagcttctggcgccgcaaacaccttgggtcctagagaaacctgcacacttgtgtctccacctttttacctcttgcgggcatgagtctggtctcagtaataacattgtccagcccatcataaagggctcttgaacacattttcatcaactttaggttaagtctgtttgggtaaatgcgtcttggagggctgggtagaagatgtgggtttcagtatcatgttaagtatggctgaaagtccttatggaaatggtgatttttttgtttgtttggttttgttttttttggggttttttattcagaaactttgaaaatctattttgttgaatggagcacttgaaaactgctgttttgtgtcagtaggtaaacaacaaacattggtgactactgaattttcagcagatgtgattcctttgtttcacagaaaaactgtatcttttgttctaaatttttttcttctaatgggtataatcctctgttggagagtcctttgatagctaggagtgtgttttcttctttactttcccaaagacaattttggatgaatcatggtactgtggttacatttggaagtgtttacaaaggtgataagatgtttttatagtttggtgttcatttatcgaccatattaagaaccttcttctatgaaatggttttagtaggaagtattttgaatgaagaaagcgtattttccacaatatatttggtagattatttttcaaaaccaaaggacttcaaaaatgtcttcctattagtggacaccagtattccagttacccaaacttaaaatctacttgacagaaatcacccttttcccaaacacatttgccttttagcgatatcacaggccttcacagttggacctaggatattaataaaacaaagcaaaacaacaacaaaagaagaactattgcaggcctattatcctccagctgatctcacgaccttggaaactgtctgctgccttctcttacactcattcccacctgccacccttaaccttcgtatttggg

SEQ ID NO: 18506 - DNA, 1054 bp, Homo sapiens
ttagaattattatctttattttgtaattgaaaagcacagaaacctcatgcagcgtgttcaagaaaatgatataccagccttgtaaactttcacttgctaattgcagctgcatttgctttgtccaatgcacggtaatgcccctggcatccatatctagttatgcagttatgcttcctttttaaaatgtttgacagcaccttcactgaaatgaatgctgccaccaccgccaaccccaccttttttttttccacataagctttcatttctggtaaatacatccttgccagagttcccaggtccaagccggtcctttgtggaccagtatgcagatttgaagttgagcactgtcacttgcctcttaggagtgttttgtgcaaccacatatttgtgttggcagataacagtagaaagaatatcatgtgttagggtagcaagagcttagcagatgttttagggaactgcattttcaaatcattttacattaaaaaatggcttacgtttatggaacttctgcgacgatcgggttacgtttcctgtgcccgtgtaaagccagtcatcgtgctgagttttaacggatgtgcagctaccctgctaatggatgggccggcaatgctggtcctgttgcaaagttataaattataactagaaaaagcacaagatgtcattcttctaaccttcgtgaaagccaaacggggtaattctgcccttgaataacccgctgcagggtgatttatagttgtacaatttaaaacgtaatgaaggagataatagatgttgatttgttcctgaaattagtattttagaaaaatacttctccccctttccatctttaaatacctgcagctgactacactatagatactatcaagggcaaagccccctgtttgaatgtgtattggtacattggtgtatcacatacaaggcagagggtgtataaaacaggctttctgttgcgagggggaaatatggttttcaaagtggaaatttcattgtattcttcatgaatctaaacattttgagactcctgagtgaggtttgaattttctggttgcct

SEQ ID NO: 18507 - DNA, 1787 bp, Homo sapiens
agggacgtatccagcggtgtgggtatgtttggagggaatgaatgtaaggagagagaggtgaggcacaggagagacaggatgagctttagaggtagacagctctcgggtccagccctagctctctcccattctaactcttgggcaaggttcaaaacctgattaagattcatgcataaaactgagatgttagaactacctcatgggcttgtcttgagaattaaagacgttatgaacttaaggcctctacagtgtgctagatgcttaagaaatgttaactactattgttattggcttgcagtagaaattaaagattatgaatgttcagcattcagaatatactagatactcaataaccattattgctgtcattattaacattattttccccagctttactgaggtatgagtgacaaaaatttcatatatgcgcatgagtgtgtgtgtgtgtgtgtgtgtgtgtgtgtggctgggcatggtggctcttgcctataatcctaacagttgaggaggccaagctgggaggatgacttgagcctgggagttggaggctgcagtgagctatgatggtgcccctgcactccatcctgggtgacatagtgagaccctatctctaaaggaaaaaaaaaattatatgtattcgtggtgtgaaatgtgatgttttgatattcatatgcattgtgaaatgactaccacaatcaagctaattaacacatcggtcaacttacatagctatcattttttgtgtgtggcaagaacattgaaagtctagtctcagcaattttcaagtatataatacgttattattattactatcgttaactgtattcaccatgctgtacaatagatctccagaatgtattcattctgtctaactgaaacttaggatcctttgaccactatctccccatttatcaccccctcccacttccccactaccagcccctcctgggaactgccctctactctctgcttctgtgagtttgactgctttaaattccacacaaaaagtgagatcatagagtatttgtctttctgcgcctggcttattttacgataaattgattgcttctcttcccattgtttatagatacccattctcgtaatgatggcactgtgtctgtcatagaaggcctaattctccctgttaacattgaacataaaaacctcatatgggccaggcacagtggctcatacctgaaatcccagcactttgggaggctgaggcggatgaatcacctgaggttgggagttcgagaccagcctggtcaacattgcgaaattctgtctctactaaaaagatacaaaaaaattggctggctggtcatggtggctcatgcctgtaatcccagcactttgggaggccgagccgggcgaatcacgaggtcaggagattgagaccatcctagctaacatggtgaaaccctgtctctaccaaaaatacaaaaaaattagccaggcgtggtggtggggcgcggtcgtgggtgcctgtagtcccagctactcaggaggctaaggcaggagaatggcgtgaacccgggaggtggaggttgcagtgagccaagatcgcaccactgcactccagcctgcgtgacagagcgagactccatctcaaaaaaaaaaaaaaaaaaaaaaggctgtgtgtggtgactcgtgtctattgtcccagctacttgggaggctgagacatgaaaatcacatgaacctgggaggtggaggttgcagtgagctgacatcgcatcactgcactccagcctgggtgacagagtgagactgaaaaacaaaaaaac

SEQ ID NO: 18508 - DNA, 1070 bp, Homo sapiens
ttgatattataattaatattataattgttcattattaccttataaaaattacttatgatatgtttttcttactatttggtgaacatcgagtatagtaccaagtgtatacttttttttttttttttttttttttgaggtggaatctcctgtctcccaggctggaatgcagtggcattttctcggctcactgcagcctccgcctcccaagttcaagccattctccagtctcagcctcctcagtggctgggattacaggcatgtgctactacccccggcaaacttttatatttttagtagagacagagttttgccatgttcaccaggctggacatgaacttctgacctcaagggatccacctaccttggcctcccaaagtgctgggatgacaggtgtgagccactgccaattatatacttattttaggtgtattatgctgtgccctgtgcttttctttgttatactggaaggtcatgatggcaggatgtcttatttatgcttctctgtactctgtcctgtccagtgcctttcagaagtaaggtttttagaaaggtttgagttatttcctgttttctgaaccagacaggcagagtatttgatcttacaaaaatctggctcagttcaagttagctgtgtagctttggaacggaccctggacagatggattttctaaaattacagaggaaactagatctgtaactctgtacatttactcctgtgccagtaacaatggcaatattttaatactgtaataaattttttcttatgcatttgctataaattagtaaatctgtgtaaagctgcttattgcatcatcatgtagaatttctacatcctgcagaagtttaagaaaattgtcttccttttacagacaaggacactgaagtttagaagtgctaagtaaactgtcttagatcacttagctagcaagtgacagggatggaattgaatctgtatttatcagaggtgaaagtatatgtgtaattattcaactacacttaggtaaatatccgcatacatgcatgcctccccttagactccattgttccaaaaggtaatgacaacaaaaatt

SEQ ID NO: 18509 - DNA, 1025 bp, Homo sapiens
tgttttaatgaagaggctggacattaaaatcaaggggaggaataatcatgtcttctcttgaaatgggcagtgaacttcccggaaccagagtgttgccttcctttttatccttttatggctgcttctgatcattgtcatggtgattgtcaactgtcttggcgctggtgagggggctgtttagcatggaaataggattataatgacacctgaggtctttttgaagtccttgggtcggctatcttgcttctaacaaatctcagctggtctggttacagagggaactttttatcacaggtgtcctgtttcttaaagataagcagtgttattacagggtagaaattcacctatgtcaagtaggcattataccaggtaacaatctcaagactcagcagggaaggatccacttgcaagcccacgtgcttgctggtaggactcagttccttatggcccagtggattgaaggcttcctttcctgcctggtgtttggttccttgccacgtagggatctccatcatggctgctggctttatcgaagcatgtaagccaagaaggaaatagaatccattggtaaaatgaaagtcacagttctttgtaatgtaaccacggaagtgacgtcttactgcttttgccatattctttttgttagaaggaaatcactgagtctgatcgttgttaaaggggaaaggatttcacagtggtatgaatcctgagaggcaggggtgatcagggccagctaccacactctacaacttgaattttgttttagatttcagtgccttttggggaccctgctacattgtggtagatttactcacaggacttgatgatttttcttgacctgcctgaagccatagcatttattacggataagtttgtcttttcttcgttctttttctgtttgcatcctttcgtcatccttttcttccctctttctggactgagagaggcaccaaatgcacccatttaaaacatatatgcatttctgctttctgatgggaggtaagatttagtcatttaataagaaa

SEQ ID NO: 18510 - DNA, 1027 bp, Homo sapiens
ccagagtgaaaacgcgaaagaaaataaacaggcagcactgaggaattatacacttgagcttggcatttttcttaacgcagggctattttaggtgcactgcgcatgttggaggtgcccttgcaggtataggtaggcattgtccatccgtggtaaaaagcaatagaagaaattcttacccgatgcttaatgaattgccaggctggttaaaaaggataacccttgaaacctagggtgtccaactgctaatttatatagactggagatatttccatgcctcgcagcaaaatttttctttaaattcacagaagcagcagctatccagcattgtccagttgtgctgagtagctgtcattattgataaacatgtaactggtcatttgtattgttttgagtaggatatggcttatcaggatgcatagtagagaaaaatgagatgaggtaatgagatcacatacactgaagcatcttacgaatctggcacatagtaggttctcaataaatcttttttgattctgtgactgttagaatctgttggctgatactctgtcatctggctctcactctgctccataaaacttgggtaattctaatgcttacttcatcccagggctgatgtgtgttaggttagggtttatgatcaagtaaagagtttaaagaagtgttttatgagggagttttgtttgcaaatgatcacctggtaatttaagagggtgagctaaacttcctccttttctagtatggacctttggggctcaggatgaggatgttcaatttgtactgctggtggagctgcctttccattaagtgagtctttctccaagggaacagaagtcttaggttgttgatctggcggtcagaacctaggacaggcaaggcagtgggctgttgtagaggagatgaagctgatcagagcacacccacaccagtgacaaccggtcaggacctgggaagggctctgacccattcatctgagagatgtggcatgaggaacactgagacctaatgcttattgcttaatattgtggac

SEQ ID NO: 18511 - DNA, 1033 bp, Homo sapiens
tctttaccatttctgaatgtggccctgagggaggatttgtcttttgctattttctttttttaagagatggggtcttgttgtgttgcccaggccactctccaactcctaagctcaagcagtccgcctgcatcggcctcccgaagtgctgggattacaggtgtgagccaccacacccagcctgggggagggtttgttaaagaactgtctgttttatcacatgaccacaagttaaaatgttgggcaatgtccctgaatgataccttttcattagtaactcacatggacccataatctctgaatttaacatgcttttcaggaatgtgttcatattttccacctataaaacctgttttagtaatttactcccttgtaaatgttccttggtatgtaaatttagcatatttccttttaattgcccaggtaaataatacccaccatcagagggcaccagtagtgtaatcaccttattttttaaaatgtattctgtgtttcatgattttttctgaataactgatctttacagtctgaattgcattctgttgggcttgacttatttttaaattaaaagagactaacacattaaacactaagaggtcacataggatattccatttatataaaatatgcagagtaggcaaattcataaagacagaatacgcatcggtggtttctggggcggcggggagtatggaaagcctgttaatgagtacaagtttctttagttttttttggttttttgttttttttttgagacggagtcttgctctgttgcccaggctggagtgcagtggcaccatctctgctcactgcaagctccgcctcccaggttaatgccattctcctgcctcagccttcctagtagctgggactataggtgcccgccaccatgcttggctaattttttgtgtttttagtagagacggggtttcatcgtgttacccaggatggtctcgatctcctgaccttttgatcagcctgccttggcctcccaaagtgctgggattacaggcgtgagccattgcacccggctatt

SEQ ID NO: 18512 - DNA, 1411 bp, Homo sapiens
tttgcttccagccatcccatggaatgctgttcttggaagggtcatctcatggtccattgtcggccctcttagaagagatttcaggccttcccttgtagcttgatagttacagggagtgctagggtaagtggaaaaagcacatgacttggaataaagacttagtacacatcccatgtctgatttatactaactagttcatggacctagcctacgttactgcacctgtttgagcctcagttttcctgtctgcaaaggagggatgatggtacttacctcaaagaattgtagttggatcaaatgagttggagtgggatacagcaacaatctatattctgatttcagcaacactgtgcagtgtaattccatattatattacaccacatcttctgtgggtctttctttgggggaagctaacattttaaaaggtttccctttgtaacctgtaaccccctctaccccaaaagtatattcaagagcgaaacttttggtatgacgatgtcttacatcagtagttctgaatgacttgacttagctatctttcttgagtctctcaaaagacagatggatggatagattgattttgttgtaacacctgttcagttttgctggccttactcgttttcaaatactcaaatgccattgagtcagatttcagaggcaaatggtgatacctcaggtttgaagttgcaagaagtcaccacatgcttgttatggaaatcgtcagggatatttattccctctcctgagaagcataattgagcctccaaaccacccatcaagatatccacctgtaaaatatttaagaactggtactatgaagacatttcccttatgcaatttgttttccatctaagagcagaacaaggaaaatatagctgactataagttacaaaggcagactcttaagctacaaaatacatctcttcacaggagcacttggagaagggctgaaggcaaaccaaaagtgagcaacaaggagactagtgttctgaaacagagatgacaggctccgcagtgagggtgatgatggtgttacgaattacccattcagtttaaactagacattccctggaagcatgtcatggggtgtgcagaagggcttttggataaaaggggtctagttaagagatgttaaaaaaacaaacttgaaaagcatagcaggctgccaggacatgtctgagtaccgcgcagatagtggggaatagtctatggattctgcttacaccatggacaaccaggctgggccatgggttgtgttttttttcctctcattttatagaaatgttaccaggcatattttccctgtttccctaagaagagcttcctctcagtgctagccagccacagggccaagtgacacctagaggtgatcctttggttatttgctaaacagatctaagacaaaccgata

SEQ ID NO: 18513 - DNA, 1030 bp, Homo sapiens
atgtgtttgtcaggtgcataaatctgtgactgataaaaccactgctcattacttggttcttaaactctccctcaatatagctgtagggacatgcaaaacaaaggctggctcattaataggatatgtctagagttctgctttagaaatcataatgtggacatcattgatttctctgatgctggaagctgctgctgcttcttcatctttatcttctcctccctgtgtattgagagcagggacctccttgtgctgttttgggctctccttgttcacccagattggctgcatcagcaccttcttaaaatattagtgttgctgagataggagcttttggtagatggataaactgggatttgtaaatattttgcttagtttttttcccagagttttgcagaagagaataaggtgttggtttgttataaggtggtcctttataaagtttagacctattttaataaggctgacttgggttgaagataactagagccatgactttcatcttgatggacaatgagtactcactctacttttttagtttatatttttattttagttcatttcatttaagacagcgtctgttacccaggctggagtgcagtgacatgatctcggctcactgcaacctacaccttctgggttcaagtgattctgatgtctcagcctccccagtagctgggattacaggcatgtgccaccacaccggctaattttatgcatttttagtagagacgcgtttcaccatgttagccaggctggtcttgaactcctgaattcaaatgatctgcccacctcaacctcccaaaatgctgcgattacattttaaaactctaccttttaaaaattagaacctggacaaagaggtattaaagaatgtgtctcttattaatttattatggtaatgagaagagtttggatttggacctacctaggtttttctttcctccagctccgccaccccaactccttactcatgcttcctctgtaaaatgatcactccccagtttgacaggaattgcccctggaatcccat

SEQ ID NO: 18514 - DNA, 1083 bp, Homo sapiens
aagcgatgataatgacgtatttccctcccttccacaaaacagggccaggtgtaacacactaagaacaaatggcttggcagcctactctcctctctcgaagctccatgcccaccttgctgttgcaccccccaccccaaggaaagccttcccacctttggaagctgcattaattattccaggccacaagggtgccgttgagttactggttcactgcactggctggcaggaaagagttttaatgcaggctccaaaggtgcttaatttcctgtggtccttatgaatatgcatacagtatgtgctcagcaatctagcagttcaaactagacagctggttctggtggtgagggttttttaaatttattttttatttatttattttttctctcccctttccttggacaagccctttctgaataagctgaatctgtagtataatttcattaactcatttccagtatttaatttggttttgatatttccatcatggccccttttctcctttgattttgtcattctgtagaagttgataatctgtattatgatcaacaaggcatattgccatgactgtaggaatcaccaatttagatatccaggcttcctaaaatataagtaagtcagatttagcattactgttttcctgaatgtaggagtatttggaaaaggaaaaaaaaataaacatacatcttggaaagcagagaaaggtgttttgttttctttctgtttggattaacatattctccatcactgtgtaacttcatccaatacgtattgaatacctactatgtgtctggcaccacttcagacagtaaggatatggatatgaatttgtatcagtcaagccttccaggatcttattatctagagagaaagattaaaacatatgcaaataattttgatagaagcaaagacctaactcagcctgagaggaggttgggtttagagaatgctttcattgtaatgttttaaagctttttatttataactatagtttatttggactttatgatttaccaagtaactttagatgcaaatatggtagtactgtgaagattatggtttttgaatgaagtcactttgtggcat

SEQ ID NO: 18515 - DNA, 1255 bp, Homo sapiens
taagacaggtggctagcattatttgggtccagaagcttccctggaaagaaaggattcactgcaagatcgacaggcttacccagttcatttaggcgtggcttgatttatgcacacaaagctttgggaacatatcagtcacatcaagctaggtccacctgtgtgagtaactaacgtgtttatttatgattttctttaacagcacagaagagcaattgcatttggtcattctagtatcaactgagttctttataaaatatctttggggtgtttaaggagaattattctttttacaagttctgattaatgacaccgcaaaaatgaaaataatgagctaatatgtatctagtacttgctatgcacttatatgtatagaagcgtataatccacagcactccttctgaatacgttacgtaaatggaaccctcgcaacagtcttacccccattgtagagatgagaaaactgaggcatacagaagagatggaactaggccaagagcatagaggtggaattgttgtgtgagcctgtagagtccgtgttcttacccactgcatgatgtctgatcatcgtcaattttctttccatttggatagatgaatggtaatacttccctactaggtagagcaatgattccagaagtttataataattggaaagtgtattagtcgattctcacactgctataaagacattcctgagactgggaaatttataaagaagggaggtttagttggctcgtggttctgcagactgtataggcttctgcctctcgggaggcctcaggaaacttacagttatggcagaaggtgaaggggaagcaggtaatgtcttcacatggctggcagtggaggaagagagaaagtagggaggtgctagatgcttttaaacaaacagatctcaggagaactctttcacaagacagcactagggggatggtgattagaaagcacctcatgatcccgtctagttcctgcagagaacagattagccccctatgcagcacacacctttgtgaggtcccttctccaacacagggattacaattcaacctgagacgtgggtggggacacagagccaaaccacactggaaggtaaaaaagttggcaaccagaggcttagaggaggttcaaatctcaaagtgatgtctttccttttgcattttggatggtttaataaataagattgatacaaacacaagcattaagcaaacaaaaggaaataaaaacggcaacaaataaaacttctgtgctttttgaa

SEQ ID NO: 18516 - DNA, 1870 bp, Homo sapiens
ttacagctctggcatttctgggtaacactttagaatacttccactccggttggtccataaaaagctgcctgtgtttttatgttttgaaaatacacgcagagagacccactgcatgtcctattaggcatcttatccttgagtaagcaggcatgcaacatcagtgtcacacacatatcacccccatactcgacattctttgagaaatgccttggtcccgtctccagccagatcagcattgcacctcttggcatgcgttcttacctgttgaggatttgcttgaattataatatggtagaggaggaaacacagtcttactgtgccgtgtgctgagcgcagagccattctcagcatcctgccttgattaataaggcgtgaaagatcctccgaattcgcacctgttcagacaagcttgtccaacccatggcccccgggtcgcatgtggcccaggacagctttgaatgtggccccatacgtatttgtaaactttcttagaacatcaggatttttatgcacggaccttttatgcatggactgtggtgttttttgatttttggttgcgtgcgtgtgtgtgtgtgtgtgtgtgtgtgtgtgtgacggagtcttgctctgtcactcaggctggagtgtagtggcatgatcttagctcactgcatcctctgcctcccaggttcaagcaattctccgtgtctcaatctccctagtagttgagattacaggtgcccaccaccaagctttgctaatttttgtatttttttagtagagacagggtttcgccatgttggccgggctggtcttgaactcctgatctcaggtgatcctcctgcctcagccacccaaagtgctgggattataggcgtgagccactgcgcccggccttttttttttttttttttttttttttttttaacgctcatcagctattgttagtgttagtgtagtttatgcgtggccgaagacaattcttcctccactgtggcccagggaagctaaaagattggacacctgtaaacaaaaacaacacagccatctagctgcaagacgtagctaattgctctgcagaacagggttggccagcctggccttgatgtcggagtgttctctagacctcacacccagtccctattcttaggttttatttctcaaaccaggttttgcctgagaaattacagcaaatgattcagagcacaatgatgttgctcatttttgataagtagttgaaagctgatggtgccctccatttcaaagcaacagaagaaacgctggtggtcatggagaaagagttgggaagcagagcgtgaatgccgggatctgcagatctgagcactatgcctgcagccgatgtctctccacagggctgatctggtggctggggtgcccctggtcagaaggggtgattactgtttcctctctctccttggtctctgtcaaacctaccaactcttttcaggaatgcagatatttaattatcttctgctgttacatctgcatcatgtattggctggctgttcaaaagtatcctctctaggcaaataacgagatttcgccagcaggatctcccgttaaaggcgtgcatgtgtggctttgtagacacgtatgtgtgtgtgcgtgcacacctgcctgcccttgcacagtgggcactgtttccagtgtgcagtgaggccctcccttcgtgtagaacaggacaggacaatgacaaagttattcaattaataattgaagcttgccgggcatggtggttcacgcctgtaatcccagccctttgggaggccaaggcaggcagatcacctgaggtcagaaattcaagaccagcctggccaacatggcaaaaccctgtctctactaaaaaatacaaaagttagccgagcgtgat

SEQ ID NO: 18517 - DNA, 1349 bp, Homo sapiens
gcgagccatgattgtgccactgctctctggcctgggcaacaaagagagatcctgtctccaagtctgtctgtctgtctgtctgtctgtctgtctgtctctctcggaaatattccttcagtgtattagtaaagaagttacttaggagtcacttatgcccttgaagagtgagtgatgtatcaaaatatgtctgtctttattgtttcactttcatccttctttttttggagatggagtcttgctctgttgaccatgctagaggtggcgcgatctccactcaccgcaagctccgcctcctgagttcaactgattctcctgcctccgcttcccaagtacctgggattatagacacccaccaccatgcacagctaatttttgtatttttagtagagatggagtttcacccttttgattggttggccagtatggtctcaaactcctgacctcaagtgatccacctgcctcacctcccaaagtgctgggattacagtcgtgagccaccgtgccggccactttcatctttctgattaactgaaaagtatcaagcaatacttacatgtaactgcactttctcatcaactgcaaccataatttagctatggatacaagagttgggcacaaatccatgaaagcattgagtgagaatcaattggctctgtgggatttacaataaagaatgttgtttatttttatttgtaaattgtgtgctacagatccttcgtatcagtaaaatgtatgataaacatatgtgtgtatattcacacacaccctttcattttggcaggagtgtttgttaaacatttaccacagcagtggattcacttccatcagctgctaactttcaaggatgtttgaggatgcatgacctgtgcaatgcacctgcttcggtgcctggcacagagtcgcaaagccacaaagatggtgcttgttggttgtatgtgttgtttccatctgatatcaccattgaggggagcaagatgacatgtgcctaccccacgtgtccagcagcaaagccacctggcatagtgggctgctcagcgtgcctggttcatactgcgtgtttatagtcccagggtgttttcagagagcaaaagtcctttatgattagcaaattgcaggtcctcccctttctgatatttacagcccttgcaaccgcctgtacaaaaatcgggaaaaggcagaagacggctgtcattaatgtaaaagcagctggttacctccccctccccagcgcacacatcacctcctagtacaattagtcaccatgtcttttcccttccgtcaagccttttagcggagttcacagggatgccttcggtccagacactatgaccgttgacgaaggatttgaa

SEQ ID NO: 18518 - DNA, 2085 bp, Homo sapiens
gtcccccttttctcttctctccccttccctgctccctctctttaaggttttctcacagattaagagagtagcatgtgctcatcccaattattgaaaccgtgcaaatgaatagcaagaaaaatagttcttggcgtgcccctttctttccgcagtgcccaggccagaagtacctgctgcccaagaccacagctgacagcgccccgggagtccttcacactcttctctgagctcttccatccttaaacagacatctatgccaaatgcagggagggtttgctgttggcttttacaagaacactgtcctgttatgcctgctgctctttgcttggttttccctggacggtcacaaacatacctccaggtcaacagttaaagagagaacccacttcttctaatagttgtgtaatattccatactacagatattctgttatttatggtagctagatttctattcatttttaattcccatgctcagagctttccagacatttggaaacattttagaaaattgacatcatctcttcaaatatctgaactcagatttcctctgtgatgttggaatctttaaaatatcatgcatacttggcctgtttctacaattttgttccccagccatcgttctccattttgcacgtgtattgtctcctcctattcctctgtacccttcacacgtgcctgcagggtatatacttttgcacaggcaaaagtccagctgaaatgatccttacttagcataatttaaacgcgagggtttcctaatgctccttccatttaaataattcaaaaatccgtggcaaggtacctgaaaactactaagagaagagaggtgttaatggacacatcattgaggctgaagccaaactgtgtgattctgtctgcagttgagaactgtaagaaaaagatcaagattaacattattattattggtgttacctcatgtctgtacctttttggagacttgggtctgtttcccgagaaatcatttttcctcctccttgaaaatagtgaatttcaagtggttttaattttaactgcattatttgtttgctttatatagtttttaaagttttatgaaaaagtcttccatgtgttttttatttatgaaatcggggcagccatccttcaaatatgaagcaggtatctgagaatactaaaatcttacagtgcattttataggagtgtgaatgatttttctgcaattgacatatcaaggagcttatcatctattattaagttaccttttcctgaaacaaaatatttgtcagatgtaacttggtacccaaatgccttttcttgctaaactaggaactgtcacacacacccacccacccacccctttattcttggttctctcctatattttgacatttgaagcatccacagaaaagtaatagaatgagcaattgaaaatcaccagaactgaaattatttccagctatgtttaaatatgaatgtcttgttcgacgcttcgcatatgtatttatggctgtgtgatatcattatggcatcctaatgaatgtctactgaattatgtgggattcaacaggggatacaaatggatttgaattctgtaactgtcatattgtggtccggagagggtggaaactgaagtatccctctgcgtcgccacatctgtcaaaagtcctcagcgctccccgcaatccatgtctggtggaagcgcgaggtggtgaggatggaaagggcatgcgttgacttcatgttgggacgggtcttaaactaaacacatgtcacgttatggagctgtttaccttggctttgaggtttatttccttctggattaagagtgatgtcgttttatataacaagaagtgaaaaaaaaaaagaatgatgttacacaacctattttttttttttttttttttttttactctgaatgtgtaactttaaatgaagaaccaggacacctcatcctttagtcttttctttactagtgagtggcagatatgtgtggaccacagagatggactgaaaagagaagtaacagtccttggtttgtattccagcccccaccttcctatgtctttgagcttggtaattagatgcttggagcttcagtttcccc

SEQ ID NO: 18519 - DNA, 1107 bp, Homo sapiens
attttagccttagcaacatgtatttactgggcatctagatttcatttatttaagaactttttattgaatgccgattgttcagcagccaccatgcaaggtcctggggaaccagtgggcagccacacagagaaggtcccaatggcaccagaacaaggccagcttcctaggaggtgtctggcttcaagacagggatttcctttagctgggtggtagagaaatggattgcctgtgatttcactgtgcataaaatgacctttcagcccttaacctgcgacatccacatgtgttctttggtactcacgggtgttatggttcatagctgtggtcttctgaagtataggaaaaggcagcttacagaaaaaaacttgcttgtttactgtcttctgagctgatttctcacctactggcaagtggataggtctagtttttgtttagctgtttttctaatttaatcttatacatgagacagctatagatggatgtatagtctttgaagtggggccagttggctccgtctattagctgtgtggcttttgtgcaggtgacttgtggcccccggcctcagggatctcatctctaaaacgaggctcttgatgttacctgccttacccagctgtgaagattaaaagggttttgtgtgttaaaggacttgcggagtgcctagaacccaatgagggccacagagcttgctccgattgctttcctgaaggcagtaagcatgttgctctggtaatagtcatcttcacggccatcattttgatcacattttggcttagtttcttcctctaccctcttcccacgtcagacctttccatggaaggtaaaacatgttaacagtctaatgtgtttccttctaatttttttcttcatttatattatacatctatgaaatatatatatatatattacatatggatatatagacatacacagatgcatatttagggtgtgctatggttagaaagtttgcatccccccaaaattcacaggttaaaatcctaatcctcaaggtcgtgacggtactacaaagcaggacctttaggacatgataaggtcctgggggcggagggtactaatccccatgaatgggtttagtgcctttataaa

SEQ ID NO: 18520 - DNA, 1033 bp, Homo sapiens
accctgtggtcttgccagcccaggacgtgtcaagactgcagcctttgctgacctgtgaccatctccaagtccatgcccaggcccctactaggagttgagggcaacaggggcagtgggtctctcctgcttaggaaatttgggttgagggtggcagtgatcttgaggggggtctgggagggaggagccagcctggcctggtctggcctggcccagtgtgccagcgagggcaggtgcaatggctcacgcctataatcccagcactttgggaggccgaggcaggtggatcacctgaggtcaggagttcaagaccagcctgaccaacatggtgaaaccccatctctactaacaatacaaaattagctgggtgtggtgatgcacacctgtaatccctgctacacaggaagctgaggcaggagaatcgcttgaacccaggaggtgaggttgtggtgagccgagatcatgccattgcactccagcctgggcaaaaagagcggggtaaaaaaacaacaaaaaaatgatgtaggaatgaacagatgaacaaccccacacaacctaaggacgactttgaatcaattcttctaagctggtagcagaagccacctttccatttgacttgtatctcgctctttttttctttcttttttttttttttggagacagagtctcactctgttgcctagactagagtgcagtggtatgatctcagctcactgccacctctgcctcctgtaatcaagagattttcctgccttgggcccctgagtagctgggactataggcatccaccatcacacctggctaatttttgtattttttgtagaggtggagtttcgccatgttggccaggctggtcttgaattcctgacttcaagtgatgagactgcctcagccagccaaagtgctgggattacaggcatgagccatcgcgcccagccagacttgtatctcttaatgagtttaactacatttaaccatgtatgtgtcagtcctactatgcaccttacagctcactaaccctgtttaataatgtatg

SEQ ID NO: 18521 - DNA, 1087 bp, Homo sapiens
caggaagtggagtgcggatgctggaactagctggctgctttggtgccagtagaggtgaactgcactcacttgaaccccctgcactccaccccttctgggaggaagcatgcaggtgagcaggtgcaggagccagggtaaatgcttttgggcactggcaggaatgaactctgtactggccctgggatagcatctggcaggggatgcccgtgacccctgaaaccctaaaaggagtgttacagtcagtgctcttttagttttgccatccacggacggcttaagtgttaacagttcagtggagggtcagcgtgacagccttttgcacccacatctgggttcttgtccagtgtccaggaggaacgaggtctcatgagcaaattttaaggatggcagatgtgggggattttattgctgatgaaagtggctttcactgggaagataagctaaaaagaagacaaagcaggaaggtaattttcccctggagctatgccatcaagctgttcttctgaagtccagccgcttctctccaactgtggtctctaatttccagctgcttctcctcttttcttcaatgtgccagcggagcctggggtttttatgggtacaggattgggggcaggccgggccatgggtggttgtggaaaaggcaatatttgagtggaaaaacagggatatatgttctcactttgggccacagttccaggcttgaggatggggccctcaccacggacctgccctcttctgcccagaatttccctgcctcctgtccctatcattgatacctgcaattctttgtacatatgaaatttaatatggtgagattggcatctagctgctgctagagatagtgctcataataatttttaacattgattgagtgtggataataatccaggagctgtgctaaacgttttacaacacattatctcacttaatttcacaactccataaagtagttttcacttagttgagggatgaaaaaagttaggctctgagaattgatattactctgcaaatatggaattggaatttcaaagcaatctatggtctttatcacttctccattaactgtccttgttttattaatgct

SEQ ID NO: 18522 - DNA, 1053 bp, Homo sapiens
tttttccttaggatgagaaagaaggcagtggagcccttttccttaggttagaatggttctgttggttgaattgtgcaccctgtttggttgaaacaattggacagtaaggatgtgactattattgttgctctctaatactttattatgtcataccaaaaattatcttttgtattttgctaccagttcttttagtttctcttacatgtatgaagttggatagttagaatgagatgaaaataaatgggctgggcgtggtggctcatgactgtaatcccagcactttgggagtctgaggcaggtgaatcacttgaggtcaggagttcgagactagcctggccaacatggtgaaaccctgtctctactaaaaatacaaaaatttttttgtattttgggattcggtttaggtgatgtgtgtctgtaatcccagctacttgggaggctgagacaggagaatcacttgaactccagaggcagaggttgtagtgagccaaacttgcacaactgaactccagcctgggcgacagaggaagactctgtctcaaaataaacaaacaaataaataaataaaaattgtttaaacctgccaactacaataactttttcagtctctttctccctttcccaccttcccaaaagggtgggaaatttttaaagtaaagtaataaacaaataagttttgggttgggcgggagattagttagagacaggatctgtaggtcagaagtggtatttgggggagtagggagttttttttttttttctttttcccttatgcatttgggagtggaagagctgtcagattctgaatttagttagatttataatgctagagacattcagcagtctgcctttccctttctgttataaaatcatgtttttattgaattacattttaatattggtatcactttaaaatgaaaatgagtacttgcaaaatgtatttttgaaggagttgggtggtggtggggggatgccattttggcaacagatgacttcggttcaagtcctctctctgtctcttacttgctttgtggctttagaccagccacccac

SEQ ID NO: 18523 - DNA, 1685 bp, Homo sapiens
cttttccctgcattgagatagcattgcatggagatccttgtactcttcgaacagaggctgcagatggacacaggatctgctcagggagataagatcacctgctaattctgctttctccatcagagtctgaatgatcagtgatggggaccagagctaggttaggtctctggaaacgccctctgtctgagtccgggagatggatgatatgggtaatgacttgctgctttatcttctctccatctccttacagcagctccaactactgacttttattgtgtggcagctaattgtaggattctatttctgtaaagagaaggcaagagaggaatgcagtgtccaccatccctgcagccctttggcgccttccccctcccattaccttgaagtagagggaaaggggacgacagaagaacccttagaagtaagactttttctgtctctgatgccacggacctttgaaatatttttttgaaaagaaggcctcccttggctgataccttctgactgttagtgaataaaggaagtttaaacaatctcttccctgtaatcattaatctcgtcttctttgttacaatgtatgttgtggtctttgttacaatgtatgttcacgaattcctagaacactgttcccgttggccatgggatcaggggaagagagaaggaagagagaaccagacacaagttggagggaatccatctccagtgctgctcagaggtatgacctagagcaaggggtttaggctttcttggactcattttcctcggtggtgaagtggggataatttattgacagtggaccgtgaggttctgcgcacaaaattcgttgcatagcacctgatacacacaaagctttcaggcaaggttagtttcgggtatttccagccttagtcttggctgtgggagccataatggagttgttcagaagtttacagctagtgtttataaattgcttgccatggggccttgtatacagtaagcattcattaagtgttccctcctattatatccttaggtttaagatacaggcaccacaacataaaccacccccagagtacacatgcatgggtgtaatttggtgccattctcctcccttttgcccccaccaaaatgaagtttttagtgtaaatgtcatgtagattttaaccaaaggttgattggagggtctgagtttctcagctaaatgaaggcatgaggactgtatccctcctgaagggtgtgatcagttccatgagaaagaagctgcgagctgtggggcatccaagataatgtaatctgccccggggtcctgtgagggactggccgacaaggcaggctgaatgcagccttgcccactgagctgggttctctctgctttaggtcctctctggaggtgaagagggaagtccgctgattgtttttctcttggtgcaacttcgcaccacccttacatatcccagtgtatatggtagccaaggacagtactgtttgagcctcccccattaagtgtcaacattgaatcaatgcaatcccatgcaaagaaagctgagcatgggattgtgccggtttagccagctaaagtgtggtctctgatgctgatcatgactatgaaaagggaaaatggaggagaatgatgacgaaggaggaggaggaggaaaaggtgacttgcctctagctgatgtggattatttctcttttttaatttccat

SEQ ID NO: 18524 - DNA, 1031 bp, Homo sapiens
agtttatcattatatgcctccaaagactttgtgtttcctatgtttgacatcgagatagaatttttcataaccctttactagtaataaatttgattgttaagggaccaggttaatcttatttctaataccagcatctgattttaaaaccctgatttaggagcattttctttctgctaccttcctaaaacgcatgggtggaaatgtataaaatatgtcacctgatattggaggattgtttatttctgttcatttggtcctgaatagtacctatgagatgcatttgaaaacttaccttgtttatatgtttcttctgttgcaatttcttccattacctggaatagctgctttggacggcaaaccaagcaatgccctttcacagctgtgggatgaatggggaaagaagtcttggtaaggaagcaattcagagaacatggaagcatctcatggcagcagtcacaattttgtgttgcgtaatatttcaggaacttgcaaccctgataacttgtgcctgcctgtctgtaggcctttaatgatgttttattgaattttggttttcccctagactttgcagtgcatgacacatagtaattgctcaataaatatgtgttcaactgaactatggtggttaggttagtaattagatgcacagacaaaatcacaggaatctgcgtgagccttgtcctactggtaaaggagtcttgtgaggattaattgaaataactcgcaaaaatatccagctctctgtttccctgctaggggctcttgtcataggagccattgttgtagccttagaaaacatacagcattattttagggggagaggttagagtagaattttaaagagtgcatttctcttccagtaagcaattctgcatcgataaaaagtggagaaagaataagtgaaaaaatatttagttaattcttgttgacagaagtaggacttcaggtccacatatatttcattgtagagtgcacacatgcatttttaagaatttcccgattctcttccacgtgtggacagattggcacat

SEQ ID NO: 18525 - DNA, 1049 bp, Homo sapiens
tgaaaattcccatcccacccccgcaacaatgaagggaaatgcctaggttgaaaacacgcaatacacattcaataaatgttcatggttgaatgaagttacctggtagggatttaatctttatttcaaaaagagtggctgtgaatctttaaaaatttctttggttctttaacattctcttcttcactaaacccaaattaataattccttactattgtcattaaaagttctcactggatcattccatttatactcagagtaacaaagcaaacccaattatttgagagacactgaaatgaattttgagtctagaacagcatctgcaaactttgcaaaggttcacatgataaatattttctgctttgtggcctacaaggtacctatcacaactactaagctatcatgcattagtgaaagcacatagataatctataagccaatgggcatggttgtgtgacaataaaactttatttagaaaaacaggtggtagactggatttagcttgtgggttgtagtttgctggcctctggtcaagagcacttgtttgtctgggagacataatttcaaaaatcattttcttttttgattttcatggttttagaacatgatattttctactatggatgaatgctcctcttttgaattttcatttttgtctgacataactcaaagtgcttgctttgggagttcttgttaaccctgacaattcttgtcaaatatcttactcctgggctgtgctggggatggcagcagagtggggtggttggatgggaaggcgggaaagagctagcttggagatgatacgcttttccatccttgaataacttgggaaaaagtcaggagtgtggaatgaagaattggaatataaaggctgagggcggacctaattttttttttaaggattaagaaaaaaggagtaagagagatggtatgacttatcacttggctggggactcagcattaattgataaatccactgtaaggaatgcatgacactgtcttttgaagaaagacattgcatgttaggattctgagtaacagtcaatatattc

SEQ ID NO: 18526 - DNA, 1413 bp, Homo sapiens
ctgtaatcccagctacttgggaggctgaggcaggagaatcccttgaacctgggaggtggaggttgcagtgagctgagatcacgccattatactccagtctaggcaacaagagtgaaactctgtctcaaaaaaattaatgataataatgttacaataataataatgttagtgatacatatcattttgaaaccagttcttaagcaattaaaaaaaagcagctatggtgattgagtttttgtgttatgaattttatactctgaaggcatggtcattgtgaatgccaaagaaatgaacaggagaaaattttatttgaaagctgggattgttgcatgctgcagaatttttttttcttttgctattgctgtgtaacaaatgaccacacacttagcagttcacattcacatcttgtttattaactacaattctctagatcagaagcctagacacaatgtgactggcttctctgctcagggtctcttggggacaaaataaaggtgtccgctggaggaacatcctttcctgcatgctctgtggaagaatccactgccaagctcattcaggatgctggcaggattcagatccttgaagttgtaagactagggcccctgtttcctactgacttctgctggtggctgccctcagctcccagaggcaacccacattccttgacttttggccccctgcatctcaaagccagcaacagaaactctcttgtgcatggagtcccctcctgctttgaatctctctgactttccttgactttgatgtctaggtctggatttcaagggctcagaaactctctcatgcatgtagttccctcctgctttgaatctctctgactttccttgattttgatgtctaggtctggatttcaagggctcacgtgatgaggatagtttctttatcttaagggcaactgatgtggagtcttaattaacactggcaaaatcccttcatgacagtacctagagtatgaattgactcagtaactggaagaatgcatgcgtacaccatggaccgggaatccgggaggccaatttagaattttatgtatcaaagccccatttttttttgaataacagaaaaaaaaaagagacctgatatttggagagactttttcaaaagcagaaagtttaatataaaagaaagggggtaattgaagaagatataaactgcaaagaaaggatgttaggtagagcgccttatagggaatcagaggttttattacaggcagacacggcttcacctgtgagccgagcaagtgattttgcctgcagagaagaacgcagggttccttctatggctcaggatcttcagttaccagcagtggaagtgaattgaaaatagttggtctcttgagtgacctgatgcaactcattatcttctctgtgccttaacgtctctatctaattt

SEQ ID NO: 18527 - DNA, 1034 bp, Homo sapiens
catgaacatttcatccagggttatatgctacagggatattcaagaaattgaagatccttgaaaatctagtctccctcacaaggatcaggtggcaggatctaatgggaggggtagagagtgagtgttaacacacagagaacccaggagacctttctcagaggtctcatatcaagaaaagatcatttctcctaagcaatcaatttctttttaaatctgaacctcatatctgagaatattcccttcttttatctggccactcgggagctcaaaaataaatttctggcacccttcttcctggctccagtaaagtcatacaaccatatggtacctctctggcaactaatttcacctatttccttatttgtttaaaaattttaacttaaattttttcccctcaagatctatttacggatcatcagttttattttttcttttctttcctctttttcttttgctcccttttctccccactcttgactcttctctagtttttatatgcagtttgtatttatccatgccatctgaaatcctccttcctttttaacaagacaagtagaaaacgaaaacaacatcaaaggatacactacacaattgttggagccctaggaaccgagagaagagtacaagcaggttcttgaactgttctctccccagcaactataactggaaggaacctcagtttgtccattcattcattcatcagagcagcatagcagagtagaaggaactctgactttggcattggtgcctctaagtttgaagtctaactccatcactgtgtttctttcctcttgctgatagctgatttgttataaacaaattaccaaaaacgtactggctttaaacaacacatgcttatcatgttgcagttctggggagtcacaagttcaaaatcagtctcacctggtcaagatgtcagtagggcttgttccttctggaggctctaggggagaatctgtttccttgcgtttttcatcttctagaggcctcctgcattccttggctcttggccccttcctctggcttcaaaccag

SEQ ID NO: 18528 - DNA, 1032 bp, Homo sapiens
tgtgtgtcctctcatggcagagagaggaaggggtctggaacctttctcttataaggatactaatcccatcgtaccccgtcccccatgatctcatttgaaattagtcacctcccaaagccccacctccaagtactgtcacactggggcatagggcttcagcatatgaatttgggggagctggggagaggaacacatacatttagtccataacaactatctcacttacctctctactaagtgattcagaaaatagcaagtatagtagtgggagaacatggtatcagaaccaggagagggtcctctggctttctgagttctgccaaaaaccaagttttgctgccttgggcctgtggcttctcctccctgattgtcgctggccttgctgtaaattgtgaggcatccatgtgaggcacaggatggttccaaggaccaactgaggctgtctgtgctgaggctgggagggtgtaagtgctcagaggcagccggaagctgtggtttttacctcccaagactgtgcagagcttccttcttctgtagggagaagtctctcaggacagggctcacaacagtgcagtcaggagattggaaattttagtgacaccaaagtgggctttacttcctcctcctagaattcctgccagaaaggtggagatgtgcaataaactgagcaccgatagagtaccaagaacatgctttttgcacattgtttgattcatcaatcagagtggggcatggctgtcatcagttcagagttgaaagaattgaagatcaaaggggtcacgtctctgtgaatagtattagtaatagcagcagtatcgatagcaatcatagtaattaaaatggaagcaaccaccagtgtaatcatagcagaaactcacatgtgtgtgctttctatgtgccaggcatgaggctgaagtcatacattcattatttgttaatcccaccctaagtgataggtgtattcatcattctcagtatcagaagaagaaactgaggttcagaatgacccagtaaagatcacaagcccaaccc

SEQ ID NO: 18529 - DNA, 1043 bp, Homo sapiens
aaaccgtttcttaaaattacaggatacctagggacctgttggggtgggagggaagaaccctatgggcagaaatgtgactttctgtagcaaagatgtactgtttcccactgagaagaatcaaaaatagaaaagtgcttccttgtctctctatattgttattaaaacaagtagatgcattttcattgaatcaaggcagttttcctttataaaatgtcctatttcatatcactgttcaaacttgacatccacatttgagttggtttaaaatatcactgttttgttgacattcacctgtattatacatttcagttggtcaagtcatttaatttatcataaaccatttaaggagcagttggagaaaagggggaaaaagttaaatgttaatgattcttttcgtaactgcaattttatcggctcctttttgtacatatatgattatgaagcaatttgcatgaaatttacaccttttcaaattttgaaaattgccttgttgaaaaagaatcgctgtacttctcaatactacactgattaatcacagttatagagtagacataacatttttattaaactctcagtgagcaggaaaattagcacttcctgcaataacgatactaatttcattagtgaacgttttcatttataaagtgcttcttccttatcttgaaccttttatcctcttcttattgaccaaagagagggcatatctttgggagctgctaataaaccatattcgtaatatgatgtgacctcatcgacaggctgctgcttctagctcatcatcttccttgatcataaatacccatcggtacctcttgtcacatggtgctcttagagcttcctctttgaatttcacatgtgataagagatggtttccatcctgaagagcttgcagtgggatggttatcggaaagattaaaactctaaaactaacaggtggatataaatataaagaaaatacagtattttgttgatttatgttcatataacttctttattggtaaaagggagacaggtgagaatacaggaaatccttgtggccttgt

SEQ ID NO: 18530 - DNA, 1049 bp, Homo sapiens
agccaggcatggtggcggggtgcctgtagtcccagctgctcaggaggctgaggcaggagaatggcgtgaacccaggaggcagagcttgcagtgagccgagatcgtgccactgcactccagcctgggcaacacagcgtgactccatctcaaaacaaacaaacaaaacaaaacaaaaaaggtttaagaaatgttctagtaccttgaaaccaaaataggtatcagatacttggctgttttgttttttcttcttagccattttgacctgtgagattttatgtgatgaaaacataagaatgtggtattacaccctgtgatttgaattttccatactccattccattctatatgtcagatgcatcttcctaaaacacacctttgtcacatcactcctctgctcaaaaacattcagtggctccctgggccctctgggactaagtttataatgctcagcttgtcattcctttgcccagtgtactctctgtctcactaatttgttcattattttaatgcattttcttgaatacacttctgtagacagccataagatgggtagcaggaatgctgcactgaaccataatccaaagctttcatcaggttcacttgcttcctgtccttgccacaccatctgctcattctcgatctccacttgaacacacttcacattctccacttgtgtatcattcactattcttgctacataaattaacacaaattttgcagcttaaaacagcacacatttattatttcatggtttctgtggatcaggaatctgagtatcagacttagctgggtcctctgcctagggtttcacaaagttgcaatcatatattggccagggtgtgttctaatttggtagcttgactggggaagaattggcttcccaaatcacccagattactagcagactttatttccttgtagctttttgactcggcctggcttcttgctgactgttggctgttggctggaggtacccctcagctcctagaggcatcaacagttcctgaatatctgggcttttcccacaaagcagcttccttcatcaagcc

SEQ ID NO: 18531 - DNA, 1078 bp, Homo sapiens
gatcttgtgacttcagctttgttttggactggggcattggatctcccacatgccctctcttaagtcgtgcatttgacgcatatttaataagcacctactgtgtgccattagagaccatgatacagttttgaaagcctagcctgaataatggatgacaccctcctaaagccacgatttggtcttgattatttttagcactatgaagaaaaatttcattaaatcacaactctatttacttttaacccaacatggtgaagttatcaacatataatgcctgtctatactttcagatggaaaatgcctagataaatactgcatgggacatttttaaacatgtaaaaaaatcaattttcgtaaggttacatctttttacctctttatataaaacatgctatattaaaagagagattaaattttaccctgtggagtaaaatgcaaacacaaaattatttttttcatttttcagagcatgtactggattatcatttatttatgaggctttttttaatctagaatatatggaaatcttttcttgaagcacaatataatattgaattgggaatgttgtctgacagtttccctcttaccgttgcatagaatgactctcctgtatgaatttttaaaagaaacttcaatatgctatgcatttgaaagggaagaagtaatcaccataatcttgaggtatcttttaaataggcttccttccagttcttctatgtttcaccaacttttctacaacaaataatgcatctgtgatttttcagaactcacaaaatgtccagctttctttcttttattcaaaatttatacttcataattgaagttcacctcccaaaagacatagcttggtttagcatagagctatgatgtgttttctctttgttccttttgcacactttccttgtctggaggcgttgggcttggatccttcattcttcatgaggctgatgtttttccatttcggtttccttaagtggtgaagctgcacaaccatgaaagcagtgaccacataaaaatgctgctttgaggcctggtacctcatgcctataatcctagcacattggatggcccaggcagg

SEQ ID NO: 18532 - DNA, 1318 bp, Homo sapiens
tggcagatgcccagaggcatttataagcagtcccatcacgaacaaattgccaaatgcaaggcctgaacaaaagacacagaaaggatttctttatcgtaagcacacttctctacattacctttacaatccaacaactctggtattagtaaattatagaaacaacttttgtaacactatcttgtttgcagagtatatgaaaaatttgaagttaaaattcagctccacgaatactgcagtggtgagaaaatggcgacaaagattagtcttctgtgagaagtctgctaattattcttcatttaataatgccatgtatgatggccttcattagaatgaattcttctcaacacctatgcctctttcacctcagacatgccttctaattttctttggtagtgtctgcccacccaggtggtaatttctggtcataagtctaatttagtagccagctaaaggatatctgtgaacccttcgcaaagagtaatctattgaaaaggaacaacaaaaaagtatatctgtgaacttattaaatgactttaatcatatgaaaatcagccatcagccttattagagtggttgattttttttttaatctaagagctttcttggttattttctgttcttaatcattgttgtatatccttaatgcgcaggacatgacaccgtataacaagtgttttaaaaatatttacaattctgatcttataaaggaaaaagttacatatggtcctttgaactaattgctaaaatgacactacattaattagataattaagggtcttgagcatgtggctattgtattcattgggctggaagccaaccttttctatagctgagaaaatgggttagcataattcaaaattcaattgctgtaccctttttcatatgaatagataatacagaatgagccttaaatctgggttggaaaaactaacaggaactggttttattttaattgagttttaaagcacttctaggccatctcattgtctttatagtttaaccctttgaagttgtgactgccaacgtgctagtcttgtcgtcttacacgttaatggtaatgatctttttagatttattgtgaacctctaggaatgttttttttaaccagtaaatgcactgaaacatggaatcaaagtctctttcccgtgggccccttttcattgggaataaatgctacccatagattgaagtagtttataccagtacattttttaggtgccttaacttaccaaggttatttgtcaggaaaattatctcttgtaacaccaggttccctacctttagatgacaggacttaatacaaaagttttccccatac

SEQ ID NO: 18533 - DNA, 1074 bp, Homo sapiens
aagaaacttgctcaatgtaaccaagtcacaattttaatattaaaaataatgagcatttattaagtgcctgttgaatgtgtaggattttgctaaatctttcacataatctcatttcatctttatcatagcccttatggtgaaaatgccattattctttgacatagaggaattttgattcaggaaggttaagtaatgtgcccagtatcatctatgtataattgatgggtctataatttcagactcaggtttgtttaagtccaaaaatcatgccattatgactgtgtaccatgttgcatgccttcatatccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcaccctgttgcccaggctggagtgcagtggcgtgatcacagcccactgtagccttgacctcccaggctcaacctatcctcttacctcagcctcttgagtggctggaaccacaagcagatgccaccatgcctggctaactttttttttttttttttttttttgtagaaacagagtctctctatgttgcccaggcttgtcttgtactgggctcaagcaatcctcccatcttggcctcccacagtattgggattacaggtgtgagccactgcgtgaggcccagttagtattctttacatttttaaaataaaatttcagagaaagcaaccaaagggagcataactctgataagaataataaaaagaaacaattcagcaactctcttacagatttttatcatcatcccattcataattgattccaaacgtgcatgaatctttcaagataagtgtcttattgattatcctgaaaacaagcgatcacttggtgtcctgagattcgctcactgccctcccctgattaccgtaaacagagatgttgatgagaagaaatgtcactttctttggtgttggatccataggacattttgaggaattgggtgtggggagtggaggg

SEQ ID NO: 18534 - DNA, 1201 bp, Homo sapiens
gttttggcagggttgagtctagtatttctgttgggatccggggagcatatggagtgttgtttgttattttttagagtttcttattgcggtaagtgctcaggagggaacagagggagaaggatagaggaaaagcaaagcaaaacaaaatagaaaagcacaaatgaagaatatttagtccattctgtattagtcctccttgatggggggacacatgccagccaggttacctgattcatctagttgtgattttattgacagtcatttctaccttgttggtatccgcagaggttgtcttgaagggggctgatgccttctttcactagctttatgtggctggcagttctgtcctgccactcttttcctcatcatctcagcctccctgcccatggcactcaagagtccaccttggcagaacctgcaactcttcagcgcctccctaatgaactccttgcaagggcccttggttaagttacagtagagaagtggttgcttaagcaagtagtttccggtaaaggcataaagatagcccataattgggtgataaaatacctggattgcatctaaaaataaagacttgtgaaggtaaaactgtagcttacagtgtgcgactgtttaccttcttttggtttcttctcatttaataggttggtcatctctctgctggctttttcccccttttttctcccttctgtagaataacatgtggaccattaactatgatgctacttcttagctgcaaggggggaaaaatggaaaactccaggggaagagggtctttacttagggagttggcatttgttggaatttcccaagaacatttcatgattagtgacaggttatcttctagtttacctgaaggctatggtcactcaacaaattttgtgttgcttcttacgtgtcacgcactgtgataagtcctaggattatagaagtcaataagctatgatgcctatccttaaggagagaaacacatataggataggaaaatagcttgccatgtctgatagatattaggcattcagtctctctctctctctctgtttattatagatagaaataaaaaaattataaatagaaatttatttctcgtggttctagaggctggaaaattcaagatcaagatgcagacaggcttggtgtctggtgagggctgctttctatccttcaaaaaggcaccacgttgctgtgtccttatttggtg

SEQ ID NO: 18535 - DNA, 1062 bp, Homo sapiens
catatatcaaaccaggacagtccaagtccttccggggactttgctgccacagttgacagggggaggtatttgcataacttcaccacacacagctaagctggtgatcctgctgcttggcagcatcttcccagcgtacaacagaggaaaactgcctgttgtagttaaaaaaaaaaagagagagagagagagagagactgatacacaaagagaatcagaaaggagtagagatgaaacaaagatagagctagcatgattgcaagctgaggacatacgaggagtccctgggtcagctgggccatacatttgtaagctgtagacaaacaaaaatgatctttgggttccttctttagcaattggagttggaggaggatgaccttagtttgcgtctttgtcccactatcattatatccaacttgtgtaattagaaacactatttaagtctcagtttcgtctcctgtcaattgggaaaatatcgtgaggcggagatgtgagatgtgatcacgtttataaagtctgcggcaagaggatgataaagtcacttctcaactccttctcaactcctcctcctggcttattaatgcccatcctttaacctgtcctctgctttatctcttggaatccttagggcctttttaaccccatatacgaagcaaacctatgtgtatgtgtttgtgtgtgcatcaattcatatggtcctctgcagccttgcaaagtcgattcctgacatttccgtagactgttttttttgttttcagcaatactctccagcagcaaaacccaatccgctcatattcttgcatttgctgcagcaaaacctgacctctctttgtgttacctgagtcttgacgaagaagactgaggaaaggccccccccccccccccgccaaattgtcccgttgtctcttggctggtcttgccagctggcacacagcttcctctgaccaccctgctaggtacaaatcccacatgaaaagtctcaatcacctggctcaaactcatagttttcaggtggcataagccatggcattttcacctcctttcctggttgtttccagaaaggga

SEQ ID NO: 18536 - DNA, 1008 bp, Homo sapiens
tctccttctcatatgtttaggcaagcgttgatgacatcaacctagccttttattttaaatcccctgtcaacgcaattagataatacaaaaataacaaaactacaggaggttgaggatggggctgggggccaaggagattacttggtttgaaatgaataaattgtctatcctaagggaattctttggtgcattttattgtgtgaaatgagcctggtcatatgactgccctgcctccctggaggcctccctgccctcctccttcccacagacacttatgggaggtactggccagctctgtatggccagtactgccctaagcaagaccaagaagcttagtctcaatttcagagagttattttggcaacatatttgggaaaatgatagttagatgctgcgttagccagcctctgcatgattttttacgcagaacaaacagttccaaatatcagtgctttcagcaactcatatatttctcacttatggtgcatgtcgctgatggttggctgctgctctgatctcactccagtatcagcttcagtcaaggaacgtattgttgtcaaggaaaggaaaaagaacagtggtgagaccaaaggatcttaaagtttctactttggaaggggcgtggcattgcttctctcattccattggctgaagcaaatcatgtatacaagccagaagccaatgagctataggaagggtagcaaagaacagaacagccatacagcctagcccacagatggggtcaagaagattcaataggcattggctgaagacttaagacttctcaagcaagttggatcctggtgtgcacctggcatatcctttaggattctttagtgttggtagattgagatggaaatgaggaaacttgtattacctactcctttgggccagaatttgcttacagcacagtgaggaggtattctttggagagcactgtttcccaagagtgattctaacaaagaggtgtaaatggacaagaatgaaaagcaattgcaagggcccttg

SEQ ID NO: 18537 - DNA, 1034 bp, Homo sapiens
gagcagatatcgtatgaacatgattttgaatgctggcatggtgatgaaaggtgatgttcacctggagtctgtacacacaaaaccctgttcattttacctaaagggtaagaacatcatggcccccttcatatcctggttaatgtccccgctgaccctgagttctgcctccatcactggaacaagagcctgtctttgggaagaggtgtcttccctggcactcgtttgatttgtagccgccacacatggcaggtcccaagctgtctgaagtcttggctgccattcctaagctactaaaactttgctggagaacatcaccaatcacgctgagggatcctttgacaactcagcttcatgaggacagctgcagttctgcgtttaggctggggtcaccggggtcgctgccccagccccactctttagcctcagtccctctgtggttcccctgactgagctcctcactaaaggggaggaatccctggagcctccccatccaaggccagcgtgttccatttgagggtaactggatccctgaaattcacccccacacaatccacaacctactactagaatgccatatgcttttctatatgctgttgtttaatttcagttggtacatattttattttttgaaacagacttcgttagaacatctttagatttaaagaaaaatcaagactgtagtaccaagttcccatgtgtgtaacagccagtttatcctattattttaacgtcttatgttatttggtacatttattaagattaaattattgatactgaaatattaggttgtgcaaaagcaattgtggtttttgccattaaaagtaatagtaataataatactcggttggtgcaaaagtaaatgtgttttttgctattaaaagtaatgcggttttacttctgcagtttttttgccatttgccaattacttttgcagtttttgccagtacttaaaagtaatggcaaaaactgcaaaagtaattggcaaatggcaattgcggtttttgccgttacttaaaattgcattacttaaaagt

SEQ ID NO: 18538 - DNA, 1024 bp, Homo sapiens
ttgactagacaaaaggtgcagagtagagtatgcagtgatttcagggtgttgggctctgacaagatgatgccgacttagacagtgttagtcaacatcaaatgtctggatcaagagaggcaagaatcccgtggatttggcgttggccagaacttgtctggaatcttgttttctgccttgagtgtcacctgttgagagctctgttgacaaactggcatttgtccttgggagagtagcctcaggaccaggggtgaagagttcagtaaactgtgtttaacccaaggaaagatacagggtgtgtcagattttgtaaggattttcaaggagcagtagatagtggccctacagtggaatgaaccttcacaccgaggatctgcttcctttgttggaggtgggaaagcaaaagctggatgcttggaattgtcatggctgccgtctgagtgatgctaccttgagtggacggtttggccaactaaggagtaaggcctctccctcatgtcacattgagtggtgctaatgtttcctgaagtttccctttcttttcagttcagtgtttcagaatctcagccttccagcagaatcccctttgtttgctctaaatatacattcccaagccccgtgtggccattctgatttactaggtctggggttgggggattgtgggtgccgagaatcagtatttctatcaagctcccaaggggacctgatatatacatggagctgaaaagtacccacctaacagacttgccagctccttaaggataagaactatattttcttcctttttttgtatgcctccccatgcaaggataattacacagaataagcactgagatgcctgttgatggatttattccagcaattttttttttttagctctctttgtctggaactttgcaaaataaacaccatggtcactccgtgctttgtgagtgacgtgctagaatggaatttcactgttttaaattcagggttaatttcttgctttcaaatgaattatgaaaggaagaggagagacctttggaaa

SEQ ID NO: 18539 - DNA, 1033 bp, Homo sapiens
ggctagagtagtcttcccatcctgctttagctaatcaactctttctcatcatttaggcttcaaatggatcatcactttctctggggtgcaggggtctttcatataagtatttctttgaactcattccaaaaaagtggatttttagaaatagaaaaaactaatttagaaatagaaaattaattgagttttagtttttagaaaattatctaagaagtagatttttagaaatagaaaattaacgtagatcacagaaaattatccaaactcagttaattttcccttttccagcaactgtatttgtcctccccacttctcttccctgccttctttttttctccttagcacttacaatgtctcactcatgtagactcgaagcttcacaagggcagggattttagtctatttcattgaaaatctgtcaccagtcactggcccagagagagtcctcaaaaataattgttgaatgaatgaatgaatgaatgaatgatgatggcgtgatgattgtgtattcctcatctggctgtaagtttcacaaggccaggcactggggtcctattttgctcactgttgctgtgtgggaaagagttagtacagcagactgtcgcaagcttggctcttggctgcatctgggaacttggaatttaggagggctgtcaccattcccagatcagataaagatggctcactctgtctagactgcttgtaccaaaaatagggctcatgtggaatacctgctttcctttgtggaggctggaattttgttatatgctacagagagggtgcctacgtggccaacttccaataaaaactgtggacactgagtccctaatacatttctctggtagacaatacttcatatatattttcacagctcatttctgggggactaattaaatgcatcctgtgtgaccccactggaagaggacatttggaatcttgtacctggttttctccagacttcgcctcattcaccatttccctgtgctcattttgccttgcatccttttgctgtgataaatctcagccatgagtg

SEQ ID NO: 18540 - DNA, 1057 bp, Homo sapiens
tctctctgggttctacatatgtagatttaactaatgacagattaaaagcattcgaacaaacggagggtggtatctgtactgaaaatgtaccaactgcttttttttgtcattattccttaaacaatccaacataaccactatttatatcgtgtttatattgtattaggtattataagtaatctagagatgatttaaagtgtacaggagcatcacatacattatatgcaaatactatacaattttatgttagggacttgagcatttgtggattttggtatttgggggggttccttgaaccagtcccctttggatactgagggacaactgtacaaatcacatttaggagtggatgcaggtcagtcgtgacatctcatccaccccttcctcacccaagattctccgtggcttgtgtcaaggcctcaccacatcagaatatttctgctcatggttgctgagacagagctggacaggtccagcatccattccccaaaacagaactcaaactgacgatcatcaagatattccagctatggcaaactgcggaagaattaggacagatgtatgacttatttcatataaagctaaatcagtttaatttatatgattgtcctttattatgagattatgttcaacagatattttcagtgttaaaatattcttttttttttttttttgagacagggtctggctctgtcacccagggtctagcacagtggcacgattttggctcactgcagcttcctcctcccaggctcaagagatattcttgcctcagccctccaagtagggctacacgtgtgtgccaccgtgcctggctattttttgtagggacagggtttcaacatgttgccaaggctagtctctaactcctgggctcaagcaatctgctcacctgggtctcccaaagtgttgggattataggtgtgaaccaccatacccagccaaaatattcttttcaaagtgattagaagtaggagaagcttgctctctttttattggcacttctgtcttacatgcactttttgatttaaattattctgtcttctatgaaatgaca

SEQ ID NO: 18541 - DNA, 1056 bp, Homo sapiens
aacgaggaggagggaaagggtccagagcagtaaagagcctgtaaataaattcataccagcttcagccccatgctttcgtttgggattcctcatccaaccctgacggcttccctgcgggacatatttccccctcttacagataggaaaccttgcccaatgtgattacgccaggaagtcagatttcaaatctaaatgtgcctaatgccaaaactgtacctcttgccactcaacatctgcagtcaaaggcttcctgactcaggatttgctggggtctggctctgggctattagaattagatgcgtgagaccctttcaatctaaaccttaagtattttgcctgttggacagatgcctggttgtccctttaatccatcgcccaaaaagcctgaggaaggatggcaggtggacttggatctaggccactcccttagatcctgattaggggacctctgcgactgctcatctgggaggaactaggggagcgctaatgtgttgtccttgactgggcaagaagggaaggagaattgtgaaacatgcacaattagaagtcgtgcacctgggttcatatcctggctgggccacttactttctggcgggtggggagggcagacaagttgctcatcctctctgcgcctcagtttcttcatctacaaaatgaagatgttggttatttctttattcaagggttgttgagaggatgaagtgctaaaaatgcttgaccagcattcacacaggcactaagacggtgagtactcactacttagcgctgtcaacatcatctccgtccacatcaatgtcgtcatcgtccttatgaaaagccctgggcatcattttgcccttgagctggatgtccatgttggaaaaacagctagtggaaggcgtgcccaaatctcagaagttggcgtttccttgcagatatcattggtggccattggaggggaaaaagatgctttggaaaccaggacacagagaaaagtgcctcgtattatacagagccaagagaggtcactgtggaagtacagaggaagccttggcctaattgcacggttaatacaat

SEQ ID NO: 18542 - DNA, 1042 bp, Homo sapiens
tatctactaaaaatacaaaaattagctgggcatggtggtggggacctataatcccagctacttggaggctgatgcagcagagtctgttgaacccaggaggcagaggttgcagtgagccaagacagtgccactgtgttccagcctgggcaacaagagtgaaactctgtctcaaaaaaaaaaaaaaattgtttctggccccacgttacagatgaggcttttaaagatacccagccaatggtccacagtgatgtaactcatcagtggtccacctgacattggaaattcggttgctttggaaccttctactacatcccctttccttactcactgacatcattcccagatcaaagaaagataaaagaaggaagggctggagacgttgttttcctgtatgctccttgatgaagggctcagagctaagcgcggagtaggtgcttaagcccttccatttgaaaggagctttaaacacctttggtggcagctaagagtgtcaaaatggagggatgtgtaggggacctagggcctgggtaacattgtcccaggccagggcctattgtgttgtgtgtgtctccactttccagcctttgggaacgcagagggggacctctgtaattggtaccagcatcccttccttgcagggtccgtccttcctctgagttgggggaaggggtctccatggtttcttctaccaggtagacccagaatcactttcaacttgctcacctgtctgtgcagtgtttgagttcttccctgggaagcttgctcacatcatccacttctctctgggttctccgtaccgctttccccaatccaagctaagctcttctcttagttattctaataactgcccaatatcaggcactaccctcaacactgtttcccatggcaattattttacatgacagtttaaaaaacaggaatgctcgatttgtattcccattttgcagacaagccaacgaaggcttggaggggttgaatggcccaagtttcctaagtggccaggggcagagtcaggatctgaacccaagacataggcccagga

SEQ ID NO: 18543 - DNA, 1063 bp, Homo sapiens
ttctcttaccattctggaggtcaaaagtccaaaatgggtctgtcttagtccttttgtgttgctataaaggaatgcctgagctgggtcatttacaaaggaaggaaatttatttgtctcatgtttctgcaggatgtccaagaagcatggtgccaatgtatttctgatgagggcgtcaggcagcttctactcatggtggaaagtgaaggggagccagcatgttcagagaacatatagggagaaagggagcaagagaggggaggggaggtgccagagactttaaaagaaccaactctctgggaacaaatagagggagaacattaatctagccatgagggatccacccccgtaacctagactcctgtcatcagccacggcctccaacattggagatcaaatttcaacatgagatttggaagcaacagacatccaaactatagcagggtctccttgggccaaaatcaaggtgttggcagggctgggctctgggggcttctggggagaatttgttctgactttttcgatttctggaggccacctgtgttccttggctggtggccacatcttccatccttaaaaccagcagtgcagcgtcttcaattctgtccctggctctgctccttctctccccctcctctccccctttgtcatctttttaggtttatttgtgaccttttagatcctttgtgactgcattggtcttccttgggtaactgcgcatactctcctcatgtcaagaacttacatccctctacaaagtcccatctgccatgccaaataacacctttgcaggtttcagggtagagcatggatgccttttgattttgatttggttgtttttggtagagatgatatcttgctctattgccaggctgatctcggactcctgggctccatcaatcctcttgcttcccaaagtgctgggattataggtgtgagccagtacacttggccttttggcaccattattctgcctgccatcctgtcctaactaaagaaagtaaggtccctccatcctccatcttagcccttctttccttagcctcctaacactcaacgcaattta

SEQ ID NO: 18544 - DNA, 2263 bp, Homo sapiens
tagagacgggatttcaccatgttggccaggctggtctcaaactctggacctcaaatgatccaaccgcctcggacttccgaagtgctgggattacaggcgtgagccaccgtgactgacctgtttttaatttttttagagacagagtttcacactgtttaccagattggagtgcagtggtgcaatcctagcttactgcagcctgtaggtcccgggctcaagcgatcttcccacctctgccacttgaataggtgggactacaggtgggtaccaccatacccagctgttgaaaaaaaaatggtggggtattactctgttgcccaggctggtgttgaactcctggcctcaagcgatcctcctgcctcggcctcccaaagtgctgggattacaggcttgagctacttccccaggctcttcccccgtttgttaatacataccatgaccttggcctttcccacctcttaggttttgcttactttcccttctgtcctttacttatgactctgcccccttttgacctctgctaaaattatttgttactgttgttatgttattatttcatgtgttaagtctacagtgtataacttgggtttacttatctcatttaacccttaggaaaaccttacacttaaatactcaaagccttgattttgcaggtctgattgatgggcatacagaggaattaaatgaccttgtcttccacatatggtataaggcacagtagtggaagcaggatccaaatctgtgtctgtgtttggatcaacagccctggccaccatcttgattcatttctcttatctgtaattctatggagggaggttccattgtatatttttttctttcaattacagtattatttgtatattggaagcctattgtactttatctgtgtaactgtcgtagcagctagaggctagtaggactggctgaaatgtcagaggaaggagggaagaaaagggagaaaagcaggacaaatgaacgcagattaaggaaaataaaaaagagtgtttggctaacttgcataaaaaggatctcatttttctttgtaacacattactacatacagtgaccatagtgtttctctaatttcttcaggacttactttgaagatgaagaagtatgtgtatccgctttttgtctttcagaataacatactgctgtctgtaaaaatacagataatttctctcttaaattccataagctggagacactgcccctgtttcaaatgaatacagattcattttgtcacctgtgtgaaattggtgtccgtgtgccttgcttcctaggctgtccaccatgacatcagcctgcccatgcaatgcttgagatttgccctgtgactcaacccaaatctaaagcccgagtcgtatgaatccaggacacctgcctgcaaatgcatttttcatgtataggttattcactctggtctttgagattatgtaattagcatatgttgtcatagtgatgtatttattataatggaggtgttctcaggaaaccagatttaatacttttaaatcagaggccaacatggacttttaggaattccattcacagtaaattttatgcgtggtgaaaggttatggaatgggtttccatgccatgtctccccctgtcccacaaatctcagctggcctgcaaaggttccactgtggatttttgccagccagccacgctgatgtagacagaatatttcggatttatattattgcttacttggcacatcttccattggaaatggaatagagaaaaggtggcttggctgtttggtttatgtcctaaaaccttatcgtaatgtgattctccttaacagagggattcgtaagcttaggactgatagagatttggcttttctgctgttggattgatagctccttgactgctgaagccattgcccatctgttcaactgttgtattcacgaggaggttagacccctgacccaaggcccaggtacctggctttcctcagttgggatcagaaggccacaaagttttcttatattttaagcatcaaagtagcaccactgtacagcatctttacttaatctgccctctttcacgtgtgtgcatccctggcatgcttaaacaagaaaggcaaatgagagagagcgagtgagtgcgagcgagagagccctgaggtgccagaaggctgtggttcctttgtgtctacagaaaagatataacgattgaattagactcttaaatatctgtggatgtcaggttgaatacaagcagctattcagtgttttactctggcaggagaaca

SEQ ID NO: 18545 - DNA, 1304 bp, Homo sapiens
attattttctacctagatcaggtataaggtggatgtattattggcattcctaggactgttttaaaggaagtacctatgaggcctcatgataagccagatgtccagaagccagcttgagaccagggctcctggtcacttaaaagatgtttggggctgggcgtggtggctcacacctgtaatcccagcactttgggaggctgaggtgggcagatcacgaggtcaagagatcgagaccatcctggccaatatggtgaaacctgtcactactaaaaatccaaaaattagctgggcgtggtggtgagcacctgtaatcccagctactcgggagcctgaggcaggagaatcacttgaacccgggaggtggaggttgcagcgagtcaaggtcacgccagtgtactccagcctgggtgacagagcgagactccgtctcaaaaaaaaaaaaaaaaaaaaaaagaaaaagaaaaaggtgtttggaagccatgtcccatgaattccaaatacaattgaggactctataaaggactataaaaaaagttgtaataaattatgcagacccctcagcagttgactcacctctctggtgctccaggtatttctcagcgtgttcggggtctccctgtgttacctggacagctcctgccatcattagcacacagccaagattcctcgaccacccatgactctggatttatcatcctcaagaattgggggctgtggaaaagatgccaaatttgttcttttcagatttaggttcttctgtgataaaaatagacttggtaaagaagcagatatttctttaatacgtgtatatattagactgtgaatttattcatcttccttattcatcatataagtaaattatatgattggacccaggcataaaacgtgatttgactcccccttgcccatcacagttctggagttcacatatcatttgttactttgaaaaatgaacttttgttatttgattatggtaataaataatatacatggtagaaggagaagaaaatgaagaaaaatttagaaacttggacagaggaaaatgaaaatgttctattaattccactagcatgagataatcactcttaatattttgttgcatgttcttttctttcttctgagtgatagcatttttttcaacaaattgggctcgtaatatataggcacatagatatataattaaaaaaacaagaatttctcatgtcattaaacattgcttgaaaaaacatactagtaatttcctaagattacaccatgtaaatgaattgtattttatgtaaccattccctagtgttggatagcta

SEQ ID NO: 18546 - DNA, 2303 bp, Homo sapiens
gttgttttgaattttggaaatagaccagtgattcttcagtagggtcgtaaggtcccgtcaatgcagcagtcaaattttttcttggtgggggggatgcatatgtgtatgtgtgtgcatgagtatcttgataatttagaaagattaattaaacattgatcatctatgtgaccacatttaaaatgagcaccaccacatccaaatgtctgagtttacattttgtgtcggtacttgctttggcagaactctgtgcctttccccaagtcttctgtgaccttctcacctggcctgcatcctggtccttatcaaccgtattttacagttaaggaaactcggctcaaactagcttcggggactcgctgtggccataggtgccctaggctgcagtctgagagtgaaactgaggtctcactcccttcatagtctgctctccgtctctgcctcatctggcttctcagggtggtggggcgtgggcactaatttgatttgatcacttagagacaacagcttacaaaatgctaccgagcagtgcctgtcctttctgagaacttgatataataacgttggcttgatctcctcagcctgtgtcttgagggaacaagtaaattaaacaagtaattagatccataatgtttttagaagttagaagatttaaatatatgaatctcatctgagtgtgcagccttttgtctgctgtgtttcctgccaaaagatctcttgacaggaaataaacattaaaataatctttaatcccttgtttggtctattaccattaacaattgatgcactttaattttgtggggttttaactacaaaatggaacggctaagtagtgataattgggtttggaattatacggtcatttatatcaacagagatgcaaggggctgggagggagggtgattaattatttactatttcctggctgtggttcctattatagaattttctgatatgttcttctgtgaacaattatcaccaaatgaaagtaaacaaatctgtgatttgaagccttatttagaagttagtctatatttaggtgatgtgggcttgattttcacagaccctgtgggctgtctgtgtgtgttccttttctcagtaccccagctctgtattcgagcgtggttatctttgtgcatcttaaaatccacaatgcacagcctggggagaagccttggttttgccagggggaaaaaaagagaaacacaacattgagtgaggtctagggtgaataccaaaggtctgttttgaaatgggggtgtgggttattcttctctctttctgatttgcttcagtacagtatgggatggggaagaatcaaaattattatgtcaacatgaggatgaaagttatgctctgttgtttctcataacatttgtgtgtgtgtgggtgggtgggtgtgtgtgaaaggtaggatcacctctctgtgcctcagtctccccatcatccttcggtggtagatcaatgctatctgatgaggccttttttgggatcacccactccaacatgcatgtcctttctctgtcccctcctggtgcctgtattagtctgttctcacattgatgtaaaggactacctgaggctggctaatgtataaagaaaagaggtttaattggctcatggttccgcaggccatacaggaagcccagttagggaggcctaaggaaacttaaaatcatggcagaagatgaaagggaagcaggcatgttctgcatggctggagtaggaggcaaggagcgaaggaggaggtactacccacttttaaacaaccagatctggtgagaactcactcactgtcatgagaacagcaagggggaaatcagccctctgatccaaccacctcccaccgggcccctcctccaacattggggattgcagtttgatgtgaaattttggctgggacacaaatcccaaccatatcggcacccactgagcacatcctcgtggatcttcctggctctccttacaaggggttccttccaaacccaagcgccacaatccttaggcagattgctctgacacagaagactggtgagttctagacttgatgtgtttcatgggaaacaggaagacatttaggggaggctgtagatacacagccgctctgtttagggaaggctgtcgatacaccgctgctctgaccatcatggcgtctggtccatgctcagattctggagtgttagggtcttcgggcacatggtggatgagcgttttgcttcgtgtactcatttatttctgaaaataatgcagccccttgtagggctttctggctaattgagtggtgccatcattcatgcaattgcgca

SEQ ID NO: 18547 - DNA, 1505 bp, Homo sapiens
cggataatatgccatcacatggtgtcatttaatatattcattcctatttatagacattgaagttagatccatgtcttactattacacatgacttagtaatgaatgttcctgcatgtatatttggtctgcttgagcaaggatattgggagggaggatttccagcagcagaagtggtggaacaaaggcactgtgtacacctttgaaacaattaacttcaccaaaattactaaactgtcctctagaatggttaaaccaatttcctctctaccattcacacgtgagaatgcctgtggccccccagaaattatctccagcagcagcaacagagaggactggaatgccattgacaggtcccacaagtcagcaatcagcacgccattttttaaaatttatgttgctattgtatcgtaaggttcttctgaagcgaccacttcataacactgtgtagtccaatccctaagctgggcaatttttttttcccctttcaatacatcacattgattttctgtatgactttatctgcttaatacaaagtgggattgaacagttatttgtctggatttgatcattccttattaaacatttatgatttagctttcaccgcggcatcttcttgtaaggtgtttcttatttttatcattttccgtaaaggtaggattgtgttgacagccctgtaataaatgtctcttggaagagatgtgttgctgagaggtggggagggggtgggggctctgtgcatggaatggggggaaaagcttcagggaagggcagtgcaaattgtttctggactgatgccatcttttaataatagtagttaatagactgggtacaatggctgacgcccgtaatcccagtgctttgagaggccgaggccggtgtatcgcctgagtccaggagttagagaccagcctgggcaaacagcctgaggcaaaacctcatctctacaaaaaatacaaaaaatcagctgggcgtggtgatatgcatctgtggtctgagctactcaggaggataaggtgggaggatcatttgagcccggtagatggaggttgcaatgaaccgagattgtgccactgcactccagcctggatgatagagcgagaccatgtctcaaaataatgataataattgtagtagtagtagtggtggtggtggtggtggtagtagtagtagtgaatgccctgactttggggtttgcagtaagctaggattaagtgcttcacagtgaggcacagtggggagctactctgaggatgaattgcctagtaaataagtgaggtttgtataaccgaggccagatcttagaacctcctgctatctgtacatagaagaatgttttagtcagaggcaaggcaaggtcaccaggattcactgagagtgttggtcagcatttcatctgcatatacaggactggaaaataagagagcgcaatgagacatctagtttttttctctttcgtttgttctgtttcccactgagagaattttctagctttatgtggagaaaac

SEQ ID NO: 18548 - DNA, 1050 bp, Homo sapiens
ggttggagaaaaagcagtcacagctcctggctgctgtggctgctttgagcttcttcctcgatcaggctggatcattaccagcctgtaccctcaaaggatgcccttagtcctgtcccctctcactagcagggattccaagcttgtaaataaagtctcccacttaaaatgtgagcagagtgaagagctggcagtgtcaaaactctgtgtccagatgttttatgattttcccttttccagatgagcccggtgtatccgtatcagtgtgtctaggaagaccaagcatgccgaacggccagcagagtagaaactctgtgtgcccatccattatgtactccctgaattaggctccttgaggctcaattattaaagtgggatttttcttaattattaacagttaaaaataggaaaatagatttcaaggggaaaaaatttgcaggcaacaagagtccaattctaaatgtgtgcatgtgcgtaaaacggaatttgccaaacatgaataggcacttacaatgtgactggaattggctctgtcatgtgtcagcctaatagcctaaaccctggttcaatacaatgaacttgggaaggtttgcttaatgaaagaactgacgttttctgtgcagcggctgcattcatcagcctgcatcctgttcattacactacaaagggctgccaatgggaattggtaggatcatctattaggtaaatgcgatggggacaaaagatagcagagcccggggctttgtggaattttctgtggtggtccgggttcctggagtagggagctgtgatgacgggcaacagatttccaagttggcacgcgggcttctggagtcacgggctgaattccggcactgccacatcttgccacgcacatcctaagggagtgtagagaagagagttttcagttatgcatgacactgccttacccattgtggattcagtagggatattcataactgtgaatttgaatataactattaaataattgaattattattattgagttactgaatataactattgagttttccctctccatctgggcacatg

SEQ ID NO: 18549 - DNA, 1032 bp, Homo sapiens
aaattctcgtaggcattatattgcatctacacataaggacacagtgtttacagaccccaaagcttgctgtcccctgggcaggtgcatgagggggtcccaggcaatcaggctcttctcaaacctgaattatacccggcctcagggtataggggtcaggcagctgtttgacaggattcttgcaaatgtttttggtttctctgtctactcattacgtacactctgccagaggttgaaaactcaatgttgagattacatacatcctgaaaacactgtttaaataaaattttggcctgcatcctgtttttgaaaacttgcaatggcttgccaacgttttcaagttgagaagtttcacaaaaaaaattcggatttccagcttctttcaaaaacacaggtcaaacatcctgagcctgttctgtggtcagttactcattagcagcctctgctctaggaggaatagttatgggtcctttcagacatgcaacccccaaaactccatgttgtttacagtgtgggacacctgactttcaccttttatgatacctgcctggggcatgcatgtggtgactttttccatctctggtctctatcttatctcttgtgatgaactcaggtctataaagcatttgggcactgcctggcacataggatatgtccagaaaacactagctggtattaaaacagaggaaacatgggaactgagggtggtcagtgacatcacattgtatttcctttatggtgtccttctgagtacagaaccaaacatttcttaggcgtacaatttcctgcctccaaattaatgttatttctaaaaagtagcccgttccactcctacaaatctttgcccaaatatgtccttttcagggatgacatccttagccactgtttaaaatagcaaatttctttccaaactctgccgtccctgaatctctaccctgctttatttttctccttagcagacatcatttctctgtttaatctgtctacttgctaattgtctcactgccctccccctccccactggagagtgaatga

SEQ ID NO: 18550 - DNA, 1022 bp, Homo sapiens
gtgagccgaggttgtgccactgcactccagcctggctgacagagggagactctatctcaaaaaaaaataataaaaataataaaaaaaaaattacatgaaaaatagagacaaagtctcgctttgttgcctaggctggtcttgaactcctgggttcacgtgatcctcctgcctcggcttcccaaagtgctgggattacaggcacgagctgccacgcctcacctcttgttttcaataccattgataagttgtggtcttcagggacttgtgggcattttcaagttaaatatccaacagtcgtgatttagggcatgaagagctcactcatcaagatgtatgtaattcagattttctgagtgtttaattcggcgtctttggtcacaaggaacagagttttacttgtgccacctcttctaagaaaaaggtttactgtaagagataatgttggcaagctgaggaaaggaggcagttttgggtaactgtctcttgcgatcccctcctgcacaactgtggcgttctctttttctgactagctgattctgctgctgctggatttattcattcttctccctcacagttttggctcgcacatgcttcctttttagctcatggccgtgcagttcaactcaacctcatggcatctttttatcagctgtccctgctgcaacaggcttagagttggtttcccaattccctagcgcagaaatccactggcatgagtcatctttcccattggtagattgcagagcaaacttctggacagatttgcccttggctcatgtatgattggacctgcggtctgtccaggtgtactcagagtggggaaggggagcggtggcaggtaatacaaaacccacctaagtagaaggacctatgaaccatgagggttttccttagcagggagtgccagtgggtagggatgactggttttgcagtttagggccaagtgagttggaatgacagctgtggcgtgttgagtcagatcaagtccagaattcctctccaccccacccatttgcagttcc

SEQ ID NO: 18551 - DNA, 1045 bp, Homo sapiens
aagaagtgccttttgcctaccaccatgtttctgaggcctccccagccatgtggaactgtaagtccagttaaacctctttttcttcccagtctcaggtatgtctttatcagcagcgtgaaaacggactaatacagtgaggaaatccatgtgttaggaagggagtgtggttgtacttcaacctggaactgtctaactcctaaggttttattaatatctagtccatttctctcaatctaatagtaaatggaagagaagcaacaacttttgttttccaattccttttgaacatttgaaaggttttctgaaaggacttaaagaaaccatagcttccttaccagttcccaaagcttcagtccttaccaaagtgtacattgcctttaaggagatttgtttccatcaatccctcccatttacaaggaattacagaagagtgatgcccccttcaaagtggctcacacctggctgacatctgttcattaagaatgcctgcctttgggttctaagacgtccaaggagctcttatgggtaacacctgtagatttatagacgttcctctctgactgtaagggccatatgcctgaatctctcacccccatgtttataaaacttaacaattgtggaagcaatgaattgaaggactagggtcaccagtggagtcccataaataggttgtttatgatccctgtgaaacaagaagaccctcttaatttcatgcttcttaaactggggtatgagtggccccaggtttccctgttgggggtactgataccagagttcatttgaagtcattggaaaccaaggcatattttcttaaagagacaactgtttttggtgaataggccatgttgtttatagtaaaaacaaacatgaatattctgtaatagaagatatcgtttgcatggtgttttaaagctaaaacttgagttattaaacacccttctctccctggggatgccttttgctatggggttgcatccacggaagagtttgaaagcccaaccatatggacatcatattattcatttttatttgccatccagagctt

SEQ ID NO: 18552 - DNA, 1029 bp, Homo sapiens
aggtacgctgtggaaggacagatgtcattccttaaaggggctgcactgaattagaccaggggttctcaaagtggggtccctggaccggcagcatcaccatcacctggaaacttgttagagatgcagatcttgggccccgccccagacctcctgaatgtgaatctctggtggggagggagacgaagtgggagcctgtaggctgcagtctgtgttaagctttctgggtgattctgatacacggtcaagtttgagatgtagcaggagaagcaggaaacataggagagaagccactaggggtgggaatcagaaatacggtgtccctgcctacctaggggctacattcctccgggcaagtctttttaactctctctgcctggcaacttccttaacaaagagtgatactaatacctgccttcctgtctttgccacatcacgggattttctacagctcatattggttacagtgatagcagctgagatttaggctgcacctgagtaccaggcagggtcctaagtgacttcagactctatagacagtccctgacttataatggtttgacttagattttttcacctttgggatgctgagaaaaccatacacatccagtagaaaccgaactttacattttgagtttcgatttttttttttcacctgggctagtaatacgtggtaggatactctctcacaatgctaggccacagcagcgagctgcagctcccagtgatcacaagggcaaagaatcgatattctaccaggcacggtgttgcctgataaccttgcccagctgtaggctaatgtaagtgttcttttttatattttctttaatttttttaaatttccacctgttttggggggggtacaggtggtatttggttacatgagtaagttctttactggtgattggcgagactttggtgcacccatcactcgagcagtatacactgcatccagtttgtactcctttatgcctcacccttttaccactctttccctctcagtccccaaagtccattgtatcattcttatgc

SEQ ID NO: 18553 - DNA, 1026 bp, Homo sapiens
gtgatggctcacgcctgtgatcctagcacttttggaggcttatgtgggtggatcgcttgagctgaggagtttgagactgggcaacatggtgaagccgtgtttctacaaaaaatacaaaaaaaaaaaaaaattagccaggcgtggtagcttgtgactgtactcccagctacttgggaggctgaagtgggaagatatcctgagcccaggaggcagaggttgcagtgagctgagatcgtgccactgtactcccacatgggtgacagagtgagaccctgtctcaagaaaccgaaaaacgaaagaaaaacaagttcatgagataccacatacgtgaatatatgctaacacagcagcattattttttggttaatcaatgattatcaatgcttctgtgattttaaaaaggagagtcagctattccctcttctgcccgctgatatctacagcctctaccagatggtacctcacttaattgaggtttgccttttttcaggctcttctaatgatcttctggccaactctaaatcacctttaaacttcatggaatttatgcattcttgttaatttatatccatgtaatatcagggtatttctctttgtagctgcatcttctaagataatggtttttcatggagactggcattgtcccgtccctatgagggggacatttgggaatggcatttttagtactcacaaggtaactggggcactcttggtcttggggaggggaggtggctggggacgcagagggtcctgcggtgggtggatacttacaacatagaaatgtcctggctcttgatgctggctacaccctcagtaagagatactgtcctagggtcatttttttcaacccacactagttacgtggactgtcttagtcagtccaggctgctataacagaataccgttgactgggtggcttgatttttttttttttctcccagttctggaggctggaagtcagatgtcagggcaccagcatggttggtttctggtgagtgctcttttctgcatttgtggacagctgcc

SEQ ID NO: 18554 - DNA, 1034 bp, Homo sapiens
gctcctacttgtcattccagcattttgggaggctgaggtgggaggattgcatgagctcaggagttcaagaccagtgtgggtaacatagagactctgtctctacacatttttttttttaattagctggggatggtggcttgcacctgtagctccagctactcagagggaggctgaagcaggaggatcccttgagtccaggagtttgaggctgtagtgagccctggtctcaccactacacttcatcctgggcaacagagtgagatgctgttttgtttttgtttttttttgtttgtttgtttggttttttttggaaaaagaaagaatcaccataaaaaagatgggtaactcggaaatttcaaatgcttgaatttcttgggttgggaagaatatcccaaaatgtgtttccaactacctcactgattttgacttcacagggagaatattttgatttttatgctctgagttgctggtactgctgtgggcacagaactgggtatgacagaacatttttctgaactatgactctgatcttctcaatctctcagtgggaaagagttttggaacttattatttttaaaaacttggtaaaagatttataccataatatttatcattttaaccatttctcagtgcacaattcagtggcataaaagggcattcctgttgtgcaaccatcacccctatccatctccaagtgaacttgattcttaaatctcccagccatctgtttcaattcactagatgttgttccacccagcacgtcatggtggaaaggggcaggctgtgattttttttttttttaacctccagcagctgtgttccctgtggcaactatgtaacctctctgagcctcaacatctgtctataaaatggaaacagtgcaacctaccttagcatttgatgatctcaacttggatcccatagcgggtatctccaaaatttcctcatcttgactacgttctggtgaaacttaagatgtcagcacatgacctacctcccttcccttctcattcatctgcattttcacaatgctt

SEQ ID NO: 18555 - DNA, 1052 bp, Homo sapiens
agaataaaacaaaaaccctattcctattcctacaattctggtactttgccacaaggtggtggtagtgtatcttgagtaaggaatatgacctgctagatataagcatctgtttatttacacactaaggaatgtttgagtgtggaacgtggtttagatgctgtgcgtacagcagtgactcagataggtgtgtattctcaagaagctttcattctaatgacacatactttgtctccagtcagagttatggcaggtttttttttttttttttttttgactaaattcacccatatttgatggcaagtgtgatcacagcatgtttataaaaatcattcttaattaaggcatttccatcttatcaagccccctatttaataaggatatcaaaaaagaaaacagttttcgtgcatatgtgtagctttttagattcactttttccttatttgacccatataaactttgtctgtctgtgtctgtcagtctcacacacatccttcaacacatctcttatttctttccagagccaggctaaagcacccttgccatcttctctctctgctgttaaattagatgccttctccaggaatctctctgggggcatcctgagccttcccgattccatttcagatttctttctgtaatcaagagctccatctctgttgctttcctggggctcttcctctcctctttttgaagcttttcatttccctttatattctttcattcgtcaactacaaagaagctgcaggcaggaacaagagagctcagcacacttggtgcagtctctctggcttggtaattggtcccaagaaaatagtttttttccaattatggcaacattgaaaacttatccaggagaggaaaggctctttcagctgctctttctcgatccttgcagtttcccttttgacctgtgggtacacatggtactgacgcaattggcacctcagatggttcttcctgacagctacccttgcaactgactcaggatacaaactacctttttttttggagacagatctcactttatcacccagtctggagtgtaattgacg

SEQ ID NO: 18556 - DNA, 1030 bp, Homo sapiens
gaaaataaattggccccctgaccccttatgaagtgacatcattcatctgaaaggtttatcgccctgcgtgtcattttgaagttccctactctcctcctcgttctctaaatccatgaaaaaatagaaatgggaggaagaactggagagaggggttctgtgtgtgtggaatgtggctctggaaagcccccagccctcctgttaacacaatgcttttatcccgtaatctctgcctgcgggagacaaaataacagttcatctggaaaacaagattaactcatttaacttacgtagtgatcacagagagaagcttgttggagttgtctggctgaaggaaagcccgcgattctcggccattccggttcacagggcctgggtagcgggcccagcctgttgcaagtaatcgggctctgtcagatcagccttggtgagattgggatattaccagggtattctgttcatctctgacacaggccctctcaatctgatagacggtgtgcctcttctcttcattagaacatcttcctgaacacttgcctgtctgcactgccctgctaaggggttttcaggtgagcgtgctgtgggtaccttcacatttcaggccttttaacagggaatgaaaaccaactgccctgtgattccaagtctgctgatgcatgtgaaattggctttgtgttggggcctcttcttccaaagcaacagtaagcattttttttttttttgtgataatctctctctgtcacccacgctggagtgcagtggtgtgatctcagctcactgcaacctccgtcttctgggttcaagtgattctcctgcctgagcctcccgagtaactgggattacaggcacccgccacccgacgcccagctaatttttgtatttttggtagagatggggtttcaccatgttgcccaggatggtcttgaacccctgatctcaggtgttccaccctccttgtcctcccaaagtgttgggattacaggcgtcagccaccgcccccggccgatagttgcctttcttaccagcctgggcc

SEQ ID NO: 18557 - DNA, 1378 bp, Homo sapiens
aggccaaatgaaagaaccttccataaggggacgcagcacagtttgaatataagtgttccctccaattcccatgttagtgctttactatgagtattgaccagtgttaaagagtgagcgcacaggagccttctcaaagcctcctgcacacactctcccactgtaaatgcacgagtattgatcacaattattccgtaaacacatcttacaaattccctcagtgcacgcgccatctaaattaatccaaattcagaacaaagctctcttggaaaaggaaagagcatctctttcaggagcttccctcttggacattaaatcttccataatctgtgctagttcggcaaagaagccccaacgtcctcccaatcatagggcgcctgagctcttggtctcctatatcttatattcattatagatgtcttatatccattcctgtatcctttgtgatgtcttgagtgagaaaatgctctgaccaataagccaatgttcaattgacttcgaaatgttatgtgggataggctcattcagggtggtacggctgtagacaaaatgctatatgcattggctgggcgcggtggctcacacctgtaatcccagcactttgggaggccgaggtgggcagatcatgaggtcaagagatcgaaaccatcctggccaacctggtgaaactctgtctctactaaaaatacaaaaattagctgggcatagtgttgtgtgcctgtaggcctagttacttgggaggctgaggcgggagaatcgcttgaacccaggaggcggaggttgcagtcagccgagattataccactgcactccagcctggtgacagagtgagactccatcttaaaaaaaaaaaaaagtcttatattgattaaaagagacttaagacacatagtaccagatggattgtgtgatgctcattttgatttggatttaggggaacctgctctcaaagacatttttctgagacaaataggaaaatttgaatatggagtagctaatagatagtattaagagagtagccttcattttttaaagtataataatattttaattgagtttatgttagagatgcataccgaaaaatctacaagtgaaatgatatgataactaagacttgctttaaaataatgcggaaaaaactgttagagtaatagcgtaaataattcaagattggaaaatgttcatgttaaattattgttggccgactgtgggttcatttaattaggttctctgttttggggtatgttgaaaatttttcataagaaaatattattcagaggtctcaagaggcaggctgccaagaatagcagttagaaatagctagtatcaggcctggtgtagtggctcatgcctgtaatcccagtgctttgacaggctgagg

SEQ ID NO: 18558 - DNA, 1031 bp, Homo sapiens
gaattatgtgtccccaaaattcatgtgatgaagccctaattcacagtacctcataatgttactctatttggagatacagccttttaaaggatggttaagttaaaatgaggttgcttggatggtccctaattcagtttaatttgggtccttataaaaagaggaaatttggatgcacagagacaccaggaattcatatgcatggaggaaagaccacagtggcaaaagacacattgaggaggtggctgtctgcaagccaaggcaaggggcctccggagaagccaaacctgctgacaccttgaccttgaatgtgcagccttcagaactgtgagaaaatcaatttctgttgtttaagccacctagtctgtcacattttcttatggcaacccctgtagataatacagtcccattctctggggaaacagatacctccgccagggtcctgatctgaatatgatttggggtgatggaacagaaacacccgaggactgtcgttggggaacaggaaacctgtctgtagtcctggctctgtctccaattggctacgagggcttgtgtgtactctagttctctttccgtgacactgcatttggggggaaggtaagggaactggggaaaagaaggcaaaatgatgacttaaagagactgatgaacccaaagctctcttgtgaagccccttctagaataagtccgtctcacgttacagtgcttaggaagtgttagatgtactgtcatttcttcaacatatatgtcctatattagtctattctcacactgctagtgaagacatacctgagatggggtaatttgtaaaagaaagaagtttaacggactcatagttgcacatggctggggaggccacacgatcatggcggaaggcaaaggaggagcaaaggggcgtcttacatggtggcaggcaagagagcctttgcaagggaactgccctttataaaaccatcagatctcgtgagacttattcactgtcacgagaacagcatgggaaagacctgcccccatgattcagttacctccca

SEQ ID NO: 18559 - DNA, 1032 bp, Homo sapiens
ctcccatggttgtctgtgaggacaacagaaagtaatgttttctctgaaaagtttaaaagggtaaatggcttcatcacatggtgatgacagtgattattccaagagatggctgtaagctccctgagaacagaggtgctctgtgtaaatctagtctgtctccccaggcttagtggttgacctagactataccaagagtaagtgtgttttttaaatttaatttaaatcaattcattaagcattgctaaattggaaaaccatggaatatagagatccagtagttaagagcctactgggagagacagcataataattacaataagtgcagaacttgcaataatgtaattgaaataatgtaatacaatcctgcttaatattacactgtatatattcattgacttatagactgagctccttatcttgttcattgctatggctttagcaccttttgaacagtggtgcttggcttttggtaggtggtcaacaaatgtgtattaagtatatgaactgttggaagggtctgctgtgaaggatgtgatttgctctctttgatggtggacaaagaaggtttcctggtggaagagattaatgagttgggttttgatgaatgaataggagtttccccagacacacggaggagacagaatggaatgaaagaggggttttccaagaagaggcactgaagggcaagacttcattgcttctttgatactccaatgccggcttcctttgggttggactctgatggatctaatcgaggattaggatggaggtaggtgggaacatatttagaaggatgccctgtggtttttctccttcctgctatttatatttccctctctgtctttcccacctgtttggtgatgaggaaggagctgtgtactggtttgaaacctattcacgacatagtggacccaacaccaagtgtcttattgtaaatggatccacttttactacagttactttaatggcatctaaatgataaatgttaataagcatttttgcttgggaaagcacaatggtattagcctgcca

SEQ ID NO: 18560 - DNA, 1054 bp, Homo sapiens
aggaaacccaactttgtaaatgtgactttcctttgctactttttgcctattaagcagccatgtatgtaaagtattaaattagcatccaggcactttctttttttctagaaggtggtattttgcatattaatacttgcttaaatcaagaagctaagactttgtattatattttgctttacgtgccttgattaaggtcatgatcctgacattccagtcccaaaggagaccaaggaaatgaccagcacgtggctcactccctgtctgtccagtagaggacaccaaggcacgatgaccgcagctcctgtagtagttatggtcactgactccgggttcagacggacttggggttcagtcctagctctggcgcttaccagttttctcaagtgactttgagcatctttactcaaggctcttggtctcagttttctcatctgtaaaatggagatcgcagtatctaactcatgggtgtgtttaaggattcagtgatggagaaaatagctgaaaagtgaccgtatgaaatgagcagcagttgtcaagtacttggcatagttcctgtcacataggaagcatccagtaagtagtggtatctgttgtgattatgatcatattttatttcatggagttcagtaagagtacaaagcgaggagtttttctgcccctccagtagctgtagaatttgtgtgatgactatgtgagcttatcccctggtaggtataatggaaagactaacaagagtagaagagggatgtaactggagcatgatttaaaggaactgtagtttgtctctgtttttttttttttttttttttttcctctaaataaacaaaggaatagaagatcctgtgaagagctgggtgtggtggctcatggctgtaatctcagcactttaggaggccaaggcaggaggattgcttgagcccagtagttcaagatcagtctgggcaacataatgaaaacctaatgtctacaaaaagtataaaaattagccaggcgcagtggctcacgcctgtagccccacctacttgggaggctgaggcaggaagattgcttgagc

SEQ ID NO: 18561 - DNA, 1126 bp, Homo sapiens
tgcttcttcccaaagtcacctttgctctctcctgaccaccgttggtgtctcaaagtctcacatgtgacaacacacatatcatcaaattcatgagtatccatggcacacaatgttttccttttcttctcttctctttctttcttgttttgttttgttgttttattttgttttgttttactgagataggatctgtctctttcccccaggctacagtgcagttgcgtgatattagctcactgcagcctcaaacttctaggctgaagtgatcctcccacctcaacgtcctgagtagggagggcactacaggcgcatgcctccacatctgactaattactaaatttttaaaaatttttttagacactgagtctcaccgtcttgccctggctggtctcaaactcctgggctcatacaattcccctgcctcagaatcccaaagtgctgggattataggcatgaggcaatgtgcccggcccacaatggttttcatatagctattgtgtattgcgttattgccttagtcacagaagcccataaaaaacagattccaataaagagactaggtttgcagagtgatgagtggggcccttgaaataattacatttagtgggttatatgtctatttttttggtcgttccttgctcatctgtctttatttttgtttatttatttattcatttatttgagatggagtctcactctgtcacccaggctggagtgcagtggtatgatctcggctcactacagcttccacctcccatgttcaagctattttcctgcctcagccttctgagtagctggaattacaagcgcccgccaccatacttcgctaatttttgtatgtatatgtgtatatatatgtatataatatatatattttttagtacagatgcggtttcatcatgttgatcaggctggtctcgaacttctgacctcagaatgatccgcctgcctcagcctcccaaagtgctgggattacaggtgtgagccacaatgcccagccttatatatgtatttattaagtttggggggaacaggtggtgtttggttacatgaataagttctttagtgatgatttctgagattttgatgtacccatcacccgggcagtgtatactgtagccaatat

SEQ ID NO: 18562 - DNA, 1050 bp, Homo sapiens
caacagtgattggatgtcatgtgctttcagaaggcacactacacatcttcggttcctccaagctctaggaaagggttgtggaattgggttgggtgacaacaggtcggtaagaagagggctgggctgagtgtaaagaaattccttggctgggcatggtggctcacgcctgtaatccagcactttgggaggctgaggcagataaatcacctgaggttaggagttcaagaccagcctggctaacacggataaacctcgtctctactgaaaacacaaaaattagcttggcttcctggtgcatgcctgtaatcccagctactgcagaggctgaggcaggagaatcgcttgaacccaggaggcggaggttgcagtgagccgagatcgtaccattgcactccagcctgggcaacagggagagattccatctcaaaaaacaaacaaacaaacaaacaaaaaccccagatattccttattatggaagaagaagcaggaaatatgtttttgaataatctgggtcagagaattgtgcatttattattgctaggatgcatatacacattgaactcagtcaacttactctctctaaattatctcaccggtggagacattgcctcaggagtcgagccctgtggtgtgcctcctgctgtcaccacatttgaccacctaactgaccccactgtggtcacctttgccacctgccctgctttggtcccttctctgcattcgccccatgccatgtagcactgctgagtttgaaaataattgcatctcctgaaaactccatttcttagagagtgagctccagcaccatcagcctgaagttgaagaaatgggactcaggaaggctggagtcttcaggcgttcttacaatgctgatgcgactcagacggctgcctgcactgtcctctgtgcttctaagtgaaattacccgtcggggggctcctgagagttaaatcaagcagcctctcttgaagcacagtaaatgctgacgtgatttgtgaagatggctctgctaatagggttggcagcgtcctttggcttggacctttggac

SEQ ID NO: 18563 - DNA, 1051 bp, Homo sapiens
ccacgatgatccactggggcagtggccagcaaagtccctgtccagccagccactcgtttttatcaataaatttttactgaaacacagtcatgcctgttaggttaggaactgcctagcgccacttcacactgcagtaggagagtgagtagttgtgacagagaccatttatcccacaaagcctagaatctttattataatcctgtaacagaaagcatttactgactccttagcattgccatgtttagcaaataaaattgcaggatgctggtcaggcgcggtggctcacgcctgtaatcccagcattttgggaggccaaggtgggcagattacttgaggtcaggagatcgagatcagccgggccaacctggtgagatcccatctctactaataatacaaaaaatagctggcgtggtggcgcatgtctgtaattacagttactcgggaggctgaggcaggagaatcacttgaacctgggaggcagaggttgaagtgacccaagatcaccactgcaccccagcctgggcgacagagtgagactgtgtctcaaaaacaaaatatctggctgggcacagtggctcatgcctgtaatcccagcactttgggaggctgaggtgggtggatcacttgaggtcaggagttcaagaccaggctggccaacatggcaaaaccctgtctatactaaaaatacagaaatcagtggggcatggggcgggtgctctgtagtctcagctactcaggaggctgaggcaggagaattgcttgaatccaggagacggaggttgcagtgagttgagactgtgccactacactccagcctgggcggcagagtgagacgctgtctcaaataaatacatacatacaacataaagtaagatgttaaagtaaattttaattttagataaacaatggataattttttagcaaaaggatgttccacatttaactggacattatctctgtctctctccctccttacctgcctcctatcctctcttcccaccccctacgatgtctatgtatagtttcaacctggcaaccctgtgacctcagc

SEQ ID NO: 18564 - DNA, 1050 bp, Homo sapiens
actaggtgccctagaaatgttctttcctctgactcaaatgacaaatcagtttctagggaaaggaacgcacagcgatccccagcgcatcacgagaaatctctctccagctttgccctggctgcgctggtgactcactcggggctaaaactgtttatgtctgcggagtcagagcgttctgccctgcggtttcagttcacatggggttgggcgacacagttttgttttcactttggtttatcgtgtgagtttccatccatcaactcttttgtatctgatgttcttgggaaactttgcgggaattcacttgaaattgtccagtgaacagccattgcgagtctcatggtcagagccgggggcttcccagtgtagggtctggtcaaggaaagggccacttcctgggcctcccaaaaagaggaaggagaaggccctggcttgtggaagagtaagaggggcctcgttaatgtctcccaagcacagtaccccaactccccacatacagtcccaacccttactgcagccgggaggttaggtgtctgccgtgctcatgaacaggaagtgaacccgatcagcccccgaaggaaacatccgtctctctccttggaggagacacttgagtgtctttctctgtgtgctgcagccgttattgatatcagttcccaggcaaggttcatgctggcagaggaggccactctttctgcactggagagcaaaagccatcttatctctctgagtgcaaggtgacagtgaggagattggccctgtgtatccctcagagaccagtattccctcatttgccaatctagaaagaagactgtgtttgctgtcatttgtttcttaactcattgattctcaaacagaatcttcccagggatctgcttcatgctgtattttgtactgtgtcctgagatgatgaggattcggtgtctaccctcaagaagcatcatttagagaagaaattagaaaagtaagtgaggcaggagaacaggatctggaggcagggaatctaaggctgattcacgttgactttgtataattaaatcaaaaggaaaa

SEQ ID NO: 18565 - DNA, 1048 bp, Homo sapiens
tttgtccaaggacatcgttttgatatgatgaaccatgggtggtttgggcatttgtcaaagcagggtcagcagaaagctgacgtagttgggtctaaagtacaacaggactgagcatggtggctcacacctgtaattctagtgcattgggaggccaaggcaggaggattgcttgaggccaggtgttcaagaccagccttggcaatatagcaagacattgcctgtacaaaaaatttaaaaattagctgggaatgatggtgcatgcctgtagtctcagctacttgggaggctgaggcaggaggatcaactgagcccaggagtttaaggctgcagtgagccatgatcatgccactacactccagtacactccaggactttaggcctgctaaagtgcattgtagtaatactagatatcagcacccttgccatggcctcatgagcagtgaaatgaactttcttgctcctggatttttggctcttggccttgtaatttttttttttcatgggatattagtcaacatgatgtgagcagagtcttgagatgtgcttgcatgattggctttgtactcctgcatttttcccatagccaatgccttttcttcagcttgggctgcagaatgagatagatgaaacagacctgaatctgacttataccctggagccattttcagcaaacccagtcaatatcaggccaacctcaaccaattcttagactagtgagtgaggaaaataaatatttgatcttgtgaacccttgaaattttgaggttgtttgttatgcggcagtattttggcagtagctgatgaatacaccactccccatccctagtggcttcctataccatttagaataaaaatacacgctcttttccagggtctacatgtcctgaagacctgaactcctgcctgcctctcagtttatttcctacctcaagtagctgtgcccaatgtcctcccaatatcctgcaaccactctagtcttctttcttttcctgggacccacagagcctatatctgcttcaaggcttttgtacatgttgtttcttttgcct

SEQ ID NO: 18566 - DNA, 1068 bp, Homo sapiens
gttcctgtcttcatgcccatgtgtacgcagtgttgagcttcgacttgtaagtaagaacatgcggtatttggttttctgtttctgcatttattcgctcaggataatggcttcaagctgtatccacgttgctgcaaagaacatgattttcttcttttttatggctgtgtagtatttcgtggtgtatacgtaccacattttctttaactaatccaccattgatgggcacttaggatgattccatgtctttgctgttgtgggtagtgctgccaagaacgtgagtgcaggtgtctttttagtagagtgatttattttcctttgaatgtatacccactaataagattgctaggtcaaatggtaattctatttttagacctttgagaaatctccaatttatttttcatagggacaaggttgcagagaaaagagaagagtgctgtttcaaacagttgaaaccattcctacttccaaaaagaatttgactcaaaagggaatagtacactacatataaaagacagatgtatttaatttgtgtttcgaactacatatcagaaattagttagaagaagatatgagataaatatacctggaaactttatgaattatttctgacatctagcattaaatttagctgggtttcctgggagtcaaaagcaaagagttttcaaccaaaaaaaagaaacagaggtgtatagtaacacacctctgtcctgcaacataactgtaagaatttatcagattatatatatatatatttatcagattatatatatatttatcagattttatatatatatatatatatatatatatgcatatgtttgtatataaatatacatgtaaagacccaaaactcatataaaaagacaaggtgatacagcattttaaaacagtttactaaaaataacaaaacattcttccatcagtcatgcatgccttatatttatgtagatacaaaaatagagtttgatattaaacaatactccaagaaagccatttctgcagagttaaaaaatacgtaggttcagttccttaccaacacgtagacatgttgtgatgaaagaaggaaag

SEQ ID NO: 18567 - DNA, 1049 bp, Homo sapiens
agctaaattttacaggtagttggggtttcaccatttaacccagttaactcttctataagtgccgtattaaagcaggtggtgtattttgaaagacgtatgtaaaaacatttgtatttatttatatgaatgaatacattttatttatttatataaatacattatatttattcacataaacacattttatttatataaataaatccatttttatttatttatataagtaaataaattttcctataaataatctttctgattgacagatagcgaccttcctgctatgtccttacatgacagaggaagagatcatctttcttcagcctcttctgacaagtccaccagtctcattcatgagggttccactctcatgactgaagtacctcctaaaggctccccctcctaataatatcaccttggagattagggtttccaaatatgagtttggggggacacattgattccacaacactgaccttctatcagatcagccaggatgctctttttcaaacttctgtcaatctttccccaccttcacaatgtgcccctattattattaatatttaaaatattgaagatctaattaatgttgaaatttttctttaaatcaattcatagattcattaactttgttttaaaaggaaatgttctatttccatcgtaaagggaagatcaatatgatttgccacatatagatgaagataaacctatatacaaagaaaatagaactatagtaattccatgtagctattattaccagagaatactctaagcccaatgcttgtgttctctttgggcaaatggaagatgagccacttgtagagaggtattaaaaaccaaagcaagatcttttgcaagtagattaattgggcaagacaaagggaataataactatgtcaccaaaattatttaatgcagggtccaggagccaccttaatcatccataaattggttaggcatgtttattaccacagattggaagcaggcttcccccaagtgtgtttccctttgtaatgccagtgtcgtaacgccactatctatacttttcaaca

SEQ ID NO: 18568 - DNA, 1043 bp, Homo sapiens
attacacggagaagtgttagaacagggtaatcaactgggaacccatttcaggtgaatgccaagatgttttgaaggtgggcatggcagggaaataacaggatgccatgcttggtgagaaatgaattcgtaagtgtgcactgtctgccataaagagccaggcaaggcacagaaaatattcttctgtttctttttctattctaccctctctctgctttttcttctctcactgctgctgaagcagtgagagcctgttgagttaaaataagccagtgaggattttggtggtgtttgcccttgaagcctcttgacatacagtgtcatcaaggagcagtgggtgagcctgcccatatctcgggcacaaacctaggtactcattgaatcctttaaactaaccctctaaagaattctcaatctgtggatgagaaatggcaacacagggatgttaaactgcatgcctacaatcatccatttggaagaagcagggctggaatttgaacatgagactgtatgctccctgttgtagtttcctatggctgctgtaaaaagttagcacaaatgcagaggcttaagacagcacaaatgtcttatcttacagttctgaaggtttcgctccagagtgagttttatggagtgaaaatcaaaatgttggcaggccttaggggagagtccattcctttcatcttccagtctctagaggctgctggcatttttcagctcacggccacagcactctaatctctgctttcactatcccttcttttttctgtgactctgaccttcttgcttccctcttacaatgacccttttaattgcattaggcccaccaggctcatccaggatgtatttgtctgtgttcacactagtgataaagacatacccaaaactgggtaatttatcaacaaaaagagatttgatggactcacagttccatgtggctagggtgggtgcacagtcatggcggaaggcaaaaggcacatctcacacggcagcagacgagagagagtgacagccaggtgaaggagtttcccgttataaaaacatta

SEQ ID NO: 18569 - DNA, 1034 bp, Homo sapiens
atacctcaattccttttgcctgcctggctcctctcctctcttctgcctgttcattgaactgaaagattatcaggactgtattcagcccggccaataatatcacaaaacaaaaatatcttgtgggtttgaaatttatgagtgttttgactgttcacagcaatgcctttgagaatcacagtgtgtcatcccctccccacccccacgaacatgtagtttttgggcaacttttcgatgagtaaaacagggcctgacttttaccccaaagtgatgttcttttgtggcttgtctactccaagaactgagatacccagactcatttctcatctcttgttgaaacagagaagtcactgtagcgccctccggggggtggggtatcaagggagagtatgggctttgaaactgctcatcccgtctacaaccttggagggcatggtgtttcactcccccacctctccccacaacttcaccctgctccaatgaggatgaaaatgtctttcttatagatgggacaggagccttagtaatatggtgcgagcaatggttcacataggggacaggtgttcattcaatggtgggtattattataataatcattagcatcattgctagtgactttatttttcctttagccaatggagcagtggcttttggcccactactttcgactgaatctatgagtgaatgtgatcctccgttttaaccctgtcttattggatgttggtaaacagtatatcatgagcccctgtaagagcttgaatccttcaaagacaaggtcagtcagtggccatcactactctaaacgtaagaccctgtgatgactgacacttactaggtttctcatttatttatttttctctgcaggacacagctatgtgttccaaagatggtcttaaacctataggagtataacaccatggctagttcagaaaaccttattccaacttccaaacttagaagatactgggaagtaaaagggagagaagggaatgcatggcttgggctaaaaaaatgattctgcattcatctcagaagga

SEQ ID NO: 18570 - DNA, 1091 bp, Homo sapiens
agacaccgtgcctgctgctaagaggcccctggtcctactgagtggtcagctgtttacactgacagtcccagcgtggtataataagcattaacacagagacatgtacagggtgctgagaaagctaatttttgcaatagtcaaaaaagacctcagggcagactccccagcacagagttccaagcctttacctaaaaaggtaatcattttataagtacctattatgtgccagatactaggataggcactttgcatagaaactcacatttcgactgggcctggtggctcacgcctgtaatcccagcactttgggaggccggggcaggcagatcatgaggtcaagagatcaagagcatcccggccagcatggtgaaaccctgtctgtacaaaaaatataaaaatgagctgggtgtggtggcacatacctgtagttccaactgctcagaatgctaaggtaggagaatcgcttgaacccaggaggtggaagttgtagtgagccaagatcgcatcactgcactccagcctgggtgacagagtgagactccatctgaaaaaaaaaaaaaaaaaaaagacatttacattttatctttactgtagctatggctgcctatcccaaggatgggaagtctgaagttcaaactggtgatgatccccaccccaagtcacacagttagctttatagttaaatcagggtgtgcctgatttcctagccataccaggcagcctatttcttgaataacctcccatcccctgtgtctcctttgtggagctcttggcaatactctggtgattggtaaccactgatacgccgccagcagtccacgcttgggtggaaggcaggtttcacgtaactgatttaccacttggtaaaggaacgaggtgacagcaagaccacaaactaataaatatgccggtattgacataatgtcggacctcagtatgattgatgcatgtgttgttgactgggatgtcacatgttcaggctgtaatcctggtctcagtatgactgtgaggacggggccaagtcatttcacaatttgggtgagtgttccaagcttctcagaagagcgacgcaatagaaattcaaggtatga

SEQ ID NO: 18571 - DNA, 1090 bp, Homo sapiens
ctcacaacctatgaccacatacgaggaagcgaggtgtcccttttgcagttgttcagaaggtcccgtgggcaggagcagccagaggaacatgaaaccagctcgtaggtggtacttgtggcaacagcagttatagccaaggagaagttaaattctaaagacttgggcagtctccagggaatatactaactgagaaataacatccataaaaataattcaatactagtatgtaaaactaaaaacaataaccaagtgtgactggctgtctaagaattaagcaaagtaagatgaagtgtcttttgctagcaggcgctctcagcaaaggagataaggctgcagtaattctcttcccaccttcgatgggcaggtgcaacctttggctgcagaaattctcacttcccagcagcagctttgagcaccctgctctgaatgtttcttgggcagcagcagctagggaagaaactcagttaaggctgtttgaggacccaaggtggtctcactctgcaacacacatcggcagccagtggtgtgctggtaaatgattaacaactggctctctgaaaaacaaacaaacacattgtgcacctatacatgtacacacacagcttattatttattatttctctgaaatatgggtagcatataatttacaaataagaagaagaatagtatacacagtactgtttcttataaattcgagatagtcagtttttaccaaatgcttctgatttttgctgcgctattatatccattacaaaaccattgttgcagtataaaattgcagtatgtagctgtgacatgaatattggttgatattttcatttttattaagaagtaaggcaaaaacaaaataagacatatgtcagaacttcacttatccttctttgctgaattggataatggttttaaaataccaaaaaatatttcttcaatttttttctgctactcataatgtagcatctgtagagcgacacacttttgaatttgagttaatatttcttttttattttattttattttttgagatggagtctcattctgtcgcccaggctggagtgcagtggcgcgatctctgctcaccgcaacctccgcc

SEQ ID NO: 18572 - DNA, 1041 bp, Homo sapiens
tctgtgggtagtctttttattcttttgatatcatctcgtgatgcacaaaagttttaacaacaaaagtttgggtgttgtatctaagaatccattgtcaaatccaaggtcatgaacgtttacctctgtggtgtcacccctcctctcgcatttggtgagaggagtcttctgtgttgattgtcatggtggtgtgagagcagaagggaaacatggtttcagaaaagagtttttccctgaaaccacccctctattttcttctcagacttttatagttttagcacttatgttaagacttttgatccattttacgtcaatttttctatatagtttaaggtaggcattcaactttgttcttttgaatgtgaatatccatttgtcccagaagcattgattaaaaaagataattctttctctattaaatggtctttgcacccttatcagagatcaattggccataaatgtaagtatttctttctggactctgaattatatcccattgatctgtatgcctgtccttatgccattgccacattgttttggttactgtactctgtgtaagttttgaaatttggaattgtgaattctccaactttgttcttcattttcaagattgttttgggtattctgggtcccttgtatttccatttgaattttaagatcaatataatttaaattttaatcatggcagtgttcaataactggcttgcatattttttgaacagtcatcagctcttgtgagccacggttggccagctcccaaacaccatgacatacaacttgcaggaaaagctcattttccagtttttccccctccagctgtaggggatatattttcgttaattcctgtgaccatatggcagcatggttaggatcttgggcttccaaatcagacagttgtaaacttaaactccaattctgccacttattgtgtcactttggacaagttacttcacctctccaagcctcagtttccctgactataaaatgctaacaatagttgttctttccttattggacactcaagaggattaaatattattcatg

SEQ ID NO: 18573 - DNA, 1046 bp, Homo sapiens
acaacaacaaacaaacaagaaacaaaaaatacatagaagaggccttctcttcacaagtttttcttattgttttttgtttttttaagggaggaaatttctttcagaagtcagtactggacattcccttatttcaccttgagctacacatcccatagtcagcttagccctgtccctggtgcgggggagcaggacggttgcctgtatcccttagtcattgccgcaggcttgctgcatcacaaaccaccattagacctcagtggcccgcagcaataaacattcgattctcgccatctctgggtttgaggtgaccttggctaagctcccctgcattgctctgctcatctttctcacgagtctggcaatggggctgggaatgggctgatctaggctggacttggctggagtaacccagccccaccttggatctctctcctctacttcccacatgtatccttttcatggttaaaggtagaaacagaaaaaaacaggcagaaacataaaaagctcggagatggcttcctattgcttcttcattctgggccagagcaaatcatatggtcgtactccagggtgaggaagtatgtcccacttacagactgaaaaggtgctgcaagtctgcacggcagagggcatggataaggggttcgtaaaaacttagggccatttaatacaaatttgtcacatcacactggcttggattgattttgattcattgctctgtcgcccaaacagaattataattattttagtaaggaaagaggaaggatacctttggggcagacaatggatagagcttactatacaagtctatagaggcatctcacctgtagaaatcttaagatgagggttagccaaagcaaagagtggttcagggtgggaaagccaaggaaggccaggatcctcaccaagattgccagcagggagctctgattgtccacagctctgctctctgctcaccccggggatttagcagtaacagaatccacactagaaggacagagtgctgtacagacagaaggaaagacgcagacccaaaccttgataac

SEQ ID NO: 18574 - DNA, 1044 bp, Homo sapiens
tttcatcttatctatatatctgtatctatatctaatctattttttgagaaaggctctcactctgttgctcaggctggagtgaagtgatgcaatctcaggtcactgcaactgctgtctcatgggatcaagtgatcttcacacctcagcctcccaagtaactgggaccacaatgcccagctaatttttatatttttttgtagagacggtgttttgccatgttgcactggctggtctggaactcctgggctcaggagatctgcctgcctcagcctcccagagtgctgggattccaggcgtgagtcaccatgccaggcccctgcctctgtttaaatgctcaaacttggtatggaactgcacagactatacggctgctctccactcaagaatacaaattgaacattgactttcctcattttttatccagttttgctttccagagacccagatatggcttcattttttaaatgaaattttgcaggtcattagctcataatgattaaatgattctggttattagcataaaacacagctgtagtacataagaggtaacctttattgtttaaatattattcaatgtgcctacatagcacacagcaaaaaaaactttttttcagactattcagccattatggaaataacttataattacattcagaaatgttgcaaatgcaactcatccttgcagtgggataaacattgcctagaagggtttgaagaggaatccaggttagaaacaatgaaaatttttggctgggcaaggtggctcacgtctgtaatcccagcacgttgggaggccgaggcaggagaatcatttgagggcaggagttcaagacctcctcatctctacaaaaaataaaatatttgaaaaaaaaaagtgaaatttttgatatagaagaggatgtagggcaggtagggctcagaaagacccatgccatatagcaaagttcttagtaacacaggctttgggttacagcaggctagattcaaatcctgctgtggtcagaatgtctgtgtcaccccagcattcatttgttaggagatggg

SEQ ID NO: 18575 - DNA, 1019 bp, Homo sapiens
aagctatgggatgtacagcagagtataacaatgataaatgatgttgtgtgtaatttttctactattaacataaagtaatataaactgaaggacactggtctattgagagacttagaagctaatgttccatatcagatgcggccaatgtcaggactgaatacagattaggcagtgtccttttctccccaggggaattaaagtttgagacaccacttgctgccagtggttttatggcattttgttggggccggtggtgcctttcttggtctattaattcaggagccgtaaacaacaatgtgagcaaaatgcttttccggtgggatgcatttcatttatatgtgcttgtatcgtctataccttgtcaatccattttgtcacaataagtgtttttaaattgtgtagattacctccacttcattatggttcctggcatttgtgtcttatgcaaggctattatgtgaagttaggaaatatttaaaactctgcctttctaaagaaacagggacacggtgcagaaaagttcatctggagttaggcttgtgtcttgccgtctctttaacggagagttcatgggcagggtacagtctgtgagaaggaatgaaaaccccagggtagatgctaacaaaaatcacttttaaaaaatgtatggtgtccatctgggttagcaaacacatgctcacacgtctgtgcttgctggatttttaagaacttaccagcatttaaggttttcttatgaaactgattttactcaccagggatagagtctcaaagttggaggtattttatgttgttttaaataatatcgtcatcacatgtcattttagaccccaaaagtccactccgaatctctgcgtatggaattgaggaggggtgaggctgtcagaagccgagggacttggccaaggtcacatggctttggacggccccctgaaccttggagctcatgttctgtggcactttgcatactgacctttctgctcttttatgctgcctgctctctaatattgtccaaaaacctt

SEQ ID NO: 18576 - DNA, 1086 bp, Homo sapiens
tggagtgcagtggtgcaatcttggctcactgcagcctccacctctgcctcccaggttcaagtgatactcatctcaagtggtttctacctcattaaaacaaacaaacaaacaccactcaccatttttgtggtgggcatggtggctcatgcctgtaatcccagctctttgggaggccaacgcaggtagatcccctgaggttgggagtttgagaccaccctggccaacatggtgaaatcccatctctactaaaaatacaaaaattagctgggtgtggtggcatgtgctataatcccagctactcaggaggctgaggcaggaaggtcacttgaacccaggaggtagaggttgcagtaagctgatatcatgtcaccgcactccaacctgggtgacaaggctagaccctatctcaaaaataaagaaacccttgctattttagcttccgatgaggatatttatccttctagcatttgaatgcagccaaagtccttactgggcaaatttttgagctctcaccccacattaacaatttctctccttaactttgtttctgaatgaagttatccacagagttttaaagtgagtggtgagttgtggatacctcttccgagcaggtgcacccccatcctgccattgtccctctccttagtgtatatggattgatgacatttcagtttcagacaaagggacatttcattttttttaggagattaaagctgtgtaagatatacaatttaaactgaatgttgatattttatagattgttgagtccgattgtcctgatctaaaattaactggttttgtgatttggtgtaaatcgcttaacctctttcaatgttttttcagcaaaatggggtaagaacagaatctgccttgcagagaattaaccgagatgatgtgtggaaagggcctatcccagaggctggtgtaccatggtggcttctcctggctctgctggttattattattagcattattgtcattgtgaaagtgacaaggaatgtgcctgtgcgtgaatctcactcttagatcagacgtgcttttgaaatatccagatatatacaacacaaagagcgaagtttgttttat

SEQ ID NO: 18577 - DNA, 2133 bp, Homo sapiens
tagattgtgaaatgtttaaggaggcaaagaatatttaaccaagaaaggaaaagtgtatttgagagagacctgatgagttcaccactgcctctggagaatcaaatccaaaacagcatatatatgtatattttttagagacggagtctcaccctgtcgcccaggctcgagtgcagtggcgccatctcaggatctcggctcactgcaagctccgcctcccgggttcatgccattctcctgtctcagcctccggagtagctgggactacaggcacccgccacctcgcctggctaatttttttttttgtattgtttgtatttttcatatttttcgtagagtcagggtttcacagtgttatgcaggatggtctcgatttcctgacatcgtgatccgcccgcctcagcctcccaaagtgctgggattacaggcgtgagctgacgctcccggcctacagcatagatttgaggcatcttgaaggtagatgcagaagagtgggatctactttggatttttagattaatcactgttaagacttaaacagcttcttatttgggtgaaacatgggagtgtcaaaaataagtcactgtcactctttgccaacttcctttaactctttatacggctatatctccatagatatccagtttttgttttgtttttgtttctgttttcagttcctctccaaactgtcaaggacagtgccaagatctgcgaatatagaaagattaagagtttttttctgccttgttgggtcttctttctagcatgccaggaacatttttctcatcttttgaacattagggaataacacccaatgccaccctataatctcgagacagaagtggaggatcctcttaagacaagaaatctttcaaagccaaataatgaattaatccaaagccacttgaggctctagatagatcttagcagtcaaagcaataaatatataatcccataaatctaaactttgtggtatattcattaggctgtctgttttcttttctttcaaatgtttcacttaattccctgatataataaggcttccaaattcttggtgtttttctacaaccaagaccttgaactttttcctctcaggatttctttcatgagaacccattttctggccatttggatatcattgatgagggaattgaagcatttccctattctttagagtttcattaaagtttgactatattccagtaacaattgttgcataacaaaccacccccaaatttagtggcttaaaacaacaacatttattttgttcaggaatctgtagtttcagcagggctctgaggaacagcttgtctctgctccagcatcagctgaagcagcttgaaagccagggtctgagatcatctgaaggttgttcactcatgagtctgaggattgatgctgactggtgggtgggacccttgctggagggtctattggctggaacacctacacattgtctccatgtaccctgagcttcctcacaatatggcggctgggttccaagggtgagcgtcccaagagaaagaaccaagcagatgctgcattgccttttatggccttccatagaagttacatagccctaggttttcctgcattctattttttaggctgtcagacccaccccaaccaggtttgcagtgagaggaaatagaccccacctcttctggaagagaatgtgggactggacatactgccatggccacttttgaaagatgcagtctgccacataagcaaacagttcgtgtcctgcagtgggatattgggaaaagaatggtatttggcaaggggtcaggaaacctgcttttgaatcctacctctgcctcttactagccacatgactgggtcttagcatgctcatctatgaaatgggggacactaatgctgaccccacatttgtgctgaggattatgcaaataaaatctgtaatttgtgcaagcatccaccaagtgcctggtgcagactggatgctcaataagtctttggtgggtccatgtattgaattggaatctgcacattatggccattatttaggtttcttgtgtcctaatctatgtcactgagtacatccttgctgtttttcatgaattttccactgagtcgcaacatgccactggccagtgaaggtcaggcaggaaa

SEQ ID NO: 18578 - DNA, 1002 bp, Homo sapiens
tttacctcccattatttcttccgctgaacaggacgtttggttctaattgttaagcctgcctaatgctgattgaagcgggccatagtatcaagggtggaagaaggtgggaatataaactagatttgctcccttctgtaggaataactctatgaagactttctttttggagacaaatcatcttatgcaggggggaaaaaaaactccctaaaaaagacaaatgacagcgcaagatccaaaaagacaagtgctcagtcattttgtcataatgccagaagagacagtaatgctgtgtggactatgcattcagacatttagaaaatactgcaggcagagctggggattccgtggccagaagcatatttggtgaaccgaggacgcatcaaagagcttctctggtgtttagtaacttgcactgtatttcagaggtttataaagggaagggacaggaaagcagtgtgccagtaagacaactcctcttctcgtctggattttagaggaatgcagtgaacaaatgatgaaaaagtctgaagggactttggtaattcagtatccgaaaaacaatcagtgttttgtgacattcttagttgtgatctaccttatgttgtatacacatggtcactcacatacataggtgtattattctgcaattgctgagtaattgatgatccttcattctctctgtgattcataggctctctgggttggataaatcacttcggggaattatatctactagtatatttatgtcactagaattcctttgagaagctatcactgtgtacatttactgtatctattaactttcttcatctccctcttcctccctttcttcctttcctttccctttcctttctcctctcctgtcctttctctctccctccctctttcttttctttctttttcctttttctctctctctttccccctttttgtatttctaggagaaacggggtttcaccatgttggccaggctggtctcaagctcctgacctcaggtgatcc

SEQ ID NO: 18579 - DNA, 1224 bp, Homo sapiens
tttttaatggccttgaaatttttgaagagttccggtcagttattttgtagaatgcccgtaatttgggtttgtctgatgtgttctcttgattagaatgacgtggtgcatttttgggaggaatatacataagtgatgtgccattcttcggccatcaagtcagaggatgtgtaatgtgaaaatatcttattactagtgatgttagccttgacctctcggttaacgtggtatctgccagatttctccactgtaaaggatcatttttttcctttgtaattaataaatatattgggggaggtactttgggactacttctcaaattttcatccattaattttagcatccctctggggatcttgcctgcaatgattaatactgtggtattctcatgactgatattgtctttctgtcatgccttctattttttggtgggaattcttctacatggaaggctgtttcttcttctccatttatattggtatggatacgtgaatatttagtttattctgtaggtcataatacgacagtattgtgatatattttggtgctcaaattgttccggctttggcccataggaggtctttcgggcaggttcctgcacccttttgacatgccccgttcttttttgagcactttcttattttttggcactgtaagaggctttacactgtcatcttggacttccctgcctcagtcttggaattaactcattctccatggaggcttggttcgttttattatagaatcatatttagaactaagatctaggtgctagttgcgctcattactgctggagtgtcattgcttctagaacttctcaacagagtttagaaatatgtgtattatacaaacccatgcacatacacctatctccatttattcctgtatctctgtgtatattataattttagtatatttatatttctttctggacacattccattatttgttcatatatttataacatatcagtatctattataaattatatatatgtacactttaatgtgtgtttgtacctaattccaatccaacacaacaactgggttttttcaaacttgtttctttgtttttttctttttgtggagagcagggtcttgctatgttgcccagctcagtctcaaagtcctgggctcaagcgattctcccgcctcagcttccctaagtgttgggattacagacttgagccactgcatctagccacaactgagttcattattctgagct

SEQ ID NO: 18580 - DNA, 1085 bp, Homo sapiens
cttttgtttgaagacaaatgcagtgagtttaatcacaggtgatctgaaaggcaccacctatcttttgctatgttcactttgcagaaactttggcgaaactggctgaatgaagatcgattccaatttgtaaatgtggcagacaataaaatttccccaagcactttgatgatgtttgtgttaatacttcctgctcagagctgtagcccatcagattctagagctaaccgaagagggaagacaacctgtcttctcccagtttccagcctgtatagacttaatcattttcaaggtttaaggttgtttttgtttattggttggggtggagagagacgcaccacctctcctaacttctgtgtttgcttccctcatgctgtgtggatcagaaaagatagcctgttcattcatcacttatttcctgacttccaccttgggtctgtcagattctgtgtgaagcccaggggatccagggaaaattgaggcccagtccttactctcatgtaactcgaagtcttttacagaagacagacttgggaacaaatcaatcaaaatgagttttgtacggaaaaagtcggtgcacgcacaaggtacccaagaaggaggtgactaactttatctaactttacttgcagggcaaggcaaataattagggaaagtttccttcagacaggggaagacaaatatgagtatccagggaggatgtttctggcagagggatcagcataggaaaggagttcagggttgaaaagagtcagtctggtccctagaaataatttttttggtgcataaagggccagaacagaatgacagaggaaaatgataaggatttaggcagggactgcgttggaaagggccttgcaacaggcctggacgttgtttgtaggcaagtaggggcaccgaaagctttaaagcagggagtaacaggcttgtagtgacttttatcgaagtagaagttgaatagatctagcctggcacagtggctcacgcctgtaatcgcagcactttggttggctgaggcgggtggatagcttgaggtcaagagttcgagaccagcctggccaacatcacaaaacctcatttctgctaaa

SEQ ID NO: 18581 - DNA, 1050 bp, Homo sapiens
aagtcttgctcgcagatagcctcttagcagagccaaaagccagcagagagaagactcagcatttgctttggagtaagtttgtgtgtgtatgtttatctcccttttactcatgggctcttttttcccaaataactgaggggccagcacatttggagaacatgggatttatcattgacgtcagtgccttgggagtctatgtttatgtgagcttaaaggttttggaagctgaatgacacagatcaaagtctctccactgatctgtcttccagtcctccaggggacttcttccatcaactacaaatcattgatcaaagtattggtctgtcacctgtccatgtgtaaggccaggcctaagtgctctgacagggcatgactcaatcctcaaacaggaagggggaaattgctttccgtctcctaaccctaagatcctggatggcaggtaatctgcttcctcaagattctgttgatacacattcaggactctggtttctgttttgcttgatgacaatgacccagtttctttgactaaataaatgtatagacacacattacttcttttcattctaagaatcataagtttttcaaactttagaatcacaaggtccattaaaggacatctcccctgaccttcccattttgtagatgggaagactaaggtccaagcttgaatgacctgccatcatggggataaccggaattgatacaatgtcttgattcaagattcagagctcattttttctgtgtcagattaaaaaaaaaacaaaaaacccttactgatcttttaaatatgtaattcttcctcctcttctccccttgtctctcttctcacccctaccaatgtaatcagttctttttttcttttttggagacggaatctcactctgttgcccaggctggagtgcggtggtgcgatcttgcctcacggcaacctctgcctcctgggttcaagcaattctcctgcctcagtctcccaagtagctgggattacaggtgcatgccaccatgcccagctaaatttttgtattttagtagagacgggttttcaccgtg

SEQ ID NO: 18582 - DNA, 1045 bp, Homo sapiens
gaactgaaatcccaggtacctgcccagaggcagctcccttggcccttgggtccctgttgttccaggtgttactcctattctttttgtagttgtctagggatttagtttctcacatcctgaggtccactaggtgctattagctggtgctaactgacagctctaggcagaaagcctttctcaggatcccagcttccctgtcttccagaactcaaagacggcttttgtttgttagttttgaggatggagacagctgtcattctaatgaggacttaaatgtgtccctgctgaccgagccagaacttatttttatgttgccactaggagtcttctgagatgctcttgtggctggatgtagaatccctttgctcatctctagacacagactagacaacgaaatacattcccctaaaatagcccagggttagttctatgacctttgtcactgttggtacagttctaagaggatattgattttttttttctttttaattcatagtctcaactatgtctcaagactgcccagcagtatttctgtttactcgatctaatttctcttccattcctcacagtggcaatttcaagcttctcctttttccccaagccccataatctccccctgatgcccttagaaagcttccctggtcagtcctcctcaccacctccagctccccctagaaactgaccatttatcccatcccggctgacttcttcccttttacaagaagatgtctctctttgaattcaactcagaggtcagcttcactgcctgccctgtggagtcgactctgtgtcccacccttcaggaatacggcttaataataagatgataaggattcgtaccagggattggcaaatgacagtcattttctgtttccttaagtaaaattttattaaaatacagctccactcattcatttatatattgttcatatctaattattttcacactgcaatggtgcatagtcaaatgctttctatctggctttttaagaagatctttgtccctcccccaccccccgccccgatttatactatggatcagcag

SEQ ID NO: 18583 - DNA, 1015 bp, Homo sapiens
gaggatataaaaggaagcatacagtgggcctcattctgacaaatttttagtaaatcacaggttgcctttcctaaatccctcaatatgatggctagtctgtttcatagtgaataaaaagtgatcctggatgaatgaataaagtgaaattcagataatttttctcaaaactgaaattgtttaaatcttcctttagttctcttttttctgcctgccccttctttcatataccctgtttttcacctcttttgtctcagtcccatctgatatttgaataacaatatgtaatttcaggtttaggattgttgatctgtaaatctcagcctagtgctttcaactcctggctttctcctaagttcaccctcctcccttccctcctttctgtaaggactctaaacgattgcgcttcattaagttatttttataatgagttcctgttaccagggaatacagagttaaaaaggtgatctcactaaaagtaattagcataagacctgctggacctgtagaagtgactggatggtaatcaatagcaatatgattacacccatgcagcaattataaattatttaaaacactacccctaggttactgactagttgcctttaaattaaattctctgtcgataattgatgcaaagaattaatgtgagaacaccttcagttactgcaactttttcaaggtggcataaaatattgaactattgcccgtcattagcagctaagctgtctgtttgctctaacatccttcttttctaaattggtcaagaaagagtctcagatcttgaaagatgacaaatgatttcgaatccactgctgggtattcttctaagagcactgaaatgtcccagtgagaaatttcatatatgaaggcaaaggaaaaaaaaattaaactttaaataatgaccagttatacttcatcaactctaacaaatgaaggagcagagttggttttccggagtttgcttcagttctttgatatggtcagtgtaggtcggggaggtcttccctagcttgag

SEQ ID NO: 18584 - DNA, 1636 bp, Homo sapiens
tgcagccttgacctcctgggctcaagcaatcctcccacctcagcctcctgaatagctggagctacaggcaagtgtactgtggcaattgttaatgttcacttttatttccatagttagccttgatcgtttagttttaaagagttatacaacacatacacacacatctaattgttgtgttattgggttaatgggaatattttagactcaagcctggttctttgcttctctccagcacagcaaaggatacacctccaagtataatattgaacttcaaagttagtaatgttcagtgatgcttaagcatgtagatcataaagtcctagactattttttgtctaaattattgtttgtagtcagcctctctactggttggaaacacaggcttgagtttggctttctgctctacctagttcattgctgcagctgtaatccagcctgattctaattttcaactggagatggttgtcttcttttttattccatgaaacaaattgattaatgtgtcgagggagcaaggtggtacttatacctacccagcctgcttgtgtgtgtctcaaggtggagagaggctgtggaaacaatagagagaatagcatggaaggccacgttgcaattaaacaagattgggaaagaagacgggactaaaatcatgccttgaagatgtttatcatatgaagttgaccttgagaccccaagaccggcttcagttttccacaatgcggctattatgagaaaaacagtgactaactgagcactgtgcataactcagttctcggaattttcaatcagaaattatctgatgacgggactaattcttattacgatagttccaatggatccacccaggatccacctccacaactaggtgtacagaagctggagatcccatcatgccgccgggcaccggtttacgagaactctatgtcttatcttggtagtacgattaggaaaacaaacacaatggtttctgccttcaatgtttccatggtgagggcagttattaggcatatgctaaagtgtaatatccgctttttcaaaccacatttcaaagttgatagcatcaacggctttaaaatcacttttaaagaatctgggcttacccagttaacagaaatagaacctgcctgtttatcagtgggtttgcctcacttttctgtgggtttcttttcttttcttaattatgcattaagaaaataacttaagtttctgtgcatacaacatcttcctttctcattcccagtaccctagaaacacagccgttcactgaagaggatttgagtgttgtctcctctgtggggtcaaaacatcatgcttctttctgttctgccccatggcagtggtgacgatggcctagcttccatcccgtagcttcttgtgtttttctattccaccagtctatcaaccctgtatttgttgtcaaatttacactgtccacaggcaaagatctattctcctttagaatttaataggagggtttggaaatgatgccatggaaaccctgagcagcttggcaatgctgaccccaaatgagaaataactatcattggtgttttccttctactactattatcttgcccattgatcttcaaaaagttcattggtcaaattgattgaggaacgcaagacttaaatgtaa

SEQ ID NO: 18585 - DNA, 1619 bp, Homo sapiens
cgaaacaccccagcttctatcattctcaagcttagtgtgtgcaagactcatggatgctgcttgttataaaggaagataaattatgaacaggcagactggtctgtgaaccttacccagaaaaatacacagtagtccagtatattggcctccagggcaaagctacctaggttctgagtccaattatggccttcatgagtcttgtttctttggacaggttttccagtgtctctgagcctcaacttcctcatgtataaagtggagatgatgccattacaggttgctgctttatggcacataattaatactagctcttatttataggaactgaacaaagccccagttgttttgaagcatgtcctatcattaacacaggtaatcaggatatattcattgaagtctcactgtgtgccaggcactatgctatgcaccttatgtgtgttattttatttcatccttccagctctgggaggtgatgactgtcatctgcattttgcacatgacaaatctgagggtcagagaacttgcccagggtcacacaattagtagatggcagctcaaggggtttttgcctgcgtcttcacccaaagccactaacacgggatctgtcaattgcattgctggtgatcaagaaatgccagctcctccgctcttccctgagtgccttgttggagacaaaaccagcagggttatatccccagcactgtaatttagtgtggcagtcaggggaaaacaccttgtagaatttcatttcttatcatttaatgtcccctttaattctcatttaagttcccctctgtaaaaggcagtcccttcagctctcataaaactttatggtctttacttgtgattaggcaatggtaaaattgattctctaaaaccaacttctagtcaagttatgtaattagccaataagggaggctgagagaggaagatatacaaggttctccctcaagaggtcagacgtattatcattggttagatgccgtatctttaaaacaccatcagcttggaaaacactatccattagcaagagatcagagcaagagaaacctcgaagggtcgaacggtccattctgagggctccacaaagaactcggcatcccagaaggatgattagccttccatctctcgagttgtctcagagcacaacaggtctgagtgtttttttctttaatgaattaaccctttggatttcagccctagcttttgcttcccacatctgacatcctgccctacctcctgccagaaaagattttgatttcgatcatggcagttgctgtcgctgaggtaatatgaggagatccgagacctcatccttgcagggagtgggcttgagataattctcgttacaagtttgcctagtgcttcacataagcagaggccccaagacatcagcaagcccgttttttgcctcttcctggttcatggttagactgcatttttgagcctctgcctgttaggtgcagccatgtgcctgagtcttggccaatggactgttggaagacgagacgttggccccttctcaacctgacctgtaaaaacctgtcttgcaaaaccctcacggctctttcccctgcagtcttgatgtgaacaagcatgatgatgttggaagccataca

SEQ ID NO: 18586 - DNA, 1028 bp, Homo sapiens
tttagatgcataaaagccaaaatatgtataggagaagctccaaaataaaatatcccagagtggcttgtaagcatccttccaacaggttcaggttgatttaccttgctgtggatatttaattatgtcattgaaaaaaacaccagtaattaaatcattatttcttagatgtgaggtccaaggacattctagaggaagtcaaaggcagagggaggaagggtgggacgatggaggcctgaagggctggtggagaggaaagaaggcagcctgtgccgtcagagagagttcaactccatccgtgcagctgctagcatcttgccttactcagcctctgtgaaccttaagttgctcagaatgagacaggtaacacctgcctccgtggtttgtcaggacatttagaaatgcagacttgctcaagacctggatctcaggtggtaggttggtccacagacagtggcaccactagctattatttatttgttgtcactgtttgggacccctgttgctgtctcaccaaagaacttcttgtctcccttttagaagtttccagagcgtcttcctgatgttgcatagagcactcacacctaacagatctcagaacttgtatcttttctgggtggctagactgaaaaatccattttcttgtgagtgagccagaggtctgtctcttgcggcatttctgcttttgagaacctcccgtttcctgaaaggcaccagaccccaagacagctctgctgcctgattggtaggtgcccatgacagctctgcttcatgcctgctgcctcctcatccctctggatgccttgtggtcctgcttgtctgaagagcataaacttgggggttcccactcgaaaagaggttccagcagttccagcccctatgtcaggggagccacttttggggctggtggtaggcagaactttggccctcgacatctcctctgttggcattactcctatggtggtgttacgtaacatgacaaaagggaccttgcagatgtaattaaggtaactaatcagctgactttagaa

SEQ ID NO: 18587 - DNA, 1015 bp, Homo sapiens
tgggtggatgaacagatgaatggatgcatggatgaatgagtagttggatggatggataaatgatgcatggatagatgaatggtgaaacttttatattttactaaaaatctgcattgatagcctagtggcttgctaaaaataagggagctgcccaaatgccccatttcctttatatacttgtggagcagcagcgaaggccaagccagtgccaggggctggaaacagacacataaataagaacaaataagatacagacctgacctcaatgattttttgatatagaagcataggcacataaataaattcctgtaatgggagtctagggtgaggggtggtgggtgccataataaaaattatataaagtgctatggggaagcaaagctacatgaccaatttgttctatttatttatttgttattattatgttttttgagacagagtctcgttctgtcactcaggctggagtgcggtggcatgattgtagctcactccagtcttgagctcctggactcaagagatcctcctgcctcagtttcctgagtagctgagaccacaggcacgggacaccatgccagtctaatttttaaattttttgtagggacagggcctcactgtgttgcccaggcttatctcaaactcctggcttcaagtgatccttctgcattgtcccccacaaagtattgggaatgtattctttcctgatcaggaaactccgcagagagaaagtgacagttgaagactatattgaattttggcccacaggaaaaggaaactttgctgttagggtcacctggaggagagactgcaggggtcagagatcagggccatatgctagagctgcaatgtgggtgctcaaatgatgttcagtgcatcttcacagatggacctccacatgtccctcatgccctaaaatagatattctccacagctgcacatacaacaacgtcagtgaaatccgttgagaggagcattgaggagatgagtcaggtgtgccgcagcactcaggtcagacttg

SEQ ID NO: 18588 - DNA, 1033 bp, Homo sapiens
ctcctgttcctttcgtgtccgttgggtgcaggcattatttccagtgtatgtgaccgcttcccccgtgggaacagtgtggcattgttccctgggcaagccaacagctcagccctgtcctagagaaccctggagctacgacgagggtaccctggacccctgtcctaaatgttctttgactctgcttagccactgaggatgtttgcatttgattcatttgcttattatgatcaagaaacgttacctgtcaacattggataaaccatccgagggaaattaatcaaaacccccttcagacaaactgcatcacatcgattctctccttataggccttcttgttttgtgttctctgtgtgtgttttttttcccctagcgtgctgaagggtggcattggagtaccatttaaagaataatttttaagaaatgaacatcaggacatagacgtctgaatatgaggaagtgcctcatgtgaaaaaggacgtaatgtgctttaaagaaagaagaaggagataggacgacacttttgatacaaaggttatttttataatacttgcatttttatcggttcacgtattttaacagggagccctgactgaagtcacaaaaattatgactccggcaccgaggtacttatctgacaaatgcaatgcgaatggtcttgttcttatcaatgagatcagatttcagaaatgaatgtgaagaccgaggcgttgctttgtgcacagataaccttgcaggcgcaaactcccaaaccagaataaaagaattctctatgaaataatgggccaggaagcccaatcgcgtcacactgtaatagacagtggggggtggaatcaaaagggggaaaaaactcatttcatctcagttaatggcagggaaacgaaggcagagaaggactttctttggagcggagctggtacgacaaagagcagggtttcgccgtgtcatgcaccatttgccgttgcactagggctcttttcaggagctgtgaagccattattataatgtgaaaaaggtggaaagaaatactcccttc

SEQ ID NO: 18589 - DNA, 1126 bp, Homo sapiens
attttgcccatagagattatcctctcagttggatttattttaaacaagttttgccccttatacattaaggtgcatgcaataaatcacttatgtaataaactactctatattatgtgggaaaaaaaaaaggagctggtggcagggggagagatttcaaattgagctagacctcaggcatgaagggaggggagagagggggaaatgtggaggaagggggcgtttgtgcagtgggaagttggagaaagtacaaatgaaagcctctctgcagtgaacctcatgactgctttagagaggtgcttatgtaataactgcagtggtgtcgctttagaaaaagttacagagcttgtctttctagagcaacctcttggcttatcttaattaccagcagtccatagtgagactggagggaagaaaaaaagatgtaagcttttattaaatagaagaaaatcaggggcagaggacagagggtgtgattaggggtctggggtaaccacaaatctgggcaactggaatttattgtaatggtaaattacactaataataatctggggatgaaaacagggcaggcagtgaaacctgaatctcagctggacgatgaatgagttttaatgcaagtgtatcgacgtgctgtactcctaacacattatttgttatctgaaatttagatttccttgggtgtcctgcctttttttttttttttttttttttttttgagatggagtttcactcttcttgcccaggctggagtgcaatggcgtgatctcagctcactgcagcctccaccttccaagttcaagtgattctcctgcctcagcctcctgagtagctgggataacaggtgcacaccaccatgcccggctagtttttgtatttttagtagagacagggttttgacatgttgccaggctgctctcgaactcctgacctcaggtgatccacctgccttggcctcccaaagtgctgggattacaggtgtgagccaccgcacccggcccctgcctttttattttgctaaacctgatgacccttgccatagcagaactaaagtgatgatgatgattacagcagatcagttattttgagctctgactttgcatgaggccctttattaagtgcttcacttgtg

SEQ ID NO: 18590 - DNA, 1084 bp, Homo sapiens
cgggttctccctgtctataaggggaaaagacagggttcacaccaaggcctgtctggatccaaaacccatgctcataatcactaagttatactacctcttcgagatgctgatttggaaaataactccatgatgaaacatgtcaagggagactgcctgtactccgtaatgcagaaatgcattagagctcaaaaatctatgctgtttaggaaagaaaaatgatatcgctcagaaaatcatttaaaaacttcctggtgaatgcacccagctcgccaatgcatgccagccacagggcctcacagcacatttcaggagcaagacaattcagaccccactcttccccctgaaaaacctccttccagaaccctcttttgcagtgagcagagataagcctctccaatttacatgtttgtcattctctaactttgagagcccaataaaactaagtgcttagtgagaatcagacatggataagctgcttgtaatttatgatttaatgcagcatagtataaaaataggcaatgaaactgaaaggcaatcaaagtctattgtcacaaggaatgggaggaacggggacgtgatctaacatttgctgagatcctgctgtataccgggaacagaacatatatggtttcatttcatcctcccattatcaccgtgaggcctcttccgcttatctattgctgagtaacaaggtgtacccctcaatttactggcgtaaaacgacaacagttttattacatctcatgattttctgggtcaggactctggatagggtttggctggttgagtctcctcttgcagtggctgttgatggaggtcatttagtggaatccagttggcaggagagctggccttggagagtctaggatggcttttgtcacatgtccagggctttgtcaggttagcagggcagggagggctcagctggtctcagctcgtggctgctccagcaccgtggtctcagggtgattggattcttgtagggcagctgtttcagctacacagcagaagtggcacggccttttctgacttagtctcagaaggcagagggtgtcacttccactgcatctttggggaaggcagt

SEQ ID NO: 18591 - DNA, 1028 bp, Homo sapiens
cagtaccgcatggcgagccagtacccgtgaatgctacttcctccaaagagaattcctgggataacagagaatccattcatggctgccaggaggacttggatatttctcattttccattggccctggagtggaggaacagagccgaaaagtacgtggggggcaggcaaagctgcggtcagaggcagaccctgttggtgttggccgtgtcaaccagctttgctggtttctattatagccctggtgtggcaaaggacactgtgtgactgtgagctcaggtcagcattgcgatcccttcaggcctctggcttgcaggttcctgttcaaccctcttaaatatgcttttgaagcccgtacgttcggtccacgccaactcctgtttatactggtgcgaagtgatgcctgctcagattctgggcgtttcacgggaaggtattaaatgtgttttgaaaatacttgaaagtccagctgtgtatgctttattttatatttagccttaaattagagactccatatacctcaagtaataaaaaggcacagcaggcacttgggttttccctcagcttgctggggccgtgcacctatgtgagattttattatttgtaattttgggggggttaatttcacagcttaattctggcctttatgcatttagagctcccctcttgtgtttcagaaaggaggagttgttgttttcttttcacttgagtttaataaatgaaaaaggggaagggagagggaaggaagaggaaaaagcacaaatgtgcttgtttttggatcagcccctgtactgggcacatggatgcagtcagtcctcagtgtaccccaggaaagaggaaactgagtctccatgtggctttctgtctggcctttctcttttgcttgccttgtgctttgaatgcaggcctgatgtttgcctgtggacctcaggatttgtaaggccatctccacccacctacagctaagtttcccaagagccgatctccagccaaagtccaaggttccttgatgacccctgggaggagatgcaa

SEQ ID NO: 18592 - DNA, 1031 bp, Homo sapiens
agcactttaaaattattatctccttaaacctcactgcagagttataaggaaagcactgttatcagatgaagaagtagatttcatcaagtgactcacccggtatcatatagctgcttagcggcaaaaccaggatgtgaatggagagctctttctcggataccaaagctatttaatatttatcattgactaataatggtagagaaagtaatcatcataacctctgccctttattagtcactcatggtgtcacaagccctttacaaagcactgtgcatgcaaatgattcctcataacaaccttgggaggtagttactttcattgtgttagctatctcttgctgtgtaagaaattaccacaaatttagtatatttgttatctcatagctccataggttaaaagtcctggttcaggctgggacttctgctcagggtctcatgaggctgaaatcaaagcgtcagccagggatggggtcttatcagaggcccttggttattaacagaattcattttcttgtaactgtaggactgaggtgcttgttttcttgctggctgttgactgagggccccttgcagcccctagaggctattctcaggctctcaggccctatccacagatgacctcacaacatgactgttggcttcttcaagactgaaggaggctcccccatgctctgagtcactctcttcagtgagggcccagccccttttaagggcctagcgattagatcagtcccacttaggattgaatcccttttgattaatgcaaaaccaactgcgttcaggcctccatgacatctgcgaaattcctccccctttgcttggtagcctaactcactcaggggggcaaattatcccatcatattcacagttgccgcccacactcaagagaggggattctataggaaatggaagtcttgggggccatcttgaatcctgactaccatagtctgtgaaatccccatttcacagatgttgaaactgagacttagaagcattatgcaccatgccaaaggccatggaaggacagagctt

SEQ ID NO: 18593 - DNA, 1022 bp, Homo sapiens
aaatacttctctgatcagagcatacctgccgtgctcaaagcacttgcttacttggaatgccataaattacatgaaggaattattcattgtatcacgaaacataccttccagtctcccgagtagtgtattaggctaagtatggtcttttaaattattactttaaaaataaaagataatggaattatagcattaaatacattttgcaaatgatcttctagtaggattattgaaagacagtaaaggcaagtataaatcagaagcaaaatcattgtcctctaattcattaatggttaataatattgctgactcttttaacttgtcaacatttcctacattcaacattgtactctaatatccagtaaagtgaaacaaacaaacaaataaatacacttttttcaagaaaaaataaatatctgtgatctcatcatttgaccgtcagtattttcatttttgcatgtgccactttaatttccctaggcaacactagctagtggcccacaataagacgtagaaaacaagaccacgtaccttccagaatcattggccctggctctactcctggaaacccagtccatctctaatccctttgatttccaatgggaggcaaatccaggggagttctagactgtctagaatattgtaccaagaacaaaaggccaaccccattagacagtggccaagggaggtgaactaaagttggtgctgtgaacagggctaatggtttgtgatttacccataagtggaaggtgtactccggctgctcctttaatattttatgattagcagtagaggtgtgtctgggggaaagagtcagcttattttatttatttattaattttttgagatggagtctcactctatcatccaggctggagtgtggtaggtgggatcttggctcactgcaacctcgtctcccgggttcaagtgattctcctgcctcagcctcccaagtagctgggagtacaagtgtgcaccaccatgcctggctaatgtttgtatttttagtagggacggggtttcgc

SEQ ID NO: 18594 - DNA, 1079 bp, Homo sapiens
catgctcatcctctgcctgccctgggtttttaatttgtgcgtgtgggtggggtggggggcgggggggggcacttatcaccacctgcatattatgcttttgtgcatttcaggttggtctttcccgcaagaaggtaaactcatctgcagctgtattcgctgtgcctatggtagtgcctggcaaatgcacagaagtgggtattactgaggactttgtggttcgaatggaatgagtgtgctgctgacagtgttgcgagtcatctgcaaatgaaaagtccttccttctcttcccttctggaaccttccaaagaggctagcctcctgagagggcgtctcctgggaatgcctgtgatccaggcaaggcacctaaatcagccaataaataattagttttgagaaaaaagcctgcacaaaagcagaactcacagattttctcattgatcttcctgcctttgccttggccatggtcagtctttggggctattagctgcatgtacaagtgcacaggggatgggaggggggctccggaagatccctaacccattgtggacacaccatttatgttagtggaatctggtaagagtgattgaggagagagcattgggtgaatgaccctgtaatccttataaaaatagtagcaacggtaactaatgatgtttatgaactgcctaagaatgccatgactgtgtcaagcacttcccataactagctcatgtaaagcctgtaaccatcttgggggtgaggacaattatgtcccattgtgttatgtgtctgtgtttgcaggagttgttcagtggtaaggtgcagtcaggacttaaacccgtgttcctgagagtagctctgtgctgcctgacacactccttcctcctgaatgcacaatcatatgttcacgtgccacatggttttcagaaagcactgcacgtgtaggaagctcaagacagagacgtggctggtcacggtggctcatgcctgtaatctcaacgctttgggaggctgaagcaggaggatcacttgagcctaggagttcgagacctgggcaacatggtgagacccccatctctacaaacaacaacaacaaaaaa

SEQ ID NO: 18595 - DNA, 1048 bp, Homo sapiens
aatgattagaatatttgtaaagttcctggcaaaggtttgattataaattagcgtcatcatgaacgttcaaggtggggaccttttttttttttttttgaggcagagtctagctctgtcgcccaggctggaatgcagtggcatgatctcggctcactgcaacctcctcctcctgggttcaagcgattcttctgcctcagcctcccgagtagctgggactacaggcacacgccaccacgcctggctaatttttgtatttttaatacagacagggtttctccatattggtcagggtggtctcgaactcctgacctcatgatctgcccgcctcaaagtcccaacgtgctgggattacaggcatgagccaccacgccctgctaaggtggcaatctttatacataaaaaacaggaatgacttcttcgaattggtgcactagagaaatgttttccagtcgcctaagcgtttaagcatggtaaacagattaccatattagttgcccagaccttgcaaaacttcatagtgtttgtttgtttcccttgggaggctgttctgagaaggaaccttttcattcctcggagttctgatgtgttcattggcccctgttgtcatgctggatatgggggcggttcaaggggggcttgggtgcctgagaaaaagagtgaaaaacccaactgcgaaaacccaagagaaaccgaaagagtgaacactggaaaaaaaaaaaagggggggccggcgagcttcaggacctaagcggttaaggaactggctttgacaggaagtgggcaggaggctgttttcagtatgctcatgggaacccagctggaaagtgctgtggtgagtgtgtgtggaaaaaaggggctttaatcaagctataaatatctgtttctttgaagttttatgaccaacaattaatgttactggaaggcccataaaaagggctgtttcttgacttggtgggtctgagtgggccagggtcgggttaagatgctagcctcgtggggtgccatcctgacagattctactgtgtgcgtgtgtgtgtgtgtgtgtgtg

SEQ ID NO: 18596 - DNA, 1049 bp, Homo sapiens
gctagataaaagttggttttctcaagagggtttctgcacacacccgaccgcatctttttcttttcttttctttgttttttttttttttttttttgagacggagtctagctctgtcaccaggctggagagcagtggtattatctgggctcactgcaacctccacttcctgggttcaagtgattctcctgcctcagcctcctgagtagctgggaccacaggtgcatgccaccacgcccagctaatttttgtatttttagtagagacggagtttcaccatgttggccaagatggtctcgatctcttgacctcgtgatcttttctcgcctcggcctcccaaagtgctgggattacaggtgtgagccaccgcaccgggcctcacgtttttcttttaaagaaatgtgtaattcagatcagtcttgctttcaggtagtctgaattaggggagtttgcctgtgtgcaagagaaggcttcctacttcattttcttgtgtgcagggagccatttatgactaataggattcattacatgtgtgtttagcccaccgattattaaggctttaacaatattaaaacctaaagagataacagaggggaagcctttgggagctaggaatcaatcgtgctgggtggcttgaaaacagggcagtaaaatggcagccgcctagcctgtggtctttaatattaataaagccagaggcgatatcacttagttgttccaacatgattggttcctcatggatgtgcacccttgctcatcaccatctcaccaccaggctgaccctatacatcttccaggagcccagctctttcccctggaaatggttctctgagtttcagctgcagttcagggaaaaggccagcagccacgttccttgttttgtgtaattggtctttagcctgatctgattcatctggcgaaacccctttttccagtaaaagtcgttggcgaggagtgaattgtgatggaaacagagacagatgtatgtacctttcatggacataatttccccaagactgaacacaaaaatgagggtttttggagatctctct

SEQ ID NO: 18597 - DNA, 1148 bp, Homo sapiens
aagtaaaccagctgccccgagcaggagcacagcttccagatcactcatcaaggggccgtgggtgacagggctggcctgctgctgcctttaatgggcgtagatgttgttgttcatgtttcccagcccattggtgatgacacagaggcaggagccggggctgcagactaaattatatacatctcaagggcagttagacaattagctcgcccacaggaacattgcaataagcacagtatctgctttcccagcaaagccaagtgcaagttcctgcctgctctgatgacctcttgtgcctccagtgtgggaagggaccaggtccctcaatgctgccgcctcccaccctgtgctgccacgtggatttaactccttcgtgttccccatgttcttagtcagtatggttgttgtgccatggattcaaatggggttgcttgatttgatttgccctttacttggctggaattctctctaacaatcaatggaaacacagctcatagggatgcatgtagcctgtctcatatgtgaaaaagaaactttcaatgtatacttcatctcattccaacaagaattggaaacagcaacatcaggacttatatggtgcagggtggtcagtaagtaggaaagaaactcggggcatggaagtgaacaggaagcccagagtgaagccaggacccaaaacccacaggtgctgctcttgttataagccagccacacatttgtctttgagccttttagcagctgccacaaactgggagaaaccatcagttatgcagtttacaatatctctaaactcaaaacaagccagtaattcagaaaaagcccagttcttctcacaaagaaagatctaagtgtgatatgagagtatatgcatggagaatattttctgagctggtgatgagctgcagggggcctctcccagcccccgcactggttgcacttttaaataagagaaaaaaacagtgataggactgacctgcgtgtagaagtttcaagttacaagaaaaacacttcacaggatccaaatccttaaagtcctgaaggaaacagagagcatatacaccagctttcgccacccaattcggatgtgttagaatgaagagtctcttattttttaatgaatttttctctatttaaaagtacagggatacctc

SEQ ID NO: 18598 - DNA, 1035 bp, Homo sapiens
agttctgggccataactctagagcaaccccaacccccaggccatggaccaagtgtcaacaatgttgacattgtgaatccctgatctggaggaacatagctttggggcagtgccaggatttaatatgggttctttggacttcagagccccttgtgctaaattgaaacattatggtgttgctttgagcaaacaattagcatttttgccatagctttttacttctccatgttgaaattatcaaagattatcgtcgaaggcgtggtttctttactatctgtcttctccaggagactgtcatctctgtgagtgcaggaatccggctggtggtgtttttactctaacacctctttcagtacatacatacagtaggtgcttagtagatgtttactgaatgaatggataaacatgtacaaaattatgatcccttgtgttaaatatggtagggaagcaacataatgtgccctggagtttcacagaagaaggggctttcttccagcttggggatggaggtgagctgtcattctggatgatgtgatggggaaagaggatgtgagctgaggcttggaaccaagcagagcttgggctttggggtgctgggaggacagaatgctggaaacagaggtaagaagggtaagcacctagtcaacatgagtgatttagctttgggagctgatcaagtgatatgatttggctctgtgtcccaactcaaatgtcatctcgaattgtaatccccacgtgtcaaaggagggaccaggtggaggtaatttgatcatgggggtggttttccccatgctgttctcatgctagtgagtgagttgtcatgagatctgatggctttgtaagtgtttggtagttcgttctgtgttcattctccctcctgccgccttgtgaagaaggttcttgcttccccttcgtcttctgccatggtggtaagtttcctgaggcctccccagtcatgtgaaacggtgagtcaattaaacctctttcctttataaactacccagtctcaggtatttctgtgtagcagtgtaagaac

SEQ ID NO: 18599 - DNA, 1030 bp, Homo sapiens
tttttccaatctcagtaagttttttagggttatgaagattgagcactgacgacgctgaaataccacagtgcaaatgcttccgtagattccctgggctctgcactcaccagatccatttctatgataaagcacagagctcctcaaacagaacagtcgagttgcaggctcagcagcctccttgtcagtgtcctgctcaactcagccaactcagccaggatatggctttggatctttctgttggaaaaaaataaacatttgacatactttaatatactaaaaaaaaaattaatatctgtacttcaagatgtcaagattagtaaaatattcacttttttttccctagacctttgaaactcacaactctacgacacctctacaggaaagaagccttggactagatataaatagtacgtgtgtgttaatatgaaactgaattttggaaatgcatcattcccttatagatttctttcacttggtaaaacgtgtatagtaggatcctaatttaaaacttttattgttttcagaaaaattgaaaagtaaatatctgttgaaggaggaaagctaatctaccatagttctcctttagaatttactagaataacaataaacaacaaaacaataattacaaaaacaaaagttagctaatagttgttgagcatttcttgtgtgccaggcaccacactaagatgtttatatgtattctttccttaatcttcacagtagtcctgtgaataagcgccattcatcaggaaactgggtttcagggaggtatggtaactctctaggcaaagtcacacagctaaggagtggcaaaactgggagtaaaatccaggtacgtctggatctggagcccatgctcttaatgcgctggataaacttctagaacaatgagaatcatgactgtattgctactcacagatgtctgaagtctctcactagaaaacccaagagaaaagagtacagaactactaaagtaaatttacaaaagtggtggggtaaaataaaaattcataaaaaaatgaaaactttc

SEQ ID NO: 18600 - DNA, 1043 bp, Homo sapiens
aggcctcacaatcatggtggaaggcaaatgagaagcaaagtcatgtcttacatggcggcaggcaagagagcttgtgcagggaaactcccatttataaaaccaccagagctcatgaaacttattcactaccatgagaatagtatgggggaaatcgttcccatgactcaagtatctccacctggccctgcccttgtcacatgggggttattacaattcaaggtgacacttgtgtggagacacagccaaaccatatcacaggcatgagctaccacgcccgccagcatgtcttttttaaacattttaaaatctattctttatcttgtttcagagaggatttggagttacagaaacacattagactgggcatggtggctcacacttgtaatcccagcacttcaggaggtttctcctagtgtactctcacacttctgataccagatatgtgggggagggggtttcccccacacattaagcaagtgtgaaacatgatatagaaaaatgacttcactctgggccgggtgtagtggctcacgcctgtaatcctagcactttgggaagccgaggtgggcagatcacccgaggtcaggagttcgagaccagcctagccaacatggcaaaaccttgtctctactaaaaatagaaaaattagttgggggtagtggcagccgcctgtaatcccagctattcgagaggctgaggcaggagaactggttgaaccggggaggcagaggttgcagtgagccaagatcatgccactgcactctagcctgggtgacagagtgaaactctgcctcaaaaaataaaataaaggccaggcatggtggctcacgcctataatcccagcactttcagaggccaaggcaggtgggtcacaaggtcaagagtttgagactagccttagcaacatggtgaaggtgaaccccgactctactaaaaatacaaaaattagctgggcctggtggtgtgcacctgtaatcccagctacttaggaggctgaggcaggagaatcgcttgaacccgggagacataggttgcagtgagcc

SEQ ID NO: 18601 - DNA, 1035 bp, Homo sapiens
cttgccacgacacccacaatgccgcccttgggtcctgcccagtggactgtatgtgccacaataactagaagagagggttttaaatgttctcaccaccaagagacaatacgtttgaggtcgaggacatgttaaacactctgacttgatcactatgcaatgtatatgtccatccatgctgcacaccgcaccccatcagtaggaataattactgtgtgtcgattatgaataaaaaaatgttttaaaggagcggtaggtttgcctctaaacaccatcagtcagtttcacggtgttggtaagatcagctcaggactgagacctaagggaaattgcccctgtggctcttctttaagagggggacacagtaaatacaccatgacaatagtctcaacaaccctccacgttatgcaaaacagggcagtcattttcaaccttgggacacatctgtgacaagcttattaaaaatccagatgtccagccccaccccggacctgttaagtcacaatctctcagtcattacaatggcaagtttccttccaccactctaggccagcagtgacataattcaaaagcgcaagtcattgaaagcagttctgcgaatatgtagcttttgatgatcaggagtaaatttagagtacccagaatattgcatgttctgtctgcccatagtcaggcttctgataagaatttcacagcagaaaactctgaggttgtagtctctagtaggacagatgtgtcgccaatgaagagtgatctgctcttaccaccatctaaaccgggatgcaacaacgttctcaattgaagatcagggagccagtcaggaaatgtacctgaggtatgctgaggaagaccgtgcaggtggggccgaattgttggactgaaaagctctgggtttctttcagcactcaagtgtaactctgggaatggctttcaacctgttgttttgttttcatactaaattttaactaaatccttttcttccctattgtttttgtgtttttttgtttgtttttgagacagagtctcactccatcaccc

SEQ ID NO: 18602 - DNA, 1027 bp, Homo sapiens
agtgacattatggtggctctgtacaggtttccagtcctgtgatcacttgtaaaatttagggttttctggagacctattgcaacaaaagtttgtttagctctcagtcctggagagaaaatgaaaaaaaagattcctaagatttttagatcctttgatgagtcagctaagaatgtaagtggcttccccccgacccccccttattttttgagagaaggcaggtctagtgaggatagaatgagacatagggcctcaaatccagcctaggtcatcatgagcgacttttctgggctctagcttccttatctgtgaagtgaggtggttgggctacatggacagcaaatcccctttaagtctaagttatgtagctctatgctatttttgttttgcctcatgtgtatgtgttgtgaggaggaggacctgtttctgtttttatagctttattgtgtcatttaaagttttgttttatgttaatattaaagcatttccattcccctgtcatacaggactttattgggtattctgttgtataaatccaggcctgtagagttgtatcacaacaatcatttattttatgctgttaatctgggtatgttccaaggcctaattattgatgagcctgttttgccatttaaatataaagtttgactcacagatgatactgatgaaactacttaaggagactaataggatctctgtaggaggtccaagtttcatagtaacatagacattattttttgaatatctgaaacatacactgtagtttaatgtcacatgggcactaaagtccgtgagtactatgtggtgtgtgcagagcctgcttttcatccccagtttacttttgttgattaatttatgtgaataactgcatagcctcttattagattctttgcttccctgttaatgctgagaatacactcccgaggcagcagtatccactaagtgttccctggtaatgagagtctggctgtgaagcaaagtgatttcacagtaatgttcagttaataatgttttgctttctttacaatat

SEQ ID NO: 18603 - DNA, 1022 bp, Homo sapiens
ggtctggagaccgacagaatccacatcacccaagagctcattacaaagacaagcactcaggctgcattgccaaccttctgaatcagaaaaaccttgttttgaacagttcccagttgaattgtatgagcattaaagtttgagaagcactgggccttaatcctttcagcgttgtacagatacagttattaaacgttcttccttgtttttgatctggttcagctttgttgtacctaaggtcatcagaaaaaatcatatgtgagagcacttcacatttaaagacttgagtatttaaagaccactgtcagcttcaagtttattgtacatgtaatcatcaagcagcatcttcactttgtaaactgctgggctaggttgtcagcatacagtgataaagagggctccagcctcaaggaacttggagtttactaaaggaaatagagaaataccataatgtaggccagaacttgatcattccatagtatgtcataataaagttattgataaggtgctggggaaattcataacaggaatctatttttacctacaaagaggtaagggcggaggtgcagcttgtggcaggatggagtgatctaggaaaaatctgtagaacagctggcattacaactgatctttcaaagacgggtgggaattgggcaggcacaaatggtattgggggaggttaagggcaggataggatgatgggaaggtgtcaggggcagatgtaaggatgtgaatttaaaccgtaattaaagttttgatacttaaccttcaggtgtttggagacttcaagtgtacagcaattcattttttcatgggctttggaaaggatcacattttatggaagtctgaaatggtccatgctcgtatttcaggaagtctcttattccttcctcttagccattgtgtatcctctgccacctgctgagaaaaacctgtattctttatatttgttcgtttctttgttttaaatagagatgaggtcttgctgtgttgcccacaatggtcttgaactcctgggctcaagc

SEQ ID NO: 18604 - DNA, 1049 bp, Homo sapiens
tagggcagagggaaaacacccaaggaaggaacaaatcaggaagtattttccccatcccacagggctgagattcatcccattggaagtgtgtgtgctgaggccgctggagagtgtgcacccctggtctcctgcatgctggtaggagcaagcacaggaggagtgagaggaaggcagccgacagcggcatagtggccctttggcccctggccttgccagtctgcaccctctgtgaacaaaagaccagcttctacactgggttcatttctccctagtattttctgtttcattgattcctacactcatctatattacttccatccttttacttactttgggtttcttttactcttttctagcttcttcaggtagaattctagattacttatggtagatcttttgcttttctaaggcacaccatgaaagccttcaactttccacagagcaccactctagctggacatgctgatatgttttattttcatgaccattcagtctgcagtatcatttttccttcttcagattggatggtttctgttgctctgtcttgtttgctgctgctttcttttgttatttccatccagtgaattttttatttcaaatttatgttagttatttatttatgttagtaattctaaaatgtttgtgtactttgtttttaggtttttaaattttctgtgctgaaatttcctatctttccatcacaagcatattttcctttcccttactgagcatcactgtggtagttgtgttcaagtccttgcctgttaattccagtatctgagtcatctcaagagttggcgtctattgattgtttgctcccttgagaaatgggttctaatttttctggctcttcttctgttgaggagttctggactgaatcctggatatggttactattatgtttttgaagctttgaattttcttatattgctttagagtgttgctctgagttttagtcagcaattgacttggttagacttaaattgcaagctgtgccacctgccatgggtggcagctgaaatctcagtccagttctcgaagcctcggtc

SEQ ID NO: 18605 - DNA, 1173 bp, Homo sapiens
tgtagggccttgtaagaactttggccgttaactctgagggagaggagagagctgtgtctgctctaatacattcaggaaagtggcagctctgaagaccgaagtgcctcctggcttgcctctctccctcccgcagcctcttcctcttcctcttcctcttcctcttcctcttcctctccctctccctgaccctcccccagctgcccactgttttgtggggattgattgggcccattgaggcctgctgcctggagtagcagccttgcccacagtccagtctggggacctttctcggccatcccctcctccagctatcctcagtgttggtcacttatggcttttgctatttatatagcacagtggtttataaactctgcttctagaatttcgcaacccgtcctgcagcatgttatctgtccaggcagatagtggcgatctttatccaaatcaaaggactgaaattaaggggatggaattgtctgcattttatgttttccacccaacatattttgtcataaactgggaacttgtgtaaggtggcatccagtttagttcaatcctgtatgtaatcatttcaagcttaataaattagttaatatttgttaaacacctactgtgtcttggggtttctgcgagatgtgagattcattggcggacaaaccagatagcgtttttgccaagtcaccgagatagtttcaggtccttggccatcatctttttccaccaactccaggtcagctcaggggcccaccaggtggaagtcgcccttccctggcggacctcgcccgttcccattccttctggcaaagtcagatttggtgaaaaggccacagcagctgggtggagttccacttgccagctcgaggaagagttctgggaggcacgggaagccaaaaccgcctgtgaaggaggcctggtgcagctcagaaagccctggctctggccgaggtttgggatgtgtggctgccatggcaacccgtctccccgacgaagggtagacgggttgggcgccgaacgcagggtgttgcaggttgggctccattttgactctggtggagaacgatcacctggctgcaaaaccaacctccccgcccagtacaagcatctcctcttcccccttgggccacgagggtgggggacttgaggcaggagtgggtttttgtagtggggtcattg

SEQ ID NO: 18606 - DNA, 1029 bp, Homo sapiens
ggcgctgtgagtgtgtcatgggaccgatgatcctaagctcccagacctactgcggagggttgaggggttgggcgtgagagcctggcacccggcctgacaggcagagaggggctcccaaaggccacacgcaaggccatcactctgttcttggcgtgttggtttgcacgttcattgcctgctggccagagcgagctggtgtgtcagactcacatgaacgggcttaggggaagaaagggaggcttttccatcacagccaggctttctcagagatattcaggttcccaagaagtggctgtgagatctggagttgatggacttaattcagagacaaacatgcgcactctgtgttcagggccttgcatctgtttcgtccatccactaggcctcagagcagccctgggaggtagatatgatcgcgcccatttgacagatgtggaaaccaaggatcatccatttgttcttgggtttcttttctaattcacctcatacgtcctaggccctgagacgcagtggcaactaggaaattgcacttcgggtcctcgctggagttcattcaggaggggtgcccagggccgggccactttgcacttgagtgcacacagtgactctccaagcagaccgccgagtccctccagtcccgcagagtttccgggtgtcctcagccacaggaggtgaggctggagtgggccggcccattgcccggtccccagagagagccagactccccaggaactaatttcttaagagaccttgaaggctcttaactccctaagcgaatccagctgtgcctggtggccggcactgttgcagatgtcctggccaaagccagcttggtttggaagcccggccccaacagccgccaagtctggaaatgaagtaaatgagtgagttgttcttggccattttcccctcatctcaacccagctcaaatcaaactggagctctgacctcaggcatcgcacattccatactccccggcctcctggggttcaaaggcgcacggcaggcgataaccgcactgggcgttga

SEQ ID NO: 18607 - DNA, 1033 bp, Homo sapiens
acccacgtggcttcagggcccaggcctgccctgtgactcacgcggcctgtcacccgccgtttcatgtttcaggcctcgcctgtacactggtgcttctcaggaagtcttagggaagatgacttatttattagccgtttttttaaaatctcttaattaaaaaaacaaccagtgtgagtatgtggaaatgtgattcaccatgtgatcggggaggtcagagccagagtccctggctcaaaggtaacacccctgtccacctggatgaagaatgttccagaagcttccctccaggcacggtccttgcctgctgagcagtcaccgggggaatcgggggcagttaccggggcctcagactgtgggagctgcctcttcctgggtctccagccgtgatttcagactcgtctttcatccttcccctctcggttgccagcccagtgctggagggacgcagggcagagcccagccagctgcaggtgtttccaggcatgtgctgggaatggagcagatgcggggctgaagctttccccagaactggcctttattgacgcagagggtgggaaagaaggcacgtggctgtgctgggagagggtgggtctccctatagcctggacctgggaagggccttctctagagctctccagggacggccagacagctccccttccaccttggggtgtaagcggaacaggacacactcccctcaggaagcacggtatcaaagagggtcaggaggagccccagccggctcccgttctgaggaggcacctgtgggcatgggggacccccggggccgccccccgatgcctccgctgatgcttaaggtcacacagcaggacatggtagctgggttcaaactcaggtcaggccaactgcaaagcctgtgctctttcgactcctggatggacactgcccaggtgcccctgggtaactgatacccttgtccccaaacaactctgaatctcttttcatcatgaatattattaataacaataaatactaataactgccatttatcaagagcccctacttgccaggt

SEQ ID NO: 18608 - DNA, 1310 bp, Homo sapiens
gtagctggaattacaggtgcatgccaccatacccagctaatttttgtatttttagtagagtcgggatttcaccctgttggccaagctggtctcgaactcctgacctcaagtgatccgcccacctcggcctcccaaagtgctggggttacaggcgtgagccattctgctactaaccggcaagtgacttaagtccttgtgccttccttgcctgatttatgaaatggcaacaatcctggggatgatgggaggacttttttattcagtcaacacatgagtggtgcctactatatgctaggccctattctaagtgttgcaactattaaatagagtagtctgcagagcagccctaaggggcagctactgcctagctccgatgaggaaactgaggcccagagaggttaagtaacgtacccagctgctaggaggcagggctgggcttcagaccatggagtctggacccgggacctgggctgacagttgcagcataacaaggattaggtgagatgctacatcagtgaggtgaccacttgtcctgttttgcctggacagtcccagtttacacttgtagtcctagtaaagtgatcagtgacgcttcatttcattcatagattacatggtcaacttatgtattgagtattcaggacaatcctggggacatggtggcactgcctccatgtgagcaatggagggggaggtgacatggccacagagcacccagcctggctcgcctgggggtgcctgggttacccgcagaacggagatgtcctcgttcattaactcattcgctcagcgatccatgggcctgtcacgtgcgccaggcatttgggcgtcatgctgatggctgggcgaggatggggaggactcagacaaaagaagacagccagcaggctctgggaaatgaagtcacatccaagacctgcccttgtgagaaatgtcaagtgttaccgttatcatcatattcccattgctttgtttggcaaattatgacaatatggctgttaactaagcagattctgattacctattgtttgaatgcaaaaaacaaaacaaaaaaagaagcaagaaaaagccttctggctatgtgaccagtatttagaaatttccattcctgaacaggcctcagggcagagccagtccccaggctgtgcggagccactgctgtccctgcaatgccgggtaatcactttgtctttgctgctgcatccatcacgccctgtctctctgtccttagatatgtttgcgtgatgtcgtgggatgtggctttcccaggcagtctgttaagcagccagagatctactctggcctcctcg

SEQ ID NO: 18609 - DNA, 1034 bp, Homo sapiens
atgaacccccatgtactcatcatctgcttcaacagttcccagcttatgatgagtcttggggtgtagctgcctctgtatgcttccctctctcccagccactgtttagatgcaaatccctgacatgctgttagttcatcagaaatgacttaaataggaatctctaaaaaataaagtatcttttaacaaatagatataaatgtaataccatcctcatgcctaagaaactaacaataattccttgatatcaaatgtccaatgttcacatttccctagttatttcattcatgatttttactattggtttgctcatttaagattccggacgtggtctacaccctgtatttgcttactgaaggttttacaatctctttaagttagtcatctgccctgtagaattttccatattctgagttttgctgattgcttcctcatggtgtcatttaacacattcctctgttccctgtatttcctgtagatttcctgcataccttgtgaattcctagtttgtttttacacaaggtctcactctgttgctcaggctggagtacagttgcatgatcgtggctcactgcagcttcaacttcccaggctcagatgatcctcccacctcagccttcctggtagctgggactacaggtgtgcaccaccacgcctgcctaattttttgtatgttttgtagagatggcgtttcaccatgttgcccaggctggtctcgaactcctgggctcaagtgatctgcccacctctacctctcaaagtgctaggattacacgtgtgagccactgcacctggcctctagttagttttagacctgtgctgtccaataccacggccaccagccacacatggtcgctgagcacttgaaatgaggtcctcattgagatgtgctctaagtgtaaaacgcacactggattttgaagacttagtatgaaaaaaaatatacagtatctcactactcattttttgtattgattatatgttgaagtgataatatatttgatatattgggttaaaatatattattaacattgatt

SEQ ID NO: 18610 - DNA, 1028 bp, Homo sapiens
aaagaatgaagtgaatctaaaatgcatgactgtggaaagatatccaagacatgttattgtctaagactcatcacacaaatgcataacacaaaggtattttttaatatgtatatgattgcatagaaaaatgagaccaaggaaacaccctcctctggcaagagagtgggcttgaattcaggtaaaggggattttgttgcttttcacacttctcatttctatattattcaaattgtaatgacagccctgtattcacatattagctgtgaaattgcaaagtatgtaataggccattatgagaaagaaaaagccccacattttagccagtgtgtccttggagtctcccccgacaatgccagggaagtgggaaacattttttcctgaagaaatgtggagcagaggcgattctctgggtgtgtttaggaaatgatcccatccttcgggaatgccgtttttggagttcgacgttctctggaggcttgggagatgcagccagggcgcagagttggcagtggctgcagacatctcttttcaatgtggacctcctgccacagccacgagattcaaggattttctaggaaaatgaacgccagtggatgtgtggaattttttcacaaagtaagtgacgggggtccctttgcacttctcatgcccccatggttaattgtgtgtgtgtgctggaagtggaggagggcggtgggtggtgcagctgtttgaggactcacccttcttcggaaggctggggtcaatggggtgctgtttccccgagtcagttgaaacgcccatggctaaagcctgtggatcatctcacccctgcatttcctatttggctctcactttggtcgaaagacagcggagcgcagaaaatctgtcataattgtgaaagtaggacctgtcatcctctaagggtcattcttcctggcccaccgggcttgttgacacctggagttgggtagcagagagagggatgtcgggaccgtgaattaacagtggccaccacttcatggtgaatggcatccagacaacacctt

SEQ ID NO: 18611 - DNA, 1146 bp, Homo sapiens
agccttcagcctcactggaggaagggtgtctcggaagagttgcatcatgagacccttggtggagtcgctcaccaggacggccttggccccgaccctggcaccagcccagggtgactttgatgtcgtgttctggcgcgtccttgggcccatttccctcctgtctcccgggggctcttttgcatgttcttcccaaggcttcagagaccttcagctccgcgtctgaagcagccatctctttcttggatctcaagagtggtgatttctggcaactgcctcagactccatttctcatctctgtctacaaaactagcctggagttgggctgtcgggttggcctggacatcctctgagcagcgattggcccttgccctgtttctgtgaatgaacgcggtcgctcttggaaagagcccccaccaccttgcagatgtgctggggtagggtgggggcgtgcgaggttggattacatgagactttgggttctttcctgcagtcattcctaagcggtacttctctgcatctggcctttaacagtgagtggacggggccagtgttcttggagcacctactgtgtgcttgctctgttagttctttgtttccttccctgacgggagttaggccttgccacccttatgttacagacggggagactggggctctgagaagcgacttccccagggtgcccggcccgcacatggtcgagcgggggtctcaaatcccgttgagtcttacttcaagtccaggctccttgatcgctggccctgcttgccctggtggcccacagtcccagagtcagtggcgccaaggtccctcaggctggttgtgaaatcagtttgagtgcagaatgacggcggttcacatcgagcttggtgcccaccctgctagcctgcctgggacttccccagcattagcaccagcatcagtcctgcctcccaggaaccccctccgtctcagacacacctccatgattggtccctgcctcacatcccagtttcttcaaatatcagcaagtttcacactgagagagaaatgtagataaccaataataaaatgaaatgacctctggtccctattgtcagagccataatagtgacattacaaaaatgcacctttagaccaggtgcagtagctcatgcctgtaatcccagc

SEQ ID NO: 18612 - DNA, 1223 bp, Homo sapiens
atccccattaccactacgctattatcactatcaccatcaccatcatcaccatcaccttcatcatcaccgtcatccccattaccactacgctattatcactgtcaccatcaccatcatcaccatcaccttcatcatcaccatcatccccattaccactacgctattatcactgtcaccatcaccatcatcaccatcaccttcatcaccaccatcatccccattaccactacattattatcactatcaccatcaccatcatcaccatcaccttcatcaccaccatcatccccattaccactactttattatcactatcaccatcaccatcatcaccatcaccttcatcaccaccatcatcccaattaccactacattattatcactatcaccatcaccatcatcaccatcaccaccatcataaccatcatccccattaccactacattattatcactgtcaccatcaccatcatcaccaccatcataaccatcaccttcatcaccaccatcatcttcgtcaccactgttacagcatcaccactatcaccatcgtcatcatttaactaaaagtgagagacactgcatataaggtctctttcctgctcttcctggggtctttgtcataaagagtacagagtcccttaatctctccctggtcaatggcagtcccagccctgagctatgtgagtgctgggtcttgttactttgaattgtatacctgagcaaggggaagaacacagagagagttctccagatgttttgtgtctccctctctccttccttctccaaaaacgatctcatctcggagctcacattggagagagctgtccttgtgaatttccccaccccttcctctggtcccttcagtccataaagtatgaaatctccatgccatgggctggtgtgtaggatgttcttcccagccagttggataaagacattttggttttttgcacgtgggagacatcacaaaagactgtgcatacatcctctgtgtccctctctggggaccatggcctggaagcagccaacacctgctcccttcctgcactggcgtcggaaaagttccatggcagataagcccgtgccattgcagggaagccttcactccaaagccacttgctgccccggagacctggcctgcgaggtccaaggttgtgccatctgaccccagatgcttcttctcctttctgtgctggccagtgggagacagcagagggaaca

SEQ ID NO: 18613 - DNA, 1070 bp, Homo sapiens
tccacagagccccaggcaccagctctgccctcccagcccagctgcaggctgtgctgctgaggtctgggcagcagagaagggtgcctggagggtctttctgtcgtcttgatgaacccatgacccctcctgggtccccaaggagagttgggtattgtaggcttggttgagattggcgagaggtggtgttgtgcctagcctggggggttggagggcggggggagtttctgctctgcagccctgtgatgcgcaggtgccatcgggtctctgaccccaggccatcaagagctgtgcgacctgcttgccatccatcatgtggagctggtcggtcaccccatgcaccaggccgactccaagccggagctttcctctccgctcttttcggagtaatccgtggatgatggaggagcttggcaagcatttcagcaaagctcttttttcttgttgaggcttgaaagtaatcgcctccgtgtattgagtgcccgccgaccacctggcgcgtctgggcattgagctcattggccgctggcacaaatggatcctcgcctcacccggtgcctgcctgtagcctctcccatctgctttctcacagctacactccctccctagcaccctcttgaggagtctgggggagggggcagcataatcatagttacctgtatcagatgctcacctgtgctgagcacgccacatgccctggcccattcaggtgctctctgcaaacacccttaaggcaggtacagtattccttcccttccctcttccctctacccttaccttccccctaccatacctttcctcctcctgctcctcctccccctcctccccctctttcctcctcttcctcccccccttctcctcctcctccccctccttctcctcctcctcttccccctccccctcttcccccgctcctcctcctcttcctccccctcctccccattctcccccctcctcccttttttgagacaagatctggctctgttgcatgggctggagcgcactggtgcaatatcggctcagtgcaacctccaactcctgggttcaagtgatcctcccacctcagcctccca

SEQ ID NO: 18614 - DNA, 1029 bp, Homo sapiens
gaaactgttgcagacactcttggcctgaccttatcccctcagcacacacctctgcacaccacaagccacttgctggaaacacctgtgactatgcctgagggcttctgctagcctgtggtgcaggataggctgggagtgctggggtgttagtgcctccaggggtggcatggctgggtggggaatcggcagatcaataccccagctccctcaccctcagtcaggacactcctggcttgttctgcactgactcccaggcttccccaatggacttcggctctatttactcacaggaataataagcttgatgacacagcctttatttgctgcgcttccttccctgtccaccaccccattccccttgcagtgattcctgggatagcccccaaataaactccttgtatgtacatccttgcctcagagtctgtttctgggggaacccagatgaagacagagacccacttagaccctgtgtcaggaaacacatggaccagacttgggccaccctgggacttgctgttttctctgttccctgcggtgtgtgagcctgtgtgtgcctatgcatgtgtctttctcctcttgcccctgattggctagccttgtcacttctgtcctgattctagagggagtgtctgatgtcccagttattgctgccctcagcagagtcaggattttttggccggggcggggggtggggtcagaaaccagctcaagcaaaaaaagagaatttactggaacgtgtggctgagatgcatactgtgtagctcacagcatccaagatgcaatgcctttcccatgctctcttcatctttctgccagtctttgtctgccaccatggttctctccttttttttttcttttttttgagatggagcctacctgtgtcaccaggctggagttcagtggcgtgatctcagctcactgcaacctcctcctcctgggttcaagtgattctcctgcctcagcctcctgagtaggtgggactacaggcactcaccaccacgcccagctaattttgtatttttagtagag

SEQ ID NO: 18615 - DNA, 1046 bp, Homo sapiens
aagctgaattgctggatcagttgctggattgctgtgtatatatccagaagctgaattgctggatttattttgccggattgctatactgttttctgtagcagctacaccttcccaaggcagtgcacaggtttctgttttcttcatatcctcaccaacacttacttcctttccctcctctgcccttgcccccttggcgtataacattggatttgcataagtagaatgtgcacttccctttgtcctttagccctggcagggacagaggaactactctaccaggaggtggcaaagggtgagggggttgcaggtggaaggcaggtgggtgagtccatttatctcattcagcgtgaatgcaaataggcttcctatttgagactccagaatgttagagtcacctggggaagctttggcagagccacggcagtagtgattcgggttttactgttctgggcatggcctctggcgttgcaaattttttaaataagattcttctgtgaagctggggttgaaaattagggctgtctagagggcaattttcaaatctgagcatgcaccggaatcccctggaggatttgtgaaagtggaggctgctgggctccatctcacagtggctgattgagtaggtggtgggcagggctcaagaatttgcatttcaaccaatccccaggtgatgtagatgctgctggtctgggagctacttagagaagcagaactctggggctgcgctgtccagcagggcacccctcaccacaggtggccatttcaacaaaacaaaacaaaatgaaataaaatacttagctcctcagtggaactagctgcatttcaggggctcagcagccccgtgtggctagcagctactacctcagacagcacagatgtctccatcattgttgaaagttctgtcagatggtgctgaggtttaaatctcagatctcacactaactcattgtgtgaattggggtaaatgatttaatttctgtgggcctcagtttcctcatgtgtaaaagataaaataatagttcccgcctcccagggcagatgtgagg

SEQ ID NO: 18616 - DNA, 1023 bp, Homo sapiens
cccgtgaatacaattggcagatggacttaagcccattcagaattgtctagcccaagcatgagacatcatacaagaattcctttttgctaattccccagagtgtcctgggttttccctcccagcatcctcctttcctggagaatgctgtgtgattctgtgtaggcagtgtaggaaagggtgccggtacttgtaagttccccatagtttcacttcagcaagagccaggccagatgatgccttcctagatagactcatcctttctggatgctttttggtgccagtgcatctttaggaatcctatcaaaaagtctgatagcctccaatcaagtagaatgaccataaattaatcaccccccaagctgagcatttagatggaatccatttacaaataaggcgatcatgcacagctttaggtgagtacctttttcctcctttacgccagaattctttccttaggatcaatactcagatatagaattagtgggatcaattaatttagctgaatggtaaaactgtaaaacctgggctttagcagaagccttaaaccagtgagcatgaagaccctttgcttagtgaagcagaccctttgcttagtgaagcttatccctccccagctcactgaagatctgggatttgtgcatctattgcccggggaaagggaaccagtgctgcttctctctatacataaaacccctccgcagacacttcacagaaaagtcaagtgataaaaatggttttagattgtggtagggcagcatttgcctaggcccgctgctctgcaaggctgttgtaaacaaccggaaacattataaataatttaagtgattaggtatcaccagcagcagagaaaattagtatatttaaaagaaaattgtgttgatgcagatttgacttccttgatgagggaagcttaatgccggggctgccactgtagggagccaggggcgttgtgtggggttctaaatggaaagtcgacgctcacaaatctgctttctgaaagttttctttagttcagctgctagg

SEQ ID NO: 18617 - DNA, 1025 bp, Homo sapiens
gtaggagagtggaaagggatttgtagttgataggtctatatgtcatttttacttgtgctcatataatgaaaaacatgttgatgatttttccttcttcaacaggttgctaataatttatactggaatctggcatttttccaagccaagagaagatcgaatggctttttgcagctaactactatgtgtagacaggttttatattataaagtatgcattcttatcacctagtatatagttagtttgtagagtgatttccccccagtttcttgaacatggtatcttcacatcttggaccttggtcagttgtgctattcattattaaacactaaaactttggcggttcttgcataacattgtcagattttttagtgtatttctgtgaagtcattttttttcttgtcattccttttgtagtagttgctgtttggataaaagttgatgtgtgattttttattaaacaaatagtaaacccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattcagaaatatctgtcactgctctgttgccaaaactcagaatagaacttagacgtatgtctgagtccctgagatcacatgctaaagtcgatgaaaagtaaccactgccactgtcttgtgtcagaacttttacagtacagaaaataacagaatagccttctgtaatgaggcgtttgttagagttttgcatgagattctaatacttcagtaggaccctacctacgtggttcatctacaatggttaccataaaaaatctggcaggattttaaaactcaatcagtctttcctttgagctagtgacttgaaaagaaagagagaaggaaaagagaccatattaagtccatgccagttgcttggctagaatatgatcaacgacttgtagtagactcaagtttttaaaaaacacta

SEQ ID NO: 18618 - DNA, 1023 bp, Homo sapiens
gggagggacttgtgctccaggcagaaaagacagtttgtgcagaaggacagaaatggcgtgtcctcagaggacagtgggctttcagtacggctggaacatgaggtccaaggtgggaacgagtcagaggtccagctgaggagacccgcagggctgggggataggaggtctgtggctcagctgagtctaaacttttcctctgaaggccgggcagtcatcaaagcgctgtaagcaagggaggggcgtggcctgctttgcaggtagaaagcccgcttggtagcagggagcagggggcaggatgctgaaaggctgctgtggaaaccccggtgcagtgggggcagccctctggaaaagtgggtgcagtttctaatacacatcaccctcaccttccctgtggcctagaagtgccgcttctcagtcttcacccaaatgcccaaatgaaaacagatggcacacaaagactcccatgggaacggcccggcagcaagctggtgacagcgagcctccatcgccgggaaacagagctgcaggtgttcaggcaggggacgggttcagcagtgagaagggggaaccgctggtctgcacatcggtgtggtgaccagcagagacgcaatgtcgagccacagaagccaggcacaagagagaacgtcctgcgcggttccatctatgccaacatcgagaacaggcacaactgatgtatgggacggaagtcagaaaaggggttgactgctgagccgggcccggtggctcacgcttgtaatcccagcacgggaggccaaagcgggatgatcacttgagcccaggagtttgagaccagcctgggcaacgtgacacggggcacaccggcaggaatgccttctttttttttttttttttttttttttttgagaggcagtctcactctgttgcccaggctggagtgcaatggcacgatgtcggctcactgcagcctccacctcccaggatcaagcgattcttctgccctcagcctcccgagtagctgggattacaggcacacgccaccat

SEQ ID NO: 18619 - DNA, 1045 bp, Homo sapiens
agagttttaggcgtgaggaagggctagcttttttttttttttttttttttgtctgagatggagtcttgttctgtcacccaggcagtggcaagatctcagctcactgcaacctctgcctccggggctcaagtgattctctggcctcagcctcctgagtagctgggattacaggtgcgtgccaccatggctggctaatttttgtatttttagcagagacggggtttcaccatgttggccaggctggtcttgaactcttgacctgaagtgatccgcctgcctcagcctcccaatgtactggggttacaggcatgagccaccgcgcccggtggcttttgctttttaaggtggacagaaacaccttgcagctgtgcttcgttgcccttgctgcttttgggtggaaacatagacttaagttagcatattcatcagttgatctcttttctgtgagaagggaaagaaatcgcagtattttgtgtgtatggcaggctttgagggcccttatactttgattctgtagatgccctgtccttcctcaggaggcagtcagctgtgtacagaggcccttgtggtcctgtcctgagagtagcggaaggaagacatggctctgcctggggagactgtgccttatgcagaggccaacaccacatggatgagccggaagcagccgctggcctggctgctctttcgggtcaggaaggctttcttgagtctggtatggtctggctgccccagtgtccccactgcctagcacagtgggcactcaggtgtttgtctgttggatcggttaattggcagggaccagttgaagcaaacagagaacagctggttgtcattcactgttttcaggactgcttatggttgtttttggtgtttctataatagttctaggcatgaagttcaggaccacagcatgcaagaccccgaggggcagatttgccgtctatagaaatagtaatgagagctgatgaagaagaggtggctgcttcccacagtatcaccttgattgtcatttctgcatttagaatgcatgagtgacccctaagct

SEQ ID NO: 18620 - DNA, 1572 bp, Homo sapiens
caatctaaaatttctgaaggaaattttagctcggaatctccatgaaagcacttaatatacagccaacctgttaaaaaccatactttgagaggtaaaatgattactttttgatagcactttaatagtagaaatagaatatacaaacagggaagtagacactcaattgcagtactttgacatttgagtttcaaggagagaggctgcctgtgagagtgactttgtgatagtttgtctactttgttcgcttctcaggacctctttgccccaagaaagtaaagcaaaattttgctatagccctattagtgagggaacaaaacttctcttcctccttcttcctttgtctgcttctgccatttgtaacacttagttcagcttgcagttggcttgcactgtaataaaactgtaaatgtcaccatgccctgacccctgtgtgtgttgtgttcaaagttttactctcgtagtctcgcatagttgagtgtggattgttgatgctcagtgcatattgttaaattggcgaacttcctggtgtgcattcactagttgatgatagtgtcatctccagatgtcctcagaaccacccacaccaccttctgaagttgaaagcacacaatgattgttcagtagatatcagctagcacccataacttactgggctttgattcataaagcctagtaaagaaattaaaatttttattttgatataagtactgaccttttttaaaactttattgagatataattcacatgctgtggagtttgtgtatttgaataaatatgcatttcagtggtttttagtgtattcacaaagttttgcagctaacaccgtagtccattttagaacatttcatcatccccaaaagaaagctcatgttcattagcagtcaccgcctcccgctcccccattctcctctcctcccagcccttggcaaccatgatctttctgtgtctggtaatttgcctattcttggcatttcatatgaatggaagaaacaatttatggctctttgtgtgtggctttaacttagtataatgttttcaaagtcatcctgttgtagcatgcattagtctgatgacattttctttttctttttctctttcttttcttttttcttttttgagacggagttttgctcttgttacccgggctggagtgcaaatggcacgatttccgctcactgcaacctctgcctgctgggttcaagcaattctcctgcctcagcctcctgagtagctgagattagaggcgcctgccaccatgcccggctaatttttttttgtgtttttagtagagacagggtttcaccatgttggcagtctgttctctgactcctgacctcaggtgatccacccgcctcggccccccagagtgctgggattacaggtgtgagccaccgtgcccggcctgtctgacgacattttcaaacccgtgtttcttaatcctttttagatccaagagatccttttggagatgggaagaattttagaagttgtctggtccaacataccttcattttgtagatgagattaaggctttaatcatgccaaacagtctattgctcttttcatgtttcc

SEQ ID NO: 18621 - DNA, 1051 bp, Homo sapiens
tactcgtgctttttagtctcccgtgtgaactgaattgttctgtattttatcttgctctgttatgggcaaaactaattcatgtcatcagtggcatttccctcttcactaggttgtaaatcctgtgaagtcagacacagcgttattttcatctttattttacccaaacacctacaattttcccccctcatgtgacagcctttgaaataagttaatcttccagaggagagaaaacactaaacagtcaaacataaggagagggtaaaggttttcctcataacctcacaattttcagtgttagctttaaaaaaacaaacaaacaaacaaacaaacaaacaaaaactctttatttgcaaatagtttgaaacttgaaaagttgcggaaagaaaaatagtacaaagaatccccagatggtcctttacccagatccacctgttgttaagattaaatccatttgcttaatcatttgtgtgtgctggaattctctgtctgcaaatacacactcatacggatacacatacagacacacagacatgggctaacaaatgcaaatatacagacatacaatatttttccaaaccctttgagatttcagggaagattacatacactgtagccacttaatcctaaattcttgaatgtgtatttcctaagaataggcatattctcttaaataaccacagtaatacgttaccactttcacaaatttacattgatgcagtacttttttctaacctgtccatattctaattttgggagttgaccatataatgtcctttctagaattttcccttccagcacaggatccagtctagggtcaggaaatgtatttagttatcatgtctctagctttttgtagtctggaagtttcccacagcctttcaggatattgacttttttgaacagcagtttctcctcccctcttttgataacattcctcattttaccaaacacctaaaataacatttgattggaagttaggaaggcttttggagaaggagatggtgaaaccagaacattttaatagcagttggctgtcctgaatttctgtgat

SEQ ID NO: 18622 - DNA, 1043 bp, Homo sapiens
tatctatattattaacaaacacaaatatgttattatatagcaacacagatactctattttcctaccttttttacaccgagagtgctttcttcttttaatagtattttgaagatctctcgctgtctgtacctaaagttcttcctcattttcccctagttaattctgtaatttgattgaaggtacatatctgtggagaaattattgacatgaagttataataaaaacacgcttaaaatctataacattttctcagatactttaaaaataattaagtaaaactaataaatttgaaaataataggagaaaaaaaactcagtgaaccgtttctgagcgttccagctcatgacttgagggtgtttgccgctgactcatgctgaagccacttggtgtctgcgtttgaaacaggaagtgtgtgttagtggcttggaatcttgttttctcctcctctcctcctctgctgccaagatttttatcaaatcatttggatttgtagtgttcttactggattgaccagctctaaaaactttaggctgtatatgaactgaaataagaaagtgtgcttagaagtatgatttaaataaacatttttattttccattgtctaggaagaaaaccttcctaaagaaaatacctgataatcctgcagaacattctgatttcttatccttaggtatcttccccacattctgaagtaaaaggcctttcttgttagtcataagataaaatggataacttttaatatatagcatttctaccttttttttttttttttttttttgacacggaatctctctctgtcagcaggctggagtgcagtggctcattctcggcttgctgcaacctccacctcccgggttcaagcgattctcctgcatcagcctcctgagtagctgggactacaggtgcatgccaccatgcccggctaattttttgtatttttagtagagacggggtttcaccgtgttagccaggatggtctcgatcttctgacctcatgatccgcccacctcggcctcccagagtgctgggattacaggtgtgag

SEQ ID NO: 18623 - DNA, 1023 bp, Homo sapiens
gcccctctgtgggctcctccgggacacagacctgggaatggaattactgggttctgtggaccgagcctctttagtttcactagagactgctcgtttgctatctaggattttaacagtcttcattcccatcagcagtgcatgggagttttcttgctcgtattaaaaaaaaaatcttgctaactcttggtgttggcatatttaaaattttgtgaatctgatgtgtgtagtaaatggactctcattgttttaatttacatctcccagattacaaacagctgggtactatttcattctcttcacgtctgctggcaatacggatgtcctctgctgtgaattacttggtttatatcccttgtccatatttttaaatcaagtagcttgtctttttcttactgattttaggattaatctttggttttacaggcatctgttcctagcatgagggctttaagcttcacatgttaggtgaaccctttttggggttgggtttttttgttgttgttgttggataagaggagtacactttcaactttaatgtcaactgaattgatttttttttccttatagtttgtggatttttagttttaaaaatatctttaggaaattcttcccatcctttagataacgaagatatttgtctgttttcttctaaaagttttcagattttgttttcacgcttcagtgtgtaataagctgaaattgaggcactgaattttgtatatgtgtgaggtggcatcgaactccctgcccctgtggccctggcaggtgcctcctcaccattcattgggaactcggcccttagctgtcctgtcagccccgttgggcagtgcatctcccctggttccgagtgtgctattctgtgggcctattgcttatctctgtataaacaccacacgttttattttatttttttatttctattttttcttttcttttctttttttcgagacagggtctcactctgcccaggctggagtgcagagtgcaatcacaattcactgcaactttgaccccccgccccgc

SEQ ID NO: 18624 - DNA, 1079 bp, Homo sapiens
aggtgtgtgctgccaggcccgggtggtgtgtgtgtgtgtgtgtgtgtgtgtgtgtgtgtgtgtgtggtgtgtgtgtttttaagtaaggggattttgtattttttcccacatcacactgatgtaaccatacgttttagttgctacaggttttctcaagtgtgtacacatgtggatgggtgggtacctgtttgcaagtgagtagacaaaaacttgagttttcatgtgataggaaagtgaaaagtgcaccgtatttcaagtctgaaggcctggggtcgcttcagttctgccacttccacaggctcggagggtttgggcacgttctttccttttgggcctcccatttcttttctctttcttttgttttttaaattgaaaaaatgcagaatgcttattcacgtcacagaaatgttgggaaatcagctaatgtatggtccgataactagtgagtaacagatgttagtagaaatggatgaaaagggtacagatggtaagttatgccaaaccttttattcacagaagacgtgactgtgtctcatgaaaatgagctcaagcttcagaactcgtagtgtgtgtgggcttatttgggcttttctgtttttcttattttttaacatacggtgaagtttggaggggtataaaaagagtttatcaaaatcacagtaacctgcaaaagggaaatgcaggctaattaacataatcggatggagttgttttccccaatcttcaggaatctgaattataatagcacatgattacacaggaactcactttcatggggcggcatgtggttgggcctgtgggtgtgtgagtggcgagggcgtgtcacttggacctgtgggtgtgtgagtggcgagggcgtgtcacttggacctgtgggtgtgtgagtggcgagggcgtgtcacttggacctgtgggtgtgtgagtggcgaggggagggcgtgtcacttctacagcacagtttggccttttatctctcaggtaacataattgccgctcaaacatgcagtgtttctaccatgtggctgtggcatgagttacaatctagtcgaatttttcatatgctttttctccgttgttag

SEQ ID NO: 18625 - DNA, 1097 bp, Homo sapiens
aaattttgtgtaaaaatagagtgattcaaaacacttttcatgcctcaaaataacacagctttctgtcaccagggggcatcctagtgtcattaacagaaaaagagggcattctatgtatcagtttctaaactgtcttctttgaccacagagggttttgaacgagatggaggcttcctgagacacacatggccgctgtgtccactgcccttatagacccacctctctgctccaggtgcctgccagcatcaatgctggtgtgtggaatggtctttgccttgcgggtgccaaggctagtgtagcccatctcagcatacagaatgctttcttctgggtgtcaacgtgatgcgtactaggttgccccctggtggtggagataagtgcagctgtcaactcctgaaggtgttggcttcttttgaattgccctgtgttttcctgtttgtcataattctctgggaagagaacttactgcgttactagcagagagaagcttttattgctgtgattattgaattggtgtgctgagatctcattggagaactcagctgaggaagccaatcaagcagcagctctcatacagtattgggcatgagacttacctaggagcctctgaactttgcggccctagggccgttcctgcactggcctttgtactgcagtgaacagactttgggaagtgctgcaccagaatgtctttttgttcttttgttctgccctcaggtagcagtttatctctctgcttaccttaccccttttcttcctaaaccttttttttttttttgagacagagtcttgtgctgttgcccaggctggagtgcagtggcactatctcggctcactgcaagctccgcctcccgggttcacgccattctcctgcctcagcctcctgagtagctgggactacaggcacccaccaccatgcccggctaattttttgtattttttagtagagacagggtttgttttttttttgttttgttttgttttggtttttgagacaaagtcttgctctattgcccaggctggagtgcagtggcgcgatctcggctcactgcaacctccatcccccaggttcaaacgattctcctgccttagcctcc

SEQ ID NO: 18626 - DNA, 1075 bp, Homo sapiens
tcccatgcacatcacttctttgagttcaccctcctccctgtgcagtgggcaccaccagctcccccagcctctggagttctgcttccccctccctccttccagcctgcctgcccttttcagtgactgcttcttggccctttttctccattctttactctgttccctctaagtcctgccttttttctgccaaaaacacgactggaatcttgccaccagtttgcacagttagtgacaggcctgcttttctctgcagcctttctgggtatcttgtgtttccatgacattagtttctcttccagtgcctgttcgactgtacagagcctgtgggcactgtcatggacctgcctctctttccagcctgctcagctgctgatggcaggatccatttctctgtgtctgtcactgcgcctgtagtatctggaatgttgtaagccctcagtacatttgttggatgaatggtttaggatgctttattctgctccctcccactacctccagctgcagcaagccctttgcagaggcacctcatcgtggcttcccttttagatctcggccttttctatttttgtgttttttaatttttttatattttaatttttgtaggtacataataggtgtatatatgtatggggtacatgagatattttcatacaggcatacaacaagtaataatcacatcaaggtgaatggttgtccttcacctcaagcactgcctgttttagatgttcctaaagcttgagataccactccttcaccctgcccttagcaattcagtgatccatcaagttccactgacctctctagtttctgatagaagttgatcactgtttcctgcatccagaagaatcctttttctaaagctattcacagctttctctcccctccctccatgttttcattctcagttgtttgtatttgtctccctaataaatgtgaactctctgagcagggcccttgtgtcactaatctctgtatatttccctccctcgccccctgccttgtagtccagtcctctctactgcatgtactgcagtgagcagccttggagaaatgctgtgttaggattcgtggtttt

SEQ ID NO: 18627 - DNA, 2054 bp, Homo sapiens
tagatggtcgtgacttcatgcataaacttgctgttaggtgtaatcgtcatcagtgttcttttccaggaactttctcttgttggggcaggattgtgctgccaccacccttcaccccccacagtcgggggctgtgattctaaagcatacgaagattcaggaggcctcgggaggctgtgtagctccagcctcctgcacactcacttgcacgtaactggcccctctcagcgtctgtattttttcttctacaaaaagatttctaggggtcctttcaaggtaaaatatattcagttctccgcagtagaacaccgttctttgggtattagtttcttttcttaagatagatgccttgaaaaaaaaattggccccttaatgctagcctggaagaaatcttcatgcattaaagatgaaatataaggcatgtgtccttcccttaacttcaaaatgtgtaactttttatcaaatataaggtgacattgatgcttgatttctgttgaaagacacaattgattctaaaacttaacctgatttcagaggtgtaaactataaaaatacgtctgtcttagcaggaatgaattatgtggattgtggttaactgggaaggaagtattgaaggcttcccaagagatatttaaaagttcacaattctaactttttcttttggtatttttggaaggctttaccacccatggggttaatccagtgtgaatttatttagaggacgtttgcatgtgttcatgtcagggccatttttcagacttaattgaaggttaccagcggaggagaccaagagatagagaattcagaagagtgctctgaagtgcgcttttatatataggattctttgttgttgttgttgttgttgttgaatctttttttgacatcttttttttttgtttttaaatttatactttctaatttctcctatccagtatgtataggattctttgcgtagttcatgtttttggaattaatcaaatcacgttaactacagaagctgatttaaccatgttttaagtccctaagttagttgtcatgatcttttaaaatttaagttgtccaaaatacatattcctttatctcaggcataaggcagctataagaaagtcagattccactggggggtatttttaaaattggcaaaatattacttgctttttattacaaatttattttaatttctaccttctgaaagccttccttagctagaaagataagtacaggcttctgcttttcatatccccaaattaaataataattttatagttgtttcattttccgcaaattgttcagcgtaagtaaaggacgtaatagatttgttgattaggaagagaacttaaggtttttattttcaaagagaaagtgagtaattactggtacttagagtttgtagaactgggttcttaactaatagttttctttctaaacaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctg

SEQ ID NO: 18628 - DNA, 1026 bp, Homo sapiens
tgaaataacatggttttttttttttggattgagtaaatggattttattcagaattttgatacaccaaggtcagctcttgaagagaaaaaaaatgttaagggttcagcccaaagttaatgttttattttagagtgctaaggctccaaagtagaaacaattcacaataaaaatagaaagctgcataattcacagattgtttttaaaaagttacagtaggaagtcagaaatgcagcagggtatgaaagaggtatgtgtcctcacatagccacgtgttgcttaactaagatggatatgtgttccgagatgtgcgtgttaacatcagagagtactacacaaatacaggtggtagagccttaggctggtggtgcagcctattactcccgggctgcaaacctgtccagcgtgttactactgaatactgtaggcagttgtaacacagtgctaagtatttgtgtgcctgaacacatttagacatagaaaaaatatagtacagatatggtataaaggatgaaaagtgcttcacctgtatagagcactcaccgtgaatggagcttgcaagactggagtggctctggatgggtcagtgatgagtgctgagtgaatgtgaaggcccaggacagtactgagcaaagccgagttttataaacagtcaacacttaggctgtactacgttgatttacaaatttttcctcaataagaaattaaccttaacctactgtaacttttttacgttttattttacttttaaattaaaaattctaaactttttgactctttcatgagaacatttagcttaaaacacacactacagctatacaaaaatattttcttcctttttattcttactttcctataagctttttcatattaaaaattgtttttaactttttaaacttaaaaagtaagacacaaacattagcctgggcctgcacagggtcaggagcatcaagacgccactaggcggcaggacgtttcagttccactagaatcttgtgggaccatcatacgtgcggctcattgttgacc

SEQ ID NO: 18629 - DNA, 1077 bp, Homo sapiens
gacctcaagtgatcctcctgcctcagcctctcaaagtgctgagattacaggcgtgagccaccgcgcccagctgagaatattatagtttcgtttctaaaattgctccacaaaggaaaacctcccatcttagggagattttctctatctttatttaaaataaccaagaaaagcttcatttaaaatgttttagaacattctacttagtcatatgactttaaatatagtttgataaatagtttgttatgttctgtatatgttaaagtctaattgaagtagctttgtcaaacactgaaagtaagggcctcttaatgactggtagtagaggaaagccttgccacacacagtccacgtaattatttttgtgtggacatattgtaaacccctaccaaacagattatttttttaatcctatttggttaggtcagttatgaagatgttttaattttctgagcaaaagtgtagtttctttaaaaatatataattcttttcagcctgtttgttgaggcttcgatagacagaacgtagttgttgacagtttcaggagtctcgtgagatagtagagcaatagagtcacattgaataacccttgggatcatatagggcttagggagaatggcattgtttgaaattttttttgttgttttattctcctacttagggatttactttataaaagtggtaaaacatactcagtttgttacaagtcagatccactaccacaaattccctttagtgggcacacttttaagtgtaggcccacttattttaagcagcgtttaactgagtgaaagtctagtttcattaaaagatctgttgatgtgggttataatagagtttgacttgcattagtatctaactgtttctactgagacagtggtatttgtgttattaacttttgggaaagagggagtagggaatgatttagacattaaatgtattcctttctgccaggcatgatagtgtggagattgaggcttgaggctcgataacttgagcccgggagttcgaggccagcctgggcaacatactgagaccccatctttaaaaaaaaaaaaaattatacacacacaaaatgct

SEQ ID NO: 18630 - DNA, 1052 bp, Homo sapiens
agagtttctgcagcccttggattgggctaagcatccttccccaccccccgccccccatctcccaacaccccttcagcttagcctgtacagtgtgtgtttggagccagggacatcacagttcgtcccttcactggtctgcgagcttgcctagggcaggaccaccttgcattcatctctgtgccttccttacccggtgcctaggcagggctcagcaggggtttactcgccttcagcgaaaggcagcatgttatttaacaaaggtttcagccacacaccatggctcatgcctgtaatccaagcactttgggagaccaaggcaggtggatcacttgaactcaggagttcaagaccagcctggccaacatggtgaaatcctgtctctcctaaaaatacaaaaattagccgggcgtggtggtgcacgtctgtaatcccagctacatgggaggctgaggcaggaaaatcacttgaacccaggacacagaggttgcagtgagccaagattgcaccactgcactccagcctgggtgacagagcaagacttgtctcaaaaaaacaaaggtttctatgttagaaagatagcaggctttgagtcttaaggttaggtttaaaaaaaaaagtcatttgatataaaaatactatggcaaagccttgttggaatcatgctggagttttcatttgagacactatgcctttacgtcattgatggttatttgaaaatgcacctttttaacactgcaatgacattagttgctgttctgtggcacacactagaaatgatagactgttgtgatgatatggtttaaagacaaatgtaaaaatccactgtcaatagactttaagcctgtggggaaaagtaagtatctgaaaccttggaataaaagggatttttaagtgaagccccttatatattgaggaaagggctcaacctcttgagtcaggtggacccaggttcacaggtcatttcagctgttatgtgacctcagttttctcatctgtaaaatggggttggtaactatctctgacagtagggttatgataattatgaataatat

SEQ ID NO: 18631 - DNA, 1026 bp, Homo sapiens
gaaatgatttgaatgttcttcactagatgtcatcaatttctgaaatatgcttcttcactctttcagagttgctggagaatgtaaccctaatccataaaccagtgtcgttgcaaccccgtgggctgatcaataaagggaactggtgctacattaatgctgtatccttcctggacgccgtccgcaaggccagcttgttgcagctgtccctcctttgggtgcatgtgacttagctcagcttccgtgggccatctagctctccatttgaatccctaagtctggtttattacttggtctgcctaccttgcttataaacaggattattcctgaccccagtccatctccctctaaaagagaggatatgttggcacgtgaatgagggctgcagacaagctggctctcattagaatagtcacaaataatagggcagagcaaccacttacaactggaaatttggttttaactgattgaactgtcttggttaggtcaagttcttgaatacaaacgactgactgcttcgtagatccttatatggacatcacaggacacttaccctagtaactatttggtttattccttttcgtggtgacatatctaagtagttcaacgtccttagcttccttgtgtttttataaacattcttgtgcttcatgtgccttcaggaaatgtggtgtgtctgttcatttcctttacgcttccttactgccactacatagacactgcaggcattggttgcttgcccgccgatgtaccacctgatgaagttcattcctctgtattccaaagtgcaaaggccttgtacgtcaacacccatgatagacagcttgtaagtaaggtggtgaaagatgtgttaagtggtggggtttttcccgtctgataattagaattgaaatagtttagtaaagctcttgatttcctgcaaatgagtcctataattctgtctttttttaaaaatagactgttggcgattttatatggaagttaaccagaaatggaattggagcattgatgatctgtgttctttagatt

SEQ ID NO: 18632 - DNA, 1004 bp, Homo sapiens
tttgtgataaaggtaatgtggccaggtgtggtggctcatgcctgtaatcccagcactttgggaagccaaggcaggcaggtcacctgaggtcaggagtttgagaccagcctggccgacatggtgaaaccccgtctctactaaaaatacaaagattagccaggcatggtggcacacacctggagtcccagctactcgggaggctgaggcaggagaatcgcttgaacccgggagctggaggttgcactgagctgagattgcaccactgcactccagcctgggtgacggaatgagactttgtctcaaaaaaaaaaaaaagtatatttattgaagaaaatttcaaaaatacagaaagtataaataataaaaatccccattagtccacccatttagagatatgtgtttagtcagtttctccttttcctcctactcttgggatttcagctatgcaagggaaacccatgtcatcatgtcattgtttggaaatactttacatcttccatttcagaggaggcatggttggactttgcaagtactgcatgtcctgcaggcctttgacagtgatcagttcacagtaacgtgattatatttgaccttttcagggtcgacaagaagatgctgaggaatacttaggcttcattctaaatggacttcatgaggaaatgttgaacctaaagaagcttctctcaccaagtaatgaaagtaggttatggtccacttgccgcagagttgtgcaagagttcgctgtaaacaggtgttgcatactcatatgttatgttgcttccctgcccctcagtcgttttcctttcaaatagcatttattccctacgataacttacaccatcgagaaggttatatttaggtaaattacagtttatcccgaacctctgccattttcctttaacttttaattaggaaaatgatcaagcctataaaaaagctgaaagaatcgtttgatgaatacctttataattgccgagtgtacagttttaaacatattttctgat

SEQ ID NO: 18633 - DNA, 1050 bp, Homo sapiens
tgtctcctgttgttctgtggtcaggatacgggatcatttgctaggcactgatttgctgaacacagtagtatttcgttgagtggcccttccttggaaacaactggcaagtaagcaaacctggaaatcactgttctgtgctgtattttcagtaaagggaatttacacagcgcttgctgctgtgggatttgcaaactattttattttgactctaggatttcacacagtgatatgcttaagatattttttataattttttttttttttttttttttttgacagagtcccactctgtagcccaggctggagtgcggtggtgtggtcttggctcactgcaacctccgcctaccgggttcaagcgattctccctcctcagcctccctagtagccgggattagaggtgcacgccaccacacccagctaatttttgtattgttagtagagatagggtttcaccatgttggccaggatggtcttgaacacctggcctcaagggatccacccacctcgaattcccaaagtgctgggatcacaggtgtgagccaccgcggacgacctataaaaacttttatccctttcattttctcatagactcccgtttaagttcttgctctgttttgggggaaagtgtttattgtttgattttctaataacgaaaacattagagtagcttcatttatgctgcctgtttcaagccaatacactgctcagttgtgtttgtgtatttgaaaagtcccctgataggaactttctgaggggtgcctgtgttgttggcacatttgagaactagacaaaatctaactctgtgtcttttttctttctttttcccctattatttggttttgtttttttaacaacccctctggagtgtgttttggttcatgggatcaggccacgtgccctggttttcgaggtatagccttggctttcttgggtcgggtctaataaccctgaccttggacttcccacgtgtccttcaaagaaagcaattatttttgcctattttctgagtatgatggtattctccatttgatttaacaaaaaaattcttcc

SEQ ID NO: 18634 - DNA, 1240 bp, Homo sapiens
agcagtgcagcccctgggagtcagaagagctgcagttcccaaaagggctgaaactgggagaagagaacaagttttggagcaagactgaccccagttcatttgttccttaccatggcgctgcgaggccttctcatctcattttatagatgagtcaaccaagactcagataagtcagacaacactcagtcagtaggtatctgaggcagatttcgaaattctgccctttctcttgctaagtacctgtgagttagtttcttatcctggtggaatgtcagtttccttggttgagaagtggaaacataccacttgctttgtagggacatggtgagagttcaatggattgggggaaatgtaagttcccccagagggtcagatgcttgacatatagtgggaccctcgtgtcctccaccctggtgcataggagcaaattcttcttggatgtgggttggttctgtgtgcgaggtgctggcttgcaggctgggtgccagttttatacctggcagtggtgtttcaaggggcagtcagaactctctgcaaatcctcaaacacagggttttgtgcaaagtatccaaattctggtgtattttctcatgtggatttgctcacgtgtcaggagttgatgggatgctgcccgtcggccttgactgataagaacgccaggaaacaagaagccgccgtttcccaggcagctgggaagggggagtggacagtagtctggtgtggacgggaacgcaggctggtgtctgcccagaaggggtcagcatgggtttggtgaggtttcatgtggtatggatgtgtgctctgttccctagaacaagttagtgcattcactccttatcatggctcttgaggccttcttatatcattttatagacgagtcaaccaagactcagagaagtcagacgacacaaagccagtgggtatctgaggtgggttttgaacctgcttctgctccctacgccctcttccaccagctgcctggaggaggtggagcttgagtcaagcctcagaaaagaggtagaatttgttggaatgaggcaggcaaacaggcccagaagcaggggtgacctgttcagcctccgtgggcgggaggtgcctgttggggatgagaggaaataaggttggagtgaactccaggccttgaaatcaggaataggaggttggatttgaagttgaaggctcaggggagcaataacaatttcttgaaagaaagtggaacggactgagaagagatctgctc

SEQ ID NO: 18635 - DNA, 1077 bp, Homo sapiens
gggagactgaccctccacccatcgtgagattttgtcctgatttcacatttcacatacattaacatgtaaaacaggttgggtacagtggctcacgtctgtaatcccggcagtttgagaggcaaggcaggagaattgcttgagcccaggagctcgagaccagcctgaacaacatagtgagaccccatatgtacaaataattaaaaaattgtccgggtgcggtcgctcacacctgtaatcccagcattttacgaggccgaggcaggtggatcatgaggtcagaagatcaagaccatcctggccaacatggtgaaaccccatctctactaaaaatacaaaaattaactgggtgtggtggcgcatgcctgtagtcccagctactagagaggctgaggcaggagaattgcttgaaccttggaggagtaggttgcagtgagccgagatcgtgccactgtactccagcctgggcgacagagtgagactctgtctcaagaaaaaaaaaaaaaaaatttagccgtgtgtggtggcgcatgtctgtggtcccagctagtcaggaggctgagaatggcctgagctcagaagtttgaggctgcagtgagctatgatcatgccactgcactccagcctgggtgacagagtaagaccctatatcaaaacaacaaaagacaaaaaaatctaaacagtctgagtcttcaaatcagtgaaatacagtaaggatgatgatgatggtggtggtgataaagaaatagcagcgatggttgccatgtatcgattacaagacattatctcactgaccctgtaaacaggaccctctgacgggtgtaccagggaagttgacttcctctttcccaccagcccctcagggtgatttggtggggtctggatgaggccagccctgctgagcatgtgctgggccagcactggggttggtgcagtgacgcagccacgcttggtgtctctggggagtggtcctccttgaggtgcctcttgtttctgtcgcctccaggtctggagccggccagtgggagcgactcagctgcctggcaggctctgtggtgtccaggtgcctggagcttgggg

SEQ ID NO: 18636 - DNA, 2142 bp, Homo sapiens
ggctgcagtgagctatgatcacaccactgcactccagcctgggtgttagagtgggaccttatctctatcttaaaaaaaaaaaaaacaaaacaaaaaaacacaggagtttacaaagatccatcatcctcatcactacctctgttcttacattcacctttcttaaccctcaaaatttaatgcaaaatctggtgcatatgtgcattttctggagagaggatcagtggcttttatcagacttgctgtgggggacatgtgactcccagaatgtaaacaaccattgttatagacacatttccctgcacacgctccagtgctgccggaagcctattcctcaccattccttgaagagccaagcttgttcccaccattaagtcttgacacatgctctttctttcacatttctgcctattttcctgctccggggagccttctttgctggctcctgccagctgaagtttctcttccctctcctggctgacctagacacttatctgtatgtagcatttttgacatttgataataacctagcactttattctatttgacttcatgttgtcttctgattgactcatatgtgtaagccctgtttctccaactagatagaaaaaatagctaaaatttgaatttttacccattgaccctctattgtttttcttttgtgcattgtacacagtgattccttgccagctgtgggagtggcattcctgaaaagcactgcacttggcaaaatcacagctggcaagatcaaagtctcagtgaaaatgggaggttagggaaaaacaataaaaatggcattaagtatatgtctttaaaaaccacagtaaataaaagttctaagagacatcactgccaaaacaaaccagatttgtccacatttaaaaacctgttccagttggtaatctttttctgaattaccttcttaagtagatgggaaacttggccaatgtcttgatgtactgacaatgagaattctcccatgaggtttatttcttcttaagtcagttttggtgatttattgttttcaaagagcttattcattttgtctaggtagtcaaattagttgataaaactttgttcttaatatttctttattatctttctaatgcctgtaggttctgtaatgatgtcccccctttcattcctgatattggtgcctactcttttcttaaccagtataggaattttattaatctcccaaaaggtttatattttagagatttacctctttaaagtttttgaaccagttttttggggggcttaagatgtatcatcttttgcacttgtcacctatcttgttctgtttttgcaaatctagaagaaatgtgtatgaaaacaccgggactgttccaagttatctaggtctaagggcacacttcccaagcctgatcttctctctatgcattgagccagtggaggctaaagcaatttctctctatcacctgcccctgtgatggacattggtgaagtccagatggtgtgtcctttggcttgagtggattttatgaaaacttggataagtaagaaagatactaaactgaaatattttttaatgcagaaaagagaactactttatctcagaatcacagatcataaagaattgctggctctctcatatattagtggctgtgttatttggagcatatgcatttaataatattgtgtttcatttcttatacaaagtatccaccatttaaagtatttgtgaccttctgtgcttttgctacaaagtatggtttatccataaccttgattgaaattccagtttcacttgtctttgtatttttaacaaatatgagtgtctgttgagaatcacaaaactgggtgaagttgagtctaacactcttcactttaacaggactccaaggcccaggaagggaaagggacttgcccaccaatacggaggacttgcctccaacttagcctgtcagaggctgaggcagaatgccagtgccctgggaatttctgcttcatcagccaagactgtccctctggcaatagatatcctggtatttttacattagcaatttgaggggccatgggaggtcagccccagctgccaagcctgtgtgggattcctggcccagggcacaaagggcggactcaccagggtggggctgatggtgagcagcatcctgcagaccc

SEQ ID NO: 18637 - DNA, 1152 bp, Homo sapiens
gcgtgtttgtgtgtgcgtacatctgtgtgtagcctgcttcatttttgaaaaaggaaatgaggctctgggaggtgaaggccttgcccaggctcatgcggccagtatgtggcagagctcgactctgactcaacgacgtagcagagcttcactctgactccacgcccctgaatccgttcaggagaatggtcaccttctctctttgctgctgttcttggactccgtgtccgggcgcccttgtggtctctgctgcagctctgggctgagacccctggccctggatagactagaacccaaaaatcctagtcctgggatgctggttctttcatttcatagatgaaggagactgtggcttagggaggccagtggattcgcttaacgtcacccaggaggtcagaggctggtctgggactatttcttctagatgtgcacaaggcagtaaccacaatgagcttctttttctaagaggtaaaaagaggttgattgcaaacaatcaggattcagactggttaccagggagacaggggccattctggaaggtttttgagcaggagatgactctggaagtatgggaggtgaccgtggacccttagcagggccccatgtgtgtgccaggaagactaatgactcgagtgttgggattttttttcccccttgctcaaatgcatttgggaaacagttagattaaagacagttaaccaggagctttggctgcaggacttatcagtgcctttaatgcacggatgtctactgtgttggacttctgttctgtgcagtgtgtttcaggaaatggctgaaaagaccttctctccagggtgcgaatctgaagttctgctgccaaggttggggtggacacaagtgtctacagagcaggatccaaggtgcctaggtctgtgtatttttttttaagaagaggctaaaagtgagtggctaaaaatggctaacagtgagtgttcggggcagtcatagctcagccagggccggtcgtgaggccagtagctttcagatcatcataaagacttgttcccggtacaggaatcactcaggagatttgtgaggtgggaaaagggagaaacagacctgttcagactccaccatccaatcgcaggcatgtacctctgcctacgtgtgaggggagaggaggaacaggcatag

SEQ ID NO: 18638 - DNA, 1051 bp, Homo sapiens
tcccccagggagaatgacaaagggatctgcccttcttggggactcctgtttccccagcagcaagctgagctcacagggtggggctcacatgtctctgaattccctgctatgccaggcctgccccccagtcccccacacccagccagccaagggtgctgtgtgctcacagctgtttacagggtcgtccgcctagggcctgggactggggacagaccacaagctcagagttctggagtccatgcagttgaagcccctgggccaggacactccaaaagggaatcccttaaaccccctagaatgttcctgaaaggtaacttgcccaaatcctaaaagctctcatttgctgggcatgtacacgtacgtcttggctcactggatctccccgcagcccctgaagaggtgaatgctgtcatcgttgtctcctttaatttttatttatttatttattttttatttttttgagacagagtctcgctctgtcacccaggctggagtacagtggcatgatctcggctcactgcaacctccgcctcctgggggttcaagctgttctcctgcctcaacctcccgagtagctggaattacaggtgcccaccaccatgcccagctaatttttgtatttttggtagagacggggtttcgccatgttggccaggctggtcttgaactcctggcttccagtgatccgcctgccttggcctcccaaagtgctaggattacaggcatgagccaccgcgcccagccttgtctctgttttgctgataaggaaagtgaagtgcagagaggttagaccactggcctgaggcgacccagcagaaacaggagttgaggtcacagcaggctgggctttgtgtcttcactgccttactttttttttccttccctagtttccctcaaacacactcatcccccacagcccctctttggctccagggctctacactgggggtaagaggcagctgtggaggcccctgcccatctcccctgccctgggcagcatgcggtgtcccctcctcagtgtgagtgggtgtcccatgggcctgccttgtgg

SEQ ID NO: 18639 - DNA, 1069 bp, Homo sapiens
gtcacagttgccttgagacagtaatacccgggcccttctgaggcctccctctctggcctctgtggccccgcccggtcccctctcacagaccgcgtggggtgcaggcgactagagcctcctctgcatggcctggtatcctaggcagggttggcaggcctggcaaaacataggtctgcagtgagtgagaggatgcaggggccctcgtggatggacaggtgggtgggggtggggcaggaggagaagggcagggctgactctgagagcggaccctgtggccacaggagggctggccccttccctccccatgtccattcacccctccttgcccggtcttggcctctgcgggtggcgggtgggtggagacacaatgccaggcgcaaggcccagctagagtgcccagagaagaaagagctgagtgtccagagccttggggagtaggccaccgttaacactgacccctgacacaggctacacagacatgggattgtggccagaagttaagtggttaaagagctttgactccgaattctattctgtggagtcagatccctgctcctcagctctgaaaccctgtgatttgggtcatttaactgctgcaagcctcacttgtgtcatctttaaaatggaggtgcgaaataatatctgccaaccattattctaagtgaagtaacataggaatggaaaccccaaaaccatacgttctcacttgtaggtgggagctaagctatgagtccacacgggcaggcggagtgatatcatggacttcagacactcagaaggggaagggttgtgggggggccagggataaaaactacaccttagatacagtgtacgctacccagttggcaggtgcactgaaatttcagaattcaccactgtataactcattcatgcaacaaaaaaccatgtgtatcccaaaagcaattgaaataaacattttaaaaaataataatatctgccttatagagctgtggtggcagtcccatagatgcctgttagagaagtgcctgacacgcggctgttgtttgttcactcagcaaacattcacagagtgcctgctgtgtgcccc

SEQ ID NO: 18640 - DNA, 1050 bp, Homo sapiens
aaatcccaaaacattttcccctctgggccagaagcagctcggcgttaccccgcacctgggatttcaagagctcttcctggtccgctttccagtgggtggctgtgaaaatggcacttggtttcagttaggagctgggggcaggcgggggtctggtttccctgctcctggaggaattaccggaccacatgttgccaggagccttggctgggagaggcaagcgaggctccaagccggcgagcgggcggcggcgcagatggaaactcgatcacccccggctcagcagactgtttgatttattttaaaatcaagcagatggctgcaacaggggtttgtttaagttcagctcagagccgggcccgcggccaggagcctggggcagctgtgccaaaaatttttcaatgactttggtcgtcaaaccacctcttcccctcccttttgaacttcagcctccccacacaggcgggcttctcgggcctgcccgctgctgcccgctgctgcccgcttgccctggcccgtctcgctttgtctctgtcttgctgcctggagtccctggctttgccactctcgtgctctctcgcgctctctgcacctctggtgtctgcctctatccctttctctctccttgcttcggtttctctttttttgtctctccatctctctcagtatgtgtctctgtctctgattcactctctcccaccacttcctccccatcccttttccgttgcaggaaaccttcccaaatcgtgccccccactgcttcctccagcttcctcctaccttgccccccacccctcctgcccaccccctcctccagtggcccctctccccctccctggcccagcaaggcacatgggagaacagccaagcctttgtggggattcagcgtcctccgggctgccccctctccgagaccctgcggctgggaaaaccaggcccccagccgtaaaatcctggagtcgaccagacctccgaggtcaagcggtgcagcccccgcccagaggcagggaggccaggggcacaggcctcatggtcacagggtcggcatctgca

SEQ ID NO: 18641 - DNA, 1073 bp, Homo sapiens
gcctccgtgccagcatccagatgggggctgaggacatctgttgacctaccccagcccagctgcagggagaaagggctggatggtgaccactcaagcacacagaggcggggcccgacacagcttcctggaggaggaggcctaccgcaaggctcagggctccatctggccagcacttaccagaaagggacggagatgaggcagtggaggagggggctggtgtccccgtgtgagccccacaggacatagggggccctgcggggcatgggcagcccccccgcagcagtgctggtcatctttggtggcgcttccagactggggctcacggcagcccactgccctcccatggtacctggacacctgacagtctagttgcctctggtcttgggtcacaccacggctttaatttcagtgaccttgactcttgtcaggtgaaacatttcttttttatttttcctttttctttttcttttcttttttttttttttttttttttgagatggagtctcgttctgttgcccaggctggagtgctgtggtgctatcttggctcactgcaattctacctcctgggttcaagtgattctcctgcttcagcgtcccaagtcgctgggattacaggtgcccgcaaccacacctggctaatttttgtatttttaatagagacggggcttcactatgttggccaggctagtctcgaactgctgacctcaggtgatccacctgcctcggcctcccaaagtgctgggattataggcatgagccaccgcacccagccaggtcaaacatttcaactcagcgactactctggtaggagctgttcccagggcaatgggggctacgccacagggccctttctggccccccgtgctccctactccagggagctgctgttcccctgcccatgtgcccaccatctactctctgcttccctgttgcccctgcactgtactgggagcccccacccctgcatgacatctgcagtgatgagcgcatggggcgtggcactgagggctcagggagtccatgggtggcctctgtgccagcatccagatgggggctaaggacatctgttga

SEQ ID NO: 18642 - DNA, 1789 bp, Homo sapiens
ttgaggccactgactttcggcagtgtccacagggcccagcagatgctttcggacagatcatcccacggtggatggctgttcaggtgcacgctaagcactttgtatgccagagccgccatcgtccccagtctacagacaaggaagctgagggggttgagaatgtgcctgtgtttctgcagctgggcagcagtggggcgtatcagcacctgtgatttggtgcccgctttggctgtccctggggggctaaaccctcgtgtgtatcctgagatatgtgtattttctcataggctctcccccatgccttatgtcgggatgtttgtctcccccactttacagatgggcagactgaggccgagcaggtgaggtgacttgccccaggtcacacaggttgcaaaggacagagcctgttttgaatccagagcccagactcttaaccacttcactggcatctccccggcgggtgcttggaatgccccaaacaagaagcctgctcttcaagaatgacttctttctgaaaactgacgatgacaaattatttatttaatggttttaatttatccccctttcctcagagagtgtcagaggcaatctgcttccttctgcctctcagagcctccccgtctcttgttagtggttctgctttgaacatatttccttttatcatgtggtgacacgcggtggcagagggcgattctgggagagattgtcggggagggggccagctagagtttgcatcgcttttgacagctaattagctgtgtgtctttgcaccggggggcctctcagatggcaggcatcatcgtcacggccctgaagccgcatgccgggacttcagaggaagcatgccttggcctccctcctccagccccacatcggtgatttctagggtaacggtttccattttggccatgccattagactgtgggcttgtcagcaggagaaggacgcaaggccagaacgcctgatccctagagcctgaatttgccaacagatcacagggttctggatttagcaatcagaccagagtgggagtccgagactccatgtgtgaccttgcacaagttctgatcctccccacagcccagtttcctcatccgaaattgggtatgggagtgatgcttgctccgtctctcacaagcttgccgcgggcaccagttggaaaatgtgttgcaatgggagctgaaaagaactcggcgagcctctgggttcctccattctgcaattcagtgttaattgactaccgactgtatgccaggccccgttctaggctcagaggatagagcagtggacaaagtggacagagatccctgcccttagggagctgagcttctagcagggaaggagacagtacaggaatagataaataacacacggatcccacagatcgcgggagggcgggggccgggctcgcttacagcactcctgacagctaattagcgacgcgtagtgattagaggcttccagaagaaggaagctcacgcttggagagtgcgggagggaagagggttgtagcttcaaagagtgtggtcagaataggcctccctgagatcatcatcatcatgatgttagcatcatgcttgtttagcaaagatcatcaaaccttttttttttggcttgttagaaatacacagcctattaatttacaatttttagggcagggattgtgacgctggagtgtgcatcagaggcccccagagagccggggaatcaggctgctggcagtactgggagtttctcactcagaatctgcgtctctaacaagtttccagttggtatttgcgctgctggc

SEQ ID NO: 18643 - DNA, 1050 bp, Homo sapiens
ggtgtcccagtgtgtgtagagtcaggaaaacgatgtgaaattggcccgtcccctgtggagacccctggtgtcaggtgtgtgtagagtgtgggtaaccaggaccgggaggggtgagggggttgggctgagtcctcgcatttggagatcagacgccctgggtccttacaggggttcccctacttccaagctgtgtgaggccaggcaggtgacttggcctctccgtgcctcagttttctcctctgagaaatgggacagtcacatcacgacagcctgagagagctgcggtgaagagtaaacgagcaggcaccactgtgacacccggagcagcgtctggcatgttgtaagtacgcagtaaacgcgcactcttatcactgcaatggcgggggccgcttccctgcattggtgagttgggagagttgcaagggggaatataattttgttattcttaagggcaaacaagtagcagaattagaatgagggcctgcgggtaaaggcctggagtgtggacaggacgctgagaccagcctgtttgcaaagggagagcttgtcaccaatcctgactgcctgcctgcaagccagtttcataaacggaacagaaaggagttggcggccacctccgctgggtggaggcagacatgactgctgctaaggaaggctgattgctcagagttgctgtcctccccctgttgagtctcgaccgccccagacccgcgctaatgcaccctgtggacctcactgctgacatcgttgccccagttcaggccaattcctggccttttctagaatatgtccggactatatctcataactgggcagacccctcctttgtcccctggtcaaactcctcatctcgggcataacctccttcaggaagccttccctgattgcctccaaatcagctgactccagaggctgatgcctaccctgctattgctgggagcaggcactgaaagaccatgtgtttggggcaggttctggttttcatgagggaggaatgttttgatcaggccattggggggctctctgctgtgctcaggacctggggtgccc

SEQ ID NO: 18644 - DNA, 1059 bp, Homo sapiens
catggtgcagcatggatcaaccatgaaaacgtgacgctgagtgacagaagccagtctgcagaggccacagtgtatgagtccattcgtatgggatgcccagaacaggccagtccatagggtcggaaagcagactggtgctgccaggggctgggaggaggaagaagaggagtgactgctcatgggcatggggtctcctttttggttttttttgagatggagtttagcccttgtcgcccagtctggagtgcagtggtgcgatctcggctcactgcaacctctgcctcctgggttcaagtgattctcctgcctcagactcccaagtagctgggattacaggtacctgccacgacactcggctaattttgtatttttttttttttagtagagatggggtttcaccatgttggccaggctggtctcgaactcctgacctcaggtgatccacccacctcggcctcccaaagtgctgggattacaggtgtgagccaccacacccatccagggtctctttttggggtgatgaaaaagttctggaagtagatagaggtagtggctgcacaacattgggaatgccactgaattgtacacttgaaaatgggcaattgtaggctgggcacggaggctcactcctgtaatcccagcacttcgggaggctgaagcggctggatcacgaggttaggagttcgagaccagcctgaccaacatgatgaaaccccatctctactaaaaatatacaatcagctgggcgtggcagcagccacccctgtaatcccagctactcgggaggctgaggcaggagaatcgcttgaacctgggaggcggaggttgcagtgagctgagatcacgccactgcactccagcctgggtgacgagaaactccatctcaaaaataaatacataaataaataaaataaaataaataaaagagggaaagagtgtattgatgtatttatcgagcactcggccagatggctttggtggctctcctaaaacctggctcaggcatcccagtggctgtgcactttgctacctgtcaggtttaggaatggcctcaggagt

SEQ ID NO: 18645 - DNA, 1006 bp, Homo sapiens
ggcgctgagccccatgtccccagcagatggcgccctcggcctgggaagggaagggcttggctgggaggagggctggtgatggaggaagccctccctgcctgttggcggtctctgctctctggccccgttcacttctgcacaggtgggtggaatgcctcatgctgcagagctataggcaaagtcagagggggtgctttctatgtccttggcctcagggtccccctcccagcgatgggcaaacagggactgataagcagttgagtcctgtgctagcacagtgccacagaaaagatggtcctggtagatttccttggggtttgcctccccactttacagatggggaaactgaagcccagagaggttgagtgacttgcctaaggtcacacagctgggagcagcaggccaggcctgttgtttccgccttgcggcgcagctggaagaccctcctggtggctgccagcccatgctgagcattgctttctgaactgtttgagcacctgacttgaatctccccgcttgttacaacgggtactgctgcagaaggggaaactgaggtaggaggacttcaggaaggtgtgccccaggagcctcagagctggtacgcactggaccaggaagtctggcttacagcttggccaggtcagcgatttgttcacccagcggttttctgagcaccgcctgtgtacactgcctgctgccccagtgtatattgggtgaatgaaatgaatggaatcggctcctaagtcactgagcaggttcagccaaggcagggcctcagggagcaatattaaggatgtttaatccagaaagggcccgggttcggggtgacctccccgtgatgaccatgaggggctagtagaggcaagtggccgggaagggcgtggaggatgcttcggtggcgggagacaggatggacccaccacgctgctctcagcgtgggccagggcaggggccggggaggtgtgtggggtgggacctcgctcgtggcccagcagcaggatgtcac

SEQ ID NO: 18646 - DNA, 1064 bp, Homo sapiens
tcacctccacaaagccttagagctggacatgatcttccaggctgtcagttctgaacctttactggggaggacatccgaggcctgcagaagccctgtggcttgtcccaggtcccaattagctggggacacaagaggccctcttgacagcaggcaggtgacggctcctctgagaacagcactctggatggtgacgttcacaccctccaaaccccggccaccagcagctccaagcagttccaggcacgagttaattaaccctcacagcagctctccaaaggagataattattactcatatcccctctgtaggtggctaaaccgaggcccacagggatggggtgagtgtcttaaatgccagatgagaagttaccttgcatcggagcgccgtctaacctgcctcttaattagttggggctaagaggccccagtgactttcaaggattccatttttgttattttcctctaaaaacgatatgcaatgctccagaaagagaaaaccctagaagaatgtaaaactcaagttccctcctacctggtcaccgtgggcaaaaccaaggtgcatggacgtggttttcagggtgtcagcccacttcaggttataggtggtgtccagtgatggggtgggaggatggagagcatgtgcacggggttagtgttgcttccaagcttatcattgccactcttgatttcaggagctctggaagcaaagcggaatagattcacgttatctgagcaggacacgcccaccacagcatgccagcattattttgccagaaacctcacagtccccaggtttgccacccacatgcagagccctgtgtagggtcttagatggcacagatggtgccgggtgccacagccggggttatcctgtgagttgctatgttttcttttcttttttttttttttgagacagaggctcactctgtcacccaggctgtagtgcagtggcacgatttcagcccactgcaacctctgcctcctgggttcaagtgattctcctgcctcagcctctcgagtagctgggactacaggcgtgcaccaccatgcccagttaatgtttgt

SEQ ID NO: 18647 - DNA, 1719 bp, Homo sapiens
aaggccccgcccgcacttccctgcacaggcctgccctgcctcagcagacccgggcccctgccatcttctcatcacaaggccatgtccacgtcacccccaggcccccaacctggagtgcggcagccttcaaggatccctccccatgacctccagtgagctccgttccattgggtactgatcccatcaaatgacatgtaagcagttctctttctgcaacctcgatagacactaggcctctagggggcaaggagcatgccttaaaccctccgtcacttgcttggccttctgtgtgttcattccacagctgccctgtgcagttgtgcagattacacactgcccaaggaccaaggacgcagaccaaaatccaggccacacagcacacaccatgccaggtgttctggagcaagggagcacctttttccaacatacaccgctgtttgtaataatctgtaataataactaactcttcatagagcctttgttgtcaccgagacacacaaagataggagatggccacccacgagctgtccggtagattctgagttgtttcaccttgtcatgctgaccagatggccggccagtgccatgtcctgcattctctcctgctcctcagcctcaccagctcgtgcagtcccctcgtccctgagcaggccagtgtgggagccccacccagcctcccctgagagcaagcagttggggagtgtctgccgggtccccaagcagggagcagggaagtgcccgttctcagtgtcagagccgtagcagacagacatgggagggggctgcaggcctggaataatcacgagaacagcaaagcctgattcaggcagacactgtccacacatgtgacatccagcatttcatggaatccttacagcagccctgggaggttggcactgtcattatccccattttacagaaggggaaactgaggcatgtagtgggtatgtccctcacccagggtctctcagcagagctggacaccaggctgcagatccaagctgaggtctcctgatcaccttgagcctgctcagagcttgagtaggagccaggcgtccctcctcaccctcctcctccctgtcccaagggtggcaccagcccccctgggcagcccgctctgcagaagggcgcctttgtgcccatctggcttgtgctggattttttccttcctgaatccagcagcattttctggatccttctcttccactggacctgctaccaccctcggaggggacgccgccctccccagcctcctcccccggcccccgcgtgagccctggtgtcccatggggtcgaataaagggctgtcggccctggcagggcagacttccccacagggctcagggccggcttgtgcgcagtgtgtggccaccgcctggtaaggaggctgggcctcgtccccgcccttttccgcccggccagccgcagctgctgacagagcccagctgggcccctgaccccggggagaccctccctacactgccctcaccctgtgggggttaggggtgaaggtcaggctgggggcagaggcccagaggccagaggccacctcccaggcctctccgtggggcccataacctcctggttgtctgccttcctccccatccccccgccagcacaaaacactcgtccctctcaccacaaagggcccttatttccctcctgcttttattagagccggctttgggttgaccgggtcaggctatggggacttacata

SEQ ID NO: 18648 - DNA, 1406 bp, Homo sapiens
tggctaattcgtaactttttttttttttttttgtagagatggggtctctctgtgttgcccaggctgatctggaactcctgggctcaagtgatcctcccaccttggcctcccaaagtgctgggactacaggtgtgagccaccgcacccagcctaacttgggactttaatggtcccttgctttgggcccttatttgtaaaaggaagggcgaccgtcactgctgcactgcaatccagccttttggagcacccatccaggaagccggcaccacagctctcctcggagccagtttggatcagctttgcaggctgagaaccaggaggccggcttgggaaatgtagggatgaaagctgtttcaaggctgaggggggatgtgggagcggagaggaggtgatttctgaactgcacaaggtacgaaaggcacgctagggaaggggacagcctgtgcgaacactgcccgtccctccccgtggccagtctctaaccacctcccacgcacggctcatcatgtgtgagcacggacacccaggcacaaagcggggtcaggtagtttcattaaaacaaaacaaagggccgggtgcagtggctcccgcctataatcccagcactttgggaggccgagctgggtggactgcctgagctcaggagttcaagatcagcctgggcaacatggtgaaaccccgactctgctaaaatacaaaaaaaattagccggatgtggtggtgcacacctgtaatcccagctactcgggatgctgaggcactagaatcgtttgagcccaggaggtggaggttgcagtgagccaagatcgcaccactgcactccagccggagtgacagagcaagattccttctccaaacaaacaaaaaccaaaaacaaacaaacaaaaagtgtgcagcatgaacccatttctgagcgcccttcaacttcttcctctgtgcaaacgacctgggctaacgctgactgtgcaccgattctttcagagccttggcttccctccctttcatgtcctaactccttccattcttacagagaccctgggaggaagggactgtcacttgctgcatgtaacagtcggggagactgaggcatgggccagtccacagcttgcctggagtcttgcagtctgtgagggcgggggtggggtctgaacccagggggtctgtcggcacgcccaggctgctcccccggcgcttccccggccagtgcccgatctttcctcctttgacctcactctgtgcctgctgggtgtggactgcatctttattgacttatggggcttgggaagtcccaagccttcagaacagtgtggggcaagggggattgagtggggaggttggggggtgcagtgatgccagtgaatcctgctgcccgccctctacccggccaggctggcaccctccagggt

SEQ ID NO: 18649 - DNA, 1069 bp, Homo sapiens
gccgtggaggacggcagaggggagggcagcctgctccgtgggctggtcccaaattccagaggcccatcggatgcccctggttcccagggtgcccccagcagaagagctgagacttgaatcccatggcactgatgtgggcacaaaggggcagagcctagccacggagagagggtgtgccatcctctctgccaggcagcgggctccctggacagggtgggcgtcgttagagcagaaacggtggtggcaggacccaagactgtgcagttctaaaccagctctggtgcagacagcccaggtcagcagcagcatcggaggcaacctgccctcgtggcaccacaagagagctgctggggacaggacgtgggcggagccctcggctgcctcccaccgtgggacattggggagggagggagggagggaaggaggtgccggggtgctcaccttccccgaggctttgtttccggattcttctcttccctccttggggtactccatgggcttctgcttcggtgcccctgggggtccttctccagggccccttgggctgtgtacctgggcctggtggctctgtctgtggctctcttggggccctggatacctcctgcctgcttcatttcccagatgtcttaggacctgaggtggtgcaggctctccagggacatctgtcccacctgccgatgcccacataccaccttgcagtcctggtgatggggacccactgtctgacctgtggccccagccgcgagtccttctcaccccagaccccagcgtctgtgtttcatgagggttgtgaagtccctgccttcccgggttccctccgccggcccagcactgcccagccccagccccgcaccactgtcctcatgtctggagatgtgggcggtgtccgtgcacactgctggagcagctgggccagctcgacctctgggaccagggtggcccaggctggcttggcctctctgccttgcacccccagagccctggggcaagaacaggacgctcagactctcctgctggccccctcgcccaccgcttccatcccctcccgtgtgcccagctcagagaacat

SEQ ID NO: 18650 - DNA, 1029 bp, Homo sapiens
gggccattgcgcttgctgttccttgttccaggaacactcttccccagctatctctgtggctagtgtcctcgtttccttcaggtcttttcacaaacatcctcttctcagtgtggccagcctatggaaaatgatatctctaccattgcccacccatccgttactttctccacccacccgcccttctctccatcctgttcttgtgctgtttgtccttatggcacttcctactgatggacagatgaacagtttgtttattcatactcatgttaaaatactgtgtgtctccccagccagaatgtcagcagggatttttagctgtttttcttgctgctacatcccaggcacagagcctagcacatagttggtactcagtaaatgtttactggatgaatggattgatggatgatgagcaaatggacaggtggatgagtggatgaacagtggatatgtggatgggtggatggatgactggatggacagatagatagatggtggacacatggacacgtcaatgaatggacagatggatgggtggatggatagatgcatggacagagggacaggcagtggacagatggacaagtggatgaatggatgggtggatgaacaatggataggtggatggatgcatagatggaggggcgggcgggtggatgatggatggatggatgaacaatggatgggtagatggatggatagatggaggggcgggtgggtggatgaatggatggatggatgaacaatggatgggaagatggatgcatagatggaggggcgggtgggtggatgatggatggatggatgatggatgggtggatagatgatggacagatggatgaatagtggatgggtggatggatgatggatggatggatgatgggcaggtagatggatggtggacgagtggatggatggtgggcaggtgggtggatgatggatggatggatgatgggcgggtggatgggtgatggacaggtggatggtggatgagtggatggatgggctgatgggtggatgatggatggatgg

SEQ ID NO: 18651 - DNA, 1019 bp, Homo sapiens
cattgtcggggaggaatggctaagagccttggacaagtgagtttccctgctccgtgcctcagtttcctcatttgggaaatgggaagaaagctaatgggagtgcctggctcacggggcagatgtggggattaactcagccaggacccgagcgtgtttgtgacaggccttggcaccctcagtgttcagggtgcaggctggggccagggagttatgatttgtttgcgatttctcacgctcagctctgggtggcagctcaggctgggtccacacccacctgtcactcaggacatccccaggggaggctcaggcagaggaggacaccagtgttcccctgtgcctagggcaggccgggtgcccctgtttggcgatgcgtcctcctgggcctggcggctcacgggtcagtggagggctccgaggaggaggcagcttgcctggttctcaccgtttctctcccacagctttgggcagagccctgccccaggaaaccagagtcctccggagcagaacaaggcccagatggacccctaggcggagtttggctgtggtttggggagcaggcccacccacttcttatctgagggacctttggcaaatgaatgagtcatcctgagcctctgtcctcacatctgtaagagggagccctaatagtaggtgttggtagaggtttcgtggcaacctcgtgagctgatgcttgtaagctgcttgaagagggctgggcaccgaggaagaaccaagtctgcctttttcccactcatgttgggacacatgtcctcctccatcagtgaaacagtgtcctgcaggccagagaggctgagcaatctgcctccactcacacagtagtgagcgagggggatggggcacgaaccccgacgtctggctcccgcgccgaactcaccctcggcacaccaggctgcttccctgagtgctgggaggccgaggagtttgagaccagcctgggcaacccccaggcgaaactctgtctctacaaaaaaatacaaaaattagccgggcatggtggc

SEQ ID NO: 18652 - DNA, 1095 bp, Homo sapiens
gcagccagtgactggcagctgtggggtgggaagccccttacttctggagagaggagccacccaccctccagagctcctctgggacagggctggggtcggggctgtgtctgaagtcacgcttgcatcctcacacccgcccccagtatccccgggagaccagccttagagatcacggcgtcctggtctccctgtctgcttctgagaaacctgcctgagacagcacacgcccagggccatggcctcagtctggtctatgcagacagcacttcagacgcaccactccttcactcctgcactccgcctccaccttcactcttctcttttccctgtggacaaaggggcagctggttcacctggctcctcccaggtcaagctgggaacacgaaagaaggaagccagcagagggcaagtacagacaggttcattgcagagcgtagccttggggttcagcccctcaacctgaggctgaggatctcttggagcttggggagcgtccttggggaccacattcagtagatggaaccacagggccgtaagggtgcgtccatgtgcattgcctggaaggtgaagcttgtagaaagcaaaggtttgtagaaggcgaaggtttgtagaaggcgaaggtttatagaaggtgaaggtttatagtagcctacagcgacttcatttccactctctctcttctagccatgtgttgaaatcagttattcgttgggaatgactaggctgtggatggctttcagtgtgcatacctggactccctctccctgagttccaaacctggctctgctcctttggagcttctgctatgtggcagatcgcctccctgtgcctcagtttccccatgtgtcaaacggggatgacggggtttcaagaatcagagtccacatcagatgcttgcctggcacacgggaatgtgtgagctgggcctgccctggcagcgacagagagctggtgaccaccagaaaccctggccctgggacggcttttgtctcttttttgttgggcaaatgggctcccagccgggcttgggcctccaccgccgggaaggcgggactgcgctcgggtactgggctccggcctcccgaagtccttggt

SEQ ID NO: 18653 - DNA, 1060 bp, Homo sapiens
ggcaggggacagagagacctgagggcgtggctttagacgggtggtcgcagaggcctaaggaggtggcatttggcagagagttccagaccaagcgaagagcatatgcaagggccccggggcagccagtgcctggcatgcttaccctcaccatgaaggcggggaccgtggctccctgtcctcgtgatctctccagtgcgtggcacagtgcacataataggtgctcagtaaacttttgttgagtgaatgtgagctttttagtcagctgttgctgggagacatgaccaggggagggcaaatgtaaagaggaaataagattcttttttttttttttttttttccgagatggagtttcactcttgttgcccaggctagagtgcaatggcatgatctcggctcactgcaacctctgcctcctgggttcaagtgattctcctgcctcagcctcccaagtagctgggattacaggcatgtgccaccaagcccggctaattgtgttttgtatttttagtagagacggggttactccatgttggtcgggctggtctcgaactctcgacctcaggtgatccacccgcctcagcctcccaaagtgctgggattacaggcgtgagccaccggaaataagattcttacaagcacggagggtgcgcgtcttcccgagtttcctgggtcaagagctgatgttccaagcaggttcttactgcattccagaagcttcattctctctccaggacccagggtggagtcaaccatctggcctctctgggcagaactctttgtgctgggagagttctgaaggtcactggagcatcggaggagagccttggctctcctgccgcctgtttcacaactgattagatcagccctaaatgccttctctaaaagatacaattctgaccaggcacggtggctcctgcctgtaatcccagctctttgggaggctgaggcaggaggatcgcttgagcccaggagttgtagatcaacctgggcaagataatgagaccacatctctacaaaaaattttaaaattagctgggcgtggtggtgcacacctgtagtc

SEQ ID NO: 18654 - DNA, 1036 bp, Homo sapiens
cattagatgcccctcgccaccctggacagtccaggatactctccccatctcaagattccaactcatgtctgcaaagtcccttctgccatagaaggtgacattttcatagactccggggattagatgtggacgtcttttggggctgttatgcagcctaacacactctccctggctgggctgagctggctgagcctgaggggcgtggtgtccatgctcacaattagtcatttattgagcgccgactgtgtgccaggcactgttgtaggtgctttgctgggactggtccctcagcctcacggtcattctgcaggggcaaactgggccccactgcctggctcaaccccaagggtgcattctgcgtcaccccgggtcagtcccctccttgggaacacggggctgatgacggagcccccttgagagggtggcctcagttagtaactcccgagtttagagctgggagggcagccctctaggtggtccctgcgccacccttgcggggcaggggctggatactggccggacccaggaggttctgggtgcagtttagcgttttcccaggaggtggcgcagtgaagccctggatgcacagccaaagccaagccctggggctgcccccaccctgtccctgggcactgggaatggcactcaccctagagacccagccaggctctgcccctcccctagcctctgagcaacgcaccccaggagatggccaactgaccccaccttccagtgcactgggcgtccctctgcctctgcctgcccctcaagcagctaagccatggtcctcacctctggtcactgctcaacccgtctatccccaaatacactaagatgggctctcacaagacgcagagaacacagcacggtgcaacccaggagggctccagggaggaggcgcactacttgaactgggcacccagaccctaggagggcaaaggaggcccctcaggggaaaagaacctgaaagtggatacagcaatgatggtgggcttcctcctttcccctccctcttctcttccctccctccttctct

SEQ ID NO: 18655 - DNA, 1050 bp, Homo sapiens
ctgtgtacctgtgtctgtgtgcacatgtggttctcagtgtgtatgtgtgtggtgctgtatgtgttggtgtgtgcacgcgtggccctcagtgtgtagtgtgtgtcagtgtgcatgtgcgtggttgcatgtggccctcggtgtgcagtgtgtgtcagtgtgcctctgtgtgttcacgcgtggccctcggtgtgcagtgtgtgtcattgtgcctgtgcatggtcgtgcgtggtcctcggtgtgcagtgtgtgtcagtgtgtatgtgcgtggttgtgtgtggccctcggtgtgcagtgtgtgtcagtgtgcctctgtgtggtcgcgcgtggccctcggtgtgcagtgtgtgtcattgtgtatgtgtgtggttgtgtgtggccctccgtgtgcagtgtgtgtcagtgtgcatgtctgtgtctgtgtccatgtgcatttttgtgtgcacatgtatgattgtgtgtgggtgtgtggctctcagtgtataatgtgtgtcagtgtgtgcgtgtgtgtgtgtgtgtgtgcgcgcgcgcgtgcacaggtagctcctagcgtgttgtgtggtgtgatgtacaggtctcagggtgtgtggctgccatggccaggctgagggcagtagcgtggaggcaatagctttggcagccagccaggcccatgaccctggagggggtagggggtggatgggcccagtggatgcgttcgagctgctggtttggtgagggctgtggaggagggaggcgcccacgcagtttcgggaccctcgccaacctcctcttgggctgccttctgcctcactgaggacggacagcccccatcctctgtggggtgaagacaaatgagggacgaagacagtccttcctctcgtcactcctcctggtgatggtgacattgtgccttccctttggggccgaggccatcccaattgggcacccctttgcccccgagtgtcatggtagaaaacagggctgcggccccagcgttctgggttttgatcctggcgcagccactcgctgctgtgtgacctggatgagccacctaatctctctgcactgctg

SEQ ID NO: 18656 - DNA, 1031 bp, Homo sapiens
cctactgcatgccagctctcgtgcgcatgtcaactccaccatcagccccattttataggtgaagaaacaggctcagagacgtgtgaggtttgccccaggtgtgccgggggcctggctgcagcccagcagttctgaagctggaattcccacagggaaccagaccccacactccaacttggcctcccttctgctatgtggatttctccttgggcctgagcaactgcccccaaccctcacggtcctcacccccgccaaagaaggtacagactccaggcttctctcttttcatccccagcccaaacaagctctgcacccgctgttctgcctcccctggcaagcagaacatggtgagatggccgcagagaggcccaggaaccagaccccacaggcacatctgagcctgagtttctctctccgggaaatggggatgatcgaggagctcgacctcggttagtcctggggaggtgcctgggtgcctggcacagtgcccctgcccgttaggattactgcaactgttggaaccctgcccttctgctcccggcccattagggctgggctggggtgagttcggtggctgcgcgggctggtctggccacctcctggctccttgatggcagatttgggcacagaaagagcctgtggccgggtggtgtgggcagagtgggctgggggctctgccctccctgcctgcctgccgggcgtgtggtcctggctggagacacaggaacacagccctggctctgttctcgaagtcgtgggaggcgggctgtcaccacagtggctgggagctggaggccagcccagagggagagaggacgccatgtctgtgccctcacccttcagcacaggccctgccaagccacaggtgcctctgctgcacagggagtgagagggggctttgctgggcagagagcagggggctggggctgggagatggaggtgggggctgtgaaggggaggacaggacagcaaggattgctgggaaaagaggctgtgtccgtggtgccataggcctctctgcacacccctcc

SEQ ID NO: 18657 - DNA, 1058 bp, Homo sapiens
ggaccaaggatagccccaatcccagaccttgccagatgtgtcagagggtcctgcagtgtgtgcagcaccaggcctgtacacatggtgccgactggcatcatgagggaggtttcctttactgttccttgcccctgggcctcactttcccttctcctgcaagctgggacctgtgcaggcggtggctcagcctacagaagggctgggaactcacggccaggcgtgtgggtggattgttctggatgcctcagagccctgttcttcagggaccttgatgagctccagctaatgaagcccaggctctcctgaggggacaagatgttgatggaggcgtggaggactggaaacaggtcctccagcgccaggatccaggagggaacacacaggaggggacagagcaggcctgtccgagtcttgctgggcttttctgcaccctgggggccctcaggcaagcagccaagcaggtaggagatccggccttgcatccggcctgccgcagacccagcaggttagcgtgctgtgcacacctgccccgcccgccctggcctcggattggctcggccagatgctttcagaaacacttcccatcataaaagtctcactggctccgccacctgccccgggccctgttgctccgccagtcaggagacaagtctgttctcgccaaggaagccctttgtgccaccctgggccgagccacatggggcttgggatgggtgcctggggcagggcacccgcagcaggtgttttggggtgggtgcctccagcctgtggctgcttgtccggggcaggaggctgggaggagaaggggagtcacatcagctgtgcgtctctggcccaggtgcaggcagggctcctctcaactgccccttgcccctgacgccatctgtgtgtgaggccagggctcccagaagagtgtggtatggcccccactattggagtcaccatgcagagggggccagacgcctggacagagactcaaagccacacagagaccgggctgggtgggacatacttgcctcccaccactacccgtggcagacagctccttctcgggggcc

SEQ ID NO: 18658 - DNA, 1022 bp, Homo sapiens
ccagccaggtcctggggagaggagggactggccagcaatgggggccaggcagcatctgaggcattctgatagagcagaacctcattaagaagctgctaggggccggggcagtggctcatgcctgttatcccagcactttgggaggccaaggcgggtggatcacttgaggtcaggagatcgagaccatcctggccaacatggtgaaaccccgtctctactaaaaatacaaaaattagctgggtgtggtggcaggcacctgtaatcccagccactcgggaggctgaagcaggagaatcacttgaacccgggcgggggaggttgcggtgagccgagattgcaccactgcactccagcctgggtgacagagcgagactctgtctccaaaaaaaaaaaaaaaaaaaaagtggctgctagggtcataccaggggctgagggtgggggtcacattattttcatctggtttgcatgcaggtggtgcaaaccaggatgtgcaaagcatcttcccgtggccatgtctctgcttctgtcctccatccctcccaccatttgtcactgtcctagaaagcctcaagcagagagaacctcctgctctcacggctgagcccccaaggtcttctcttccatatacagaagaataatcctaacaaatcactgaagcccttcctgcttggagccctttacctgaactaacccattgaatccccacgagcctgcaaggcaggtgctagtattgcccccatttaatagataagcaaactgaggcccagagaggggcgtcacttgcaaacagctgcatggcaggtgggcccacgcttagcggatctgggcaatgaggccttacacagaccccgtggagtcaggctcttcgtctcgttttaccccaggggaaagtgaggcatgactgaagcttgagaagggacagagaaagcgaagaaagcacaagcagctgacctcggggcctaggctgggattcagctgcagatcaggcctagaaagtacagattatttctttatctatttat

SEQ ID NO: 18659 - DNA, 1050 bp, Homo sapiens
ctctgacaggcagagctgtctccttaagcaaaggttattggactgcgaatgttatgacattacatttttgtgtctgcactttggagatgcgtcatgctggcagaatgacaagctctgggcagggctgagcagaggggccgggcaacgcggggaactgatagcggtccactttattgcagtgccttcacggctccgccgctgcgccctgggagttgacaggacaaggcgccagcctccttggctggggctgcttagctggtttgatgctgtcagctcccaggcaccgcccccccaccgccccagctggcagccccagcacctccaagagagggctaggatggagcaacaggatggagcaaggcagacccacagcagcaatgagaatggtcccagcagcccacgtggcacagagctgtgacattccaggtagtgtgcaaacacattcgggcattaatgcatgtcccacgcacccacccgaagaagcaggcatttttatcccttttgtcaattgagtaaactgaggcacagagtggtagtgacttgtgatatctgtcccctgcggctgccgtaacaaagtaccacaaactggggagctgaaagatttcttctcccacagttctggaggccagaagtccaaaatcaaggggttggcagggccacactctgcctggcaggtccagccggcgatgcttcctgcctcttccagtctctggtgacttcagcattccttggcttgcggcagcatcactccagtgtctgcggtcatcacgtggccgcctttcctctgtgtctatgtcccaattcccctctttttataaggacgcaggtcgtaatttaatatgcccacattttaacttgatgacatctgcaaagaccctgtttccaagcaagacctcatttacaggttccgggtggacatgaattgggggtggggacattattcaagctgacatgtgtgcccaaggtcactggagtagatgcttgtggggcctcactggcatgtcccccaccaatctccgagctcacctgcagatggctctatagaaccct

SEQ ID NO: 18660 - DNA, 1088 bp, Homo sapiens
cagaacagctggcacacacagcattgattctgcacaggcggccgactccttcaggactacagcaggcctggcagagagcgtcaccagatccagaaagaaaaacacaggacacccagtgaaacttaaatttcagataaacaacaaataccttttagtataagtatgtctcatgcaatatttgggctatacttatgctcttaaaacatccattgcttcgggctggggaggggatggagagtgattgctaatggttatggggtttctccctggagtggtgaacatattctgaaattgactgtggtgagtagctgcccacttttgtgagtattctaaagcccatcaaactgtgtgctttaaatgggatcatatgggatgcaggttatgtataataaagctgttatattgaaaaagtatttgttgtttatctgaaatttaagtttcactgggagtcctatattttatcaggcaatcctatttgggggtaggttctcccactatctctgtatcacagatgaggaaactgagagccagccgcatatcacagccaggacttgtggaagggactggaacccagaagtccagcctccttgacccttagggagcgttgcctcagtgaagatggagcctgaggctggagaggcggctggggccaggttggctgaccccgaatgtgcggggatgccctccgaggtctctccatccacccagaggcagagtgcatgcctctgagcaaggggtcccaatgtggctgaggttcctctcatcctctccctgcctctttgggctcggcctcctccctcacataaggaccgcaggctggtcagagggaggaggatcagatagaggccctgtcaaggctgctggtgcagggcctgcagtcgttgcttctcacaggcagctgcctcttggaggtcggaagagaaactgcgctgggcacggtggtgcgcacttgtaatcccagcactttgggaggctgaagtgggaagatcacttgaggccagcaggtcaagactgcaatgaactgtgattacgccacttcactccagcctgggcaacatagcaagaccctgtctcaagaaaagggaggc

SEQ ID NO: 18661 - DNA, 1008 bp, Homo sapiens
tcgttctgttcccaagtttgagaaccactggcccagagagggtagcatcctgtgccgtttgtcccggaacgcagcttacggcacactctgggtgccctgcgatgtctgggctgtgtccataggaaccttgcggcctggcgggaggtgagataagctggtgggtactgaagccagagcggcctgtccaccgggccaccgtgttttccatcctgaacccaagacgctgagaagctcgggggagaggagtcgccagtgggatgtctggttggagaagctgccaggaagggggactcgagagagcctgggaggaggaggtttgcagaagggagcgcacagcctcaagaacggggctgagcgaatagggaaggtcatggtggtttctctgagggccggggccatgctgagtcccaaagctgaggctggagatgggagagtggacccagagagagtggcctgcaagccatgtggagccggggctgggacatcacagggcggcactttgaagagagcttgtcgggagcgcggcgctgggcctgccagttacctctggctgcctaacagattgccccaaggccaggcatggtggctcacacctgtaatcctagcatttcaggaggctgaggcgggaggttcacttgagcccaggagttcaagaccagcctggacaacatagtgaaaccctgtctctacaaaaaatacaaaagttatccgggtgtggctcctgtagtcccagttacttgggaggctggggcgggaggatcacctgagccaggggagatggggcctgcagtgagctttgattgtgccactgcatgtcagcctaggtgacagtgaaagaccctgactcaaaaaaaaaaaaaattgccccaaaacttcgtggctccagacgccatttattatcccacagcatgtgcgggtcagggatccggatccagcttagccgggcctcctgggtatcagccttccccagctgaaggcttggctggggaaggatctactcccaagccc

SEQ ID NO: 18662 - DNA, 1068 bp, Homo sapiens
tagacattagtatgactttattctagttatttatttatttcttgagatggagtcttgctctgtcacccaggctgcagtgcaatgttgcgatcttggctcactgaaacctctgcctcctgggttcaagcaattctcctgcctcagcctcctgaataactgggattacaggcacctgccaccatgcctgactaattttttgtatttttagtagagacggggtttcaccatgttggcaaggctggtcttgaactcctgacctcaggcgatccacctgcctcggcctcccaaagtgctgggatcacaggcatgagccaccgtgcccagcctgattttatttttatttatttacttttgatacagggtctcactctgttgcctaggctagagtgcagtggtccaatcatagctcacagcagcctctacctcctggggtcaagctatcctcttgcctcagcctcctgactagctgggaccttgggtgtgcaccaccatgctaatttttgtattttctgtagagacagggtctccctatgttgcccagactggtcttgaacccccgtactcaaacgattctcccaccttggcctctcagagtacttggattacaggtgtgagccactgtgtctggccaggacttaattttatatttgtgtaccttgttttctcatcttttgggtccccctggggagggagtgtgtcctcttcatgtctacagaggacctacagcagacgaagtgctaaataggacatgatgatgaatgaatgaatgaacaaatgaatgactatataatgactgttactggtggcttccaggtgctgagggcgtcctggggtttgctacggcaaacttgccatcctagagatgcagagctggcaaaccgggtcctcaccctgagatccctggctctgctccccgaaggcaaggcagatggccgccttctcagcccccgtcccctaccagccagggccccgagcaaacccttctacagcagctggcctctgctgaccccgtgatcgggatctgctctgtttggaagaagattcattccctgtacagttgacggcccc

SEQ ID NO: 18663 - DNA, 1034 bp, Homo sapiens
gggtgcagtggcacgatcatggtcgctgcagcctcaacctcccaggctcaagtcatcctcccatctcagcctcctgggtggctgggagtacaggcacaagccaccatgcccggctaatttttttgtatttttttgtagagcaggtctcaccatgttgcccaggctggtctcaaacttatgggctcaatcggtcccccggccttggcctcccaaaattacaaattatagttcaaattacaggtgtgagccaccatgcccagcagccctgtggatatttgggtgagataattttgggtggtgggggccatcctgtgcactgttgggtgtttgccacattcccagcctcaaccccactagatgccagtagcactcactccccgagttgtgacaaccaaaacatcttttgatattgccagatgtccccctgggggcaacatcacccccggctgaccacctgcacagcctgtcaggccgctagtctgctggaagacccgagctggaagaagatccttggcctctgtgttctccctgcagcctggagagggtcagagcacacggtttcggactccctctggctctaagtgcctgtggttttagaagggccgcccaggtgtgtgtgcagcatagcggtaggaagctcacctctaccactgcctccagagtgtctgcatcagcgggttaggtggctctgttgccccatgggtggcccaggccgctttggctgccagatgtccctgggtatggaaggctggggcccaaggccagtgggagaggagggggcgctgggcccaggctattcccaaggctagagcagaggatctcagtgtcccagggcatcagcatccgtcgcaggacgtgttacagtcctgaatgctgggctgcacccacagcatttctgattccatgggtctgaggcagggctgaaggctgcatttcttttttctttttcttttgagatggagtctcactctgtcggccgggctggagggcaggggctcgatctcggctcactgcaacctccgcctcccgagttc

SEQ ID NO: 18664 - DNA, 1047 bp, Homo sapiens
caggctgggctggactggactgggctgggggccccgggccactcacccaggactccggtcggccctccctgggcgccctggggcggggggttgtcccagcagccacttgcatccctggctgtccctgcattgtcccagctgcctgttctgtaccatctcagttaggggccagccacgatagaagctgcttgaggcatttcaacagagaggatttgactcttggcactgctgagcaggtgctggaggacccagaaggcaggaggggatgcacgggtgatgtgaggtggtgacagcaggaagcagccccacccccagggccaagggaaagggtggagttgctggacccagaggcttggtggaggatggatctgggactgaccttggaggcaggtgtgctgccgggctggagctgcgagtgtcaggggaagggaagtcgcccgtgatgctcatgagacaaaacccatcttgtggtggcaaaaaggggctggtctcctcctagcgggatttggagcggagccacaccgatgcacgctttggcggagactgagccgcagggaagaggcgcagtaaaggatgttgtcacccaaacatggccaccccacccaccctccaaggcaagcctgccctgcccacccagaaagtcatgcagccccgcttacccatcgcactgagcagtcttatctcctgaccacttaccactaggaagaagcaattttgttcccattttacaggagactgaggctgagagacgaagtaacttttactttggttaaaaatccatggcaagtaaaaggcaaggaagaatctgaacatcctagactgagacctcacaatatcatccctttcttttagatggggaaactaaggcatggagcggtggagtttcctgcccacagttgttcagcttgtcagtggcgaggccgggattcaaactttagacagtcatgctctggaatccacacttttaaccaccactctctaagaatgaatggaaaatggatggatggatggatggatggatggatggatggatggatggatgggtag

SEQ ID NO: 18665 - DNA, 1096 bp, Homo sapiens
catatatcctgttactatttcagcacatggacaatattaaaaaatatcagtgagatattccatatccttatttttgtcctaaatcttcaaaagccagtgtgaatttgaacctagagcacattacagttggacccagccacatttcaagtgctccatggccatgcgtggcccgtggctgctgtattggacaggacctgctgcattggacaggacccagatagaccccttgttcaaggggcttcggtgctgggaactggtgcatctcgcccacccttgtctctttgagcctctccagatcccaggcaggagggagagcaggggctggcccctcattagcagggcaggctgagggcccgagacaaggtccagccccggccctgggctcctgacctgggcttcctgcaccacccaggattccctcgtgccttggtgagagctgtgaggggcaacgatgggcagaggcaggtaggtgtcaggcatggcatggctctaacttcggagccgaccgtctggcttcagagctcagctctgccacctgctggccctgtaacgctgtgtaagtgattgaaccttaccaagcctcagcttgcttagctgtaaaatggggcgataatcgcccctgcctcacggggtgctgaggcagtgacgtagcgcttggaaccagcactgctagcagtttattcccctgcctcactaagacaaggtgttttgggtccctgtggggtttctggagtgggcaggtgagtgaggctgcaggccagcccctgagggcggtcctctgatggggacacctggctgaaaggtaagccctcccctgaactggactgtccacagccccagaagatgaatttcactgttggctcctgtttgaattcacctcccaccccccattctagttaccaggggtccagtgggtgggagcgggctgggggatccttggcagttaggggaaaatcgattctgcttccagtagacaaacgcctggggggtccctggtgttgacagcagaccagtaaactgtctttgtcactggccggtgagctgtggccaccgtcctgggcagctggagtgagcagtaacatttgtaaggtactcc

SEQ ID NO: 18666 - DNA, 1030 bp, Homo sapiens
taatcttcataagaaccccaaagaaacatctcttatgcccattttacaggcaaaggaactgaggcacagagaggttaagtcacctgggtccagttaccagattataaaagtagagttgtgatttgacttcaatcctttactttcccacaaattactttccctgccctcggccagccttagagagagaagcaggagtgcacaccactggccgtgatccctggccacccccagggacctctgctgcccactcactgtagcgtcctgacaactctgggccctgctgtttggcattggtgtctgtatctctgaccagatgaaggctgtgtagatggatggatgaagagaaggatcctggatggatggatggatggatggatggatggatggatggatggagagatgattgggtgaatgttgaatggatagatacttgcatgggattggatgagcagaaggatagatgggccagtggatgttggatagatggtggatggagggtcagatggatcaatggatgctggatggatggatgctggatagatggatgttggatagatggatggattttggatgggtagagaatggatgaatggatggtggatagatgttggttgtacagatggatggaagtggtttggatggatggatggatgttggttagatgactagatggaaggatggaaatctctggctctgggaggggaagcaagagccataattcctcatatccctagtggaaagggggactaactagctccagccctaggcctgctcagctgggcacaacccaaacctgagggcctgtgggcaccaatctcccacccaaaggggcagcagaaattctccagtatcaaagtctgaaggactgtggcccaactcctcaccaggaaagaaactgagactcaaagatgggaggagacttgccatggtcccaggatttatttcccacagggctggggactgcagcctcatttctgtgacatactaagggtcccaaggaacgccttacagcccctcctgccccatgagc

SEQ ID NO: 18667 - DNA, 1023 bp, Homo sapiens
gcacacacacagacacacacacaaaagtgagtgcacacatgtgcacagagattacagatccacaggcacagatgcatgcatgcacacacagacacataaactcacaggcatgcacacatatgtgtacacaggtacacacaggcatgcacacccacagatacatacatgcatgcacacaggcatacgcagagacactcaggtacacagacacacattattacatatgtgcacatgcatgcatatgcaaatatgcacagtacacagactgcacagagctccacagacatacacttgcaccttcgggtttaagccctgagcaaattgacatcccgtgtcttgttctccacagtgtctccagtgccaagcatggggctgggtgtggtaaatgtttgtcgagtcagtgaatgcatggatggctcgaaccgtgtcttgactcagcaacaccgggaccagtggggtctggaggtgaggatcaggagacagtcagccctctgctttgctggagactggggaacacctttaggacattcagagaaggacagctgcaggcacaacttgctctagcaaatcacaagcctggattgaggcctcaggattccttgtaccgtgttcctttccactgcccagagatagccagctgctggactaagcacttgccatctgggggaggcgcttccttgggttccagaagtttcacgtgcatctgagatgaacctgctgcagcaggagacggacagctggccagtcctaaacatcgtctttctcacacccaccccagaatgaggactcggctgctgatcttcagccgacactgggaggacctggggttaactttgccaagggccacaccagattccctggctggggtcagtggtcactggtcagctggatgctaacctgactgggtctcattccctgcagcttttacttttttcaggttgggtaagttctggtgctgaggccccaggaaccatcacgggggcacagcgcggcctggaatatgcccgtggaggtggggccttg

SEQ ID NO: 18668 - DNA, 1025 bp, Homo sapiens
gggagcagaagctcaggattgctgaccctggggtgtcccgcccatgccccttcccgcggcgctggctgtgcctcccccgcctccccactgcccacgttgtcacaggaggcccaggtgtgtcgccggctccgcagcagccagatcttgagccgcttttcatgcttcaggtttcccgccgcacgcaggcaggggagcgggggctgtcttttctgcacgccttgcccttgatcttccctggctttatcttccagcctgaatcgctggtggcaccccacagggcccccttgttctgagccacctgagactgggcatcggggtgccacacacctgactgccctcccccatggggccccttgctgcttgctctcctctcccgggagcagctgccacgtgcggtaattagaggctgacaccaggtgtggccgccactgctgctagcacagtggagaggcgagtgtgctgctacctgctccagcgaacccccccactctgcaaaggaggcagaccgtgaacatggggggcgggagaggctgaggaaaggtgggctggaccagccctcagagtgctcgctggcggccacgcacagcgagggggggcggccagtccccagacccctcacaggtgcaggcccagattctgttgagctaagctttgcgtggcgggcggctggcagcgatctgctgagccttccaaaggtagcagccatctgcactgtgataaaaagccctgaggatgataaatagacaagtcgcacttttattggattgcagtttgggagcagccactttgggtttggcactgtgttaacgacagatttctgcttcccttgcaaggcctggcctctcggggagcgcgccagcagcagcagccctctcctggctcgagggagagctccccccagccgccctggtgggtggctggcctgctcccattggcccctgcagccatgctgcccttgtgggatttctgctgggggcccgccttgcagctcgctggggtcaggctgatgagttcacatcccggca

SEQ ID NO: 18669 - DNA, 1050 bp, Homo sapiens
agtaactgtgtgtcttcaggcgggtgtcctaacctctctgtgctgccagtgccccatctgtgaaatgggcaaataatggcatttacctaacaggcttgggaggttccacgggtaacggctgtgcgtgtagcatttggaagagtgcctgggtgcacacacagtgagcgttctgtaaacattagctgctggtatcagcgccatgagcagcctgattggtagtatgattgcttccagagagccccgcctggccctggcatcccaccaggcagggagctgtttggcctcagctctgcgacgtcggggcctgttccccggaggacctgtatttcccaggacaacaaggcctctgctgtgtcctccactcatcagttgaacgtgggagctctgggaccagatggtctgactacctcatggtctctcagctgtgagaccttgggcggtagctgcaatgctctctgcctcggtttccccttctgtcaagcagggataaaaacagaactgaacctcatagtgctggagacgatctgctgtaagctcttggaccaacgcctggcacgtgataggcatgggtgggtgatgtccccccactcggcattgctggtggctctcctgtttgccaggagcccccggtgggcccagcgttggctctgggttctgcgatgaccgggctcatgtggaaggacggcagcaggagtggagagcagagggtagcccggggtggggctcgacccctatggggtgtgggtggctcagtagacgccatcgagcgggttctctgcctgcatggcagggagacctaccgtgtgttggagctcagccctggggaacggaggaacaagggaagagcgggcatggtggaggcggtagcctgcgtcctgttccgcttggcttcctgggtgcgttgggcaggttggctcatctgtcttaggctccgtttcctcactggagcttcccgaggttcctcccagggcccgcaaccccgctcccgctgtccccatctggccttccgttccctctgcacgggcacaccctcctcctgctctgtgtgcc

SEQ ID NO: 18670 - DNA, 1232 bp, Homo sapiens
cgctggtggtggttggtgtgtgtgctggtggttggtgcgtgcgctggtggtggttggtgtgtgtgctggtggttggtgcgtgcgctggtggtggttggtgtgtgtgctggtggttggtgcgtgcgcttgtggtggttggtgtgtgtgctggtggttggtgcgtgcgctggtggtggttggtgtgtgtgctggtggttggtgcgtgcgctggtggtggttggtgtgtgtgctggtggttggtgcgtgcgctggtggtggttggtgcgtgcgctggtggtggttggtgcctgcgctggtggttggttccttcctgttttagagcagtgcaccactgtatggatgcaccacaaatggtttgcccggtggagacactgaagcccacagtcacactgctaggctcctcataacaggccacctggcttgagaggccacccaagaggcccgtctctgcctgcctccccccctcaccgagtttctggttccagggagactgggtccatgtgctgtaagcaagaagcgtccccacccaaggtccgtgtctcggtgtcaggttagaccatggctgaagatgcatctttgtccccgccagagagacccgtgtccggcgcgaataattggattttaatgaaacgaatgggagtgctgaagccgtttgccaccctggcctgcatcggggccccgcaattaagccgattatgttttgagagtcaagctgtctgactcctcgcgtccctaatgtgatgatgtttgatggccctgccagcgcggttatttatttatttacccaaccctcatgagctgggacgtgccagtgggccccggtaattaacagcgggtgctgagcctgtgtgttcccactctggcccccacctctccctctgtctggcagctcagggcatcacctagggacagactctaacaaatgcagatggccaggccatactcacgcagacttttaagttggttgatctgggactgtggcaaggccactgggatttttcaaagctaccccggcggggcccagaagcccctggtctaaaggacgcagattctcctggaagcctggggtgctgctgcatctcaaagggcctccttcctcggaatcccctgccccagtgggcccaggctgttcccacctgtgggaggcctgtggtcttctcctccttaaggcctcactgaaattcagggaaggatttgaacccagagaccctcagcacaggtcctgggagaga

SEQ ID NO: 18671 - DNA, 1044 bp, Homo sapiens
cgcccagtccctgctgccctgaagaagaggctgggctctcagcatttctggtgggggcaggtccccagctccaggggtggctgagtgtagggatctgccagtcccaatgccaccttatttcatgtgaggatttcgtagctccaacctcatttagtcacagtttaagatgaagatagtaaatgttggttgcatggtaccataggtcaggctcataggcctttcagcccacatttatttagttttctttctttattacttgttgaggcaaagtctcactccatcacccaggctggagtgcagtggtgagaccatagctcactgcagcctccattccctgtctcagatgatcctcctacctcagcctcccagagtagctgggactacaggcacaccaccatgcccagataatttttttgcattttttgtagacacagggtctcgctatgttgcccagactggtcttgaactcttgggcttaagcaatctgccctaccaaagtacaaggattacagacatgagccactgcacccagcccatttatttcttaatttactttttttcgatgatctcgctctgttgcccagggtggagtacagtggtgtgatcatagctcactgcagccttgaactcctggggccccaatgatcttcccgcctcagcctcccgagcagctgggactgcagacacacactgtcgtgcctggctaagcccacatttgttaagtgcccacttgtggctggcacctgtggtggcccctcatgggggaaatctgatgagtgtttacaccttaaggcaccgtaagaccgttgaggtttggggccagatacttctttgtcctgggagctgtcctgtgctttgtaggttggccttgtcctctgctcacgagataccagtaatactggttgtcccagtgtgacaaccagacacctgcccagacattgccaggtgtctcctgggggatctcagaccatccaaatgtccctgttgagaaatccttgcttaaggtgtgtgtatgtttcctggggctgccatgataaatgacca

SEQ ID NO: 18672 - DNA, 1647 bp, Homo sapiens
caggcggatctcctgaggtcgggagttcaagaccagcctgaccaacatggagaaaccccgtctctactaaaaattcaaaattagccgggcgtggtggcacatgcctgtcatcccagctacttgggaggctgaggcaggagaatcgcttgaacccgggaggcggaggtggaggtggagaatcgcttgaacccgggaggtagaggttgtggtaagccgagatcatgccattgcactctagcctgggcaacgagagtgagactccgtctcaaaaaaaaaaaaaaaaaaagccagctgtggtggtacacatctgtagtcccagctacttgggagctcctcgcttgagctcaggagttcaaaaccagcctgcgcaatataagtgagaccttgtctctacaaaaagaaaaaaaaaattagcttgacatggtagtggttgcctgtagtcccagctaccttgggaggctgaggtgggaggatcgcttgggcccaggagtttgaggctacagtcacaacattgcactcccgcctgggcgataaagtaagactctgtctcaaacaaaaaagtcagtgtattcgttccctaaagctgccattaagaacttaccccgaacagaggggcttataacaacagaagcatattctctcccagttctggaggccacaagtctgaagtcaaggcatcagcagggccgtgctccctgtgcaggctctaggggaatagtttccctgcgcctcccaacttctggtggcttctggtggctcctggtgacctttggcttgtggccgcttcactacagtctcttcctctggctttgagtgtcttcttgtaaggaccccagtcatgttggacttggggcccaccctattccaaaatgaccttatccttagtaactaataacatctgcaaagatcccatttccaaataaggtcacctttttttttttttttccaagacagggtctcactctgttgcccaggctggagttcagtggtgcaatcccagctcactgcagcctccacttccaggcatgccccaccacgcccagctaattttttgtatttttgtagagagagggttttgccatgttgcccaaactggtctcaaactcctggactcaagcaaccctccctccttggcctcccaaagtgctgggactgcaggtatgagcaactacacctggccccaaataaggtcacattctgagattctgggtggatataaatttggggggaactctattaaatctagtgcagactcaggagctagaaggggctttacagctcaccaagtgtgaccccctgttcttctgatgaggaagccaagcccagaagggcgaggtgcctctgtggcagcccccacacagaaaggaggtgccgggccctgtcccctgcctctgccggtgcaggctttctgcatcggactcctgctgcttggaaacaggtgggctgtggagaggtcaaccactgggcacaggggcagagccctgctgggtccggcccggcccaggagtttctaggtcaggctggtagccttcctatgggctatgatcatgctgggctgtttccagcactaaattatttaacgtgtggttattctagtgttctttgtccttcgggaggaggggagaaagggagagaaaagctcaggat

SEQ ID NO: 18673 - DNA, 1979 bp, Homo sapiens
tgggaaaggccccatgaggagaccacactgagcttgtatttgaggaaagacagtggcaggaaaccctgttgacattgaggggtgccccgggcagagggcacggccagtgccaaggccctgaggtctgagctcacccagaccattggtagaacagcaggaggccagagtgggtgggagccactgacgggattaagtgagacgctgaagccaggatttccattccccgtgactttctccagcatccaggggtcaccacacgggtgtctcacggagggtcagctgccaaaatgacctggtggagaggcagcccccaggagggaagggtgtgggcaggtgcagtccttcctgccctaactccccagcctccacctgccctcagctgccgctcctcctcctcctcctcacaaatcatgaccacctagtgaaggacctcggccttgagagaactctggggcctcttgctctgagccaggtcagagcctccacaaaattacagctgtgagacacggcgaggggagcggggcctctggccctgctggtaattacggcccacggagctctgattgccgcagtccaattaattaaacaccgcagcgacccaaattatgatctcttgccttgtaccaagcagtatttttaaccttaactgtcggggctgaacttaaatttcctatctggacagaagtgtcacccgagggagaaaaaggcagtgtcgaagcaaacctcgccgatgacagaccctgtaattagaaactgtagtgtccccgagactggtctttaaaactgtcagaagccaagcggccgtcatttgatacaagactatcatcacccgtgaacccattagctgcaggtaaataacatattatgccagggacggaaagcagccaggctggggaattcgccggcgcttaattaggaccggcagtgcggaagatagatggtcatcctttttgctcccttcattaggagggagggtcaggtgtggcggtggtcaccggagcccgggctgccgaccctgcagaaaagcgccatcctccgcccgccctctgcctcccacggtgctgcccgcacctctcttccaggcctgtgtttactgctgatccctaccagctggtagtgttctgcaggagtccatgtgtgaagagaggttgcgtggaacaggtaccccgctcagcagagggaatcttggtgaagtgggctgaggagggtgggtgtggaccgtccctgagggccacccccaaagcccacgatgtaagatgggcacttgaaggtttgcaaagcctattgtgagcaggtgggtttggactcgtgctgcgggccacacactttccccttagaggcagaattgtggagccctgatctggaaagatcttttgagacccagaggtctggctttccaaagctgggtgtgaggacagctgcagcccgcagagcggtgacaggggcacacacgtgtgtgtcttctgactcaccagccacctgatggctattttaaggtgtttccaggtagcatacggttagtgtgaagccgacgagtctttggggtctgggctcagggacaattgggttaaatagtgagtgattgccacatagttagaattgggaaataaagagatgaaagaaaacaatttttaaacacaaataagaaatttaaggaaaaaaatggcaagtgagccaatttagataaatattaagtaaatttatttgtcgggatgtctggggctgcaggttacagaaaacgttgactcaaattggcttaacccatctgggaatttttaatatcccagaacaagggggtacagagctagggtggatggggggtgctccaggccggtggctctggccttggctctgcccctctatgtgagcattgtccttggccttgcttgttggtgcatgaataatttataggaagatgaaggtctgaaaggaagttatgacgatgaagtcgctgcatcgagagttccttctgttcccaa

SEQ ID NO: 18674 - DNA, 1005 bp, Homo sapiens
gttggccaggctggtctgcaactcctgacctcaggtgatccacccgcttcggcctcccaaagtgctgggattacaggcaggagccaccacgcccggcctccctcacttatttttcggaacaggtgatgttccagagtgacatacgcaggtagcttctacctagcccctgctctgtttccacaccaccaggggcgagaggtgagttgggacaggatggaggagaagccagcagctccaggaggagcacacgccatggagggtagggagccaggaggggctgcctgcatgggtgagaggtggttgagcttcagcctgggcctccagccgtccaccccctcagctgtggcctggatgggtgtcagggcagggcccgcggcctctaaaacatcctcggggaggtgcctcgtggacacgtggcaatagttacccagatacagcctcggaggggaggctgctgcttgtgctcagtatgctggtggagactggtgtgctggtctgtttttctgtagagactgaaattagcaggaagctaatcacgctttgtcttttacctgaactggggtccttgaacttcacatccaggagaaaggttcgtaactgtgtgcccagcctggtgtcaggtcctgggggatgtacaaacgtgtgtgtcagggtctttccccctcagcgtatgtgcactgggcaggcacacatggttcgttggacaacagcgctgctggtcactggcgactggctggctgggtcacagtggatatgtctggtagggctgggcaaaggtgggaacagcagggagagggacttgaaccaggacctgaggaagaggagggatccaggtggcctctgtagagaagaaacgctcacctggtgaggggcgagacacggacaaaggctggaaggccgggcagagcggggttatcgtgtgacggagaaagtggcctgcccacctgatgggcgtgtgggtatgtgtgggtgcacgtggacgcaagggggcaggaagggttggat

SEQ ID NO: 18675 - DNA, 1494 bp, Homo sapiens
caaccgactcacccccgcgtttctcgtgagagtgattggatccagccagtggtgctgttctgagaactgcctgtgtctccggccttagctcatctgtggctcacaaagtggggataatttgcatcctactgatggggaaactgagtcacctggcggtgacatctcttgccccaggttcacagcaggccggctccgagtccgtgagtgtgagggcgtgagtgggtgctcgtgtgggtgtctgtgatggttgcgcagagtgttggagtttactgtgtgtatgtgtgttgtgctgtgtggtgtaaatgggtgtgtgcatgtgttgggtgtgaatgtgtgttggatatatgtataagtgtcaggagtgagtatgttgtgtatgggtgtgtgttgtgtgtgactttgttgtgtgcatggctgtgtgttgtatgtgtgactttgtgtttgtgtatgtatgttgtatgtgcatgtgactctgcatgacctgtgtgggtgtatgttgtgtgtatgattgtgcattgtgtatgaatgtgactatgtgggcacgtgttgtgtgtatgcgtgtgtgtcttttgtgtgctgtgtggctatgtgtgcatgtgactgtgttgtgtgtggcctgtgtgtgttgtgtgcgtgtggttgtggttgtgtgtggcctgtgtgtgtgtggctgtgagacctgtgtgtgttgtgtgtatgtggctgtggttgtgtctgccctgtgtgtgtgcacgtgtgcctgtggctgtgtgtcccctgtgtgttgtgtgcgtgtgactgtgttgtgtgtgccctgtgtgtgtgagacctctgtgtgttgtatgcgtgtgcctgtggttgtgcgtgccctgtgtgtgcgtgcgtgcatggggcatcctgcctgtccagcagagctccctctcccactttcgttaaaccccatctccatcctccatgctcaggaaggtgctgggtaaatacattgccatctggctgatggaacagcgtcctggttgggaggagttggccacactccccagatcagggagagtctccagggactgtggaaggagccagggctggggccaggaaggaagcagggctaaggaacccctgggagccgcctcccactccactcctggccccagccgtgggggctggagctgatgcagttccagggggctgagggacagagggggtccctcctcgtgcctgcctccacccccaaaccttccctgggttccagtgtcactgcaggcggcctccccgaacactgggagacactgagagtcttagctgcctggcctggtagctcagtctaggtgtcacgttttccccaggagaggggctggccctcaggcgcagcggtctggttcagagccagcaacaccacggggctcttgcctggagggcagtgctgcgggaggcggggtcaacaggcccaggctgagcagaggtgggagggcgcaggagggggcagcttactccctcggtttctggcccactgaggaacgc

SEQ ID NO: 18676 - DNA, 1023 bp, Homo sapiens
tccgtggcaagcgagcagcggcccaggagacaggggcagagtctctgggttgcagctggtggaaggcctcagcaggcctcagcctgcagccatgttttcttagctcctacacagtattttatttatttttttaagatgtattgccaatatttacaattaaaaacaaagaaatttcttccccacatttaaaccccagagttccagcttctctttaaaactcctggtaccctgggtctgtgctcccccttggcacctgttgggggcagctgagcagcccctgctatgccgagagggcaggcaccctcctatttgctctagccccccacccccactacggggccccttttccttgcctaactggccctcccagcacgtgagtttctaagccctggctttaggtgtccctggctggaatatggaggcctgtttgggggtaggctaggggagggtaggtggagacggaacagggaggcttccggaacctcaccgattagactgtctagctagaggaggtttgccagaaaggctgtcttcctgattactgggaaacaggacccagaatgctaggcagctgggagccacgaaacacctctgtcctttgccagcaggaccagccgtggcctgtagggcaccttgctgcacattagaaaaggggttcctcctgtgtgtggacaggcactggcaagatgagtgaaaggtcagctagacttcagcctgctgttcccctttgcccagccccttgtgcagtgcacaacctgcccgcatgtacccagcgttcctgccctgattggaaccagctcttgaagcctggtaggaaatggcaggactgtctggaaatccgtgagggtagcgcctgccgtcctgcctcctccggcccccgatttccagctcagccgtctgccttggctccctgaagcctgtggaaccatttaaaaagctcctaacgatattgatcaatctctctaaaatggattatcctgtttgcctcccagcctgactggatgccctgggtaagatcagaaa

SEQ ID NO: 18677 - DNA, 1042 bp, Homo sapiens
ttcgcttctgtgcctgggatcagagtgggcctgaggtcctgtttctgagttgtcacataagaggcaaagccacggggcacggtgaagggctgtctggaggacagagcggcagggatggtgttgatgagcagtacagggggaaggggccctgcatggcacagaacattccacatgcgtgtactctgtcaggggccacgtccctgcctcgctgcttgtccttggtgtgaccttgggctgactttctccatctgcagaaggggagagcagtctccctccccagcactgggaacgggctgagcatgagggaaggctgtctgggcatcaggggagttgtgaagtttggagatgtgtggttttcaaaatgcatccttgccctcggggtagagaaggcagtataaagggtgggaggcccagaagacatcagtcatttcagggttttattagggcaggcctctgccttcagctgccctgccccacccccaccccatccggttttgaccttctgggttggaggagggggagcccgctctgcgtgtgattgtgtgtgtgcatgttggaatttgtagagtcagggctgggatgcggggagggtgtgaacccacatttggatcagcaggcgaaggcggggagcaggctgcacagggcagctttctctttggaaacccgttctgtttcttaaatgtcagagtgagcagatggtgtgtctgagttttattaatcatgggcttaccgagctggagggcctgggggatcatttcgtccaagtgtcctacagaggaggagactgaaggccagagccacactgcacctgccacaggggcagaaccgtgctgggacccagcatcctctcccacacccataagcctccgctgtgcagaacttaacaggtgtgtctcgctctgcccaggcgcagcaagcctacctcccaatgaagagctgaagcggagatgcttctgggttgctccaccccacaaacaaccggaaaggctgtctttgggacacatgggttgggactgtgactgctaactaagagtgctctggc

SEQ ID NO: 18678 - DNA, 1032 bp, Homo sapiens
ccaacagctcttgccaggcccccattggctctgcacaatgcagaatgtggacaaccagggctgtctgagattaccaatggactccctccaaaagtggcccgtctgcgtcccaggaggcgttccgaggacaggcagagggtcccttcacagggatgagctatgtggcctgggcagtccccaacacagtcgctgtctgatttctctggcatctccgtagtcataggaaggaaggccttttgtcatattgctgcctctatcttgtaaaaccattattttaaagagttcccaaatactgagcttgctggcagcttgctccaggggcagccccaaaatggaggtcggacacacagttctgcatgtagactgcagatgcggtgttcttgcccttcctgttttttgtttgttttgcttttaattaagaagggtttctgggtaaagcgtctttgccagctcctaccacagagagatgagagagttgaaaatacagggcctggcttccgacttctctgagttccagtctgagcattgcttcttactggctgtgtgaccttgggcaagtcacttcacttttctagggcttttcagtttcctcatctgaaaaatggagataataatagacttgctcttgttgtgaagatgtaacaagataatgtacttaaagcatgtagcacagtattcggcagaaagtcagcatccggaaaggagacctagagacctatgggtatgtgttgttagtttgtttttttggtttgtttgtttgtttgtttgtttgtttttggagacagagtctcactgtcgcccaggctggagtacagtggcgtgatctcggctcactgcaagctccgcctcccgggttcacgccattcttctgtctcagcctcccgagtagctgggactacaggcgcccgccaccacactcggctaattgttttttgtatttttagtagagacggggtttcactgtgttagccaggatggtctcgatctcctgacctcgtgatctgcccacctcggcctcccaaagtgctggga

SEQ ID NO: 18679 - DNA, 1067 bp, Homo sapiens
ctgtccatgaaatggggaagtgagttgggcgtgggggcacaaaccaccaagtggcagtttcatgaaggaaggagtggtttccattgtcaagtggtattggatgtggggaccaggtggaccctggaggacatcagtactagtgtctagtgatgcatacgtagaacacatagcacacacacacacgtacaacacataccacacaccatacacacaaccacacccccccacaccccacataccacacacacaccacacacaacgcacacacacacaccacataccacacacaacacaccacacacacactgaatactacacacacaccacatactacacacacaacacacacagcacgcacacaccacataccacacgtacaaaacacaccacaccacacacaaccacacacacaccaacacaccacatacccccacacacaacacacaccacataccacacaacacaccacacacaccacatacccctccacacacaacacacaatcacacaccacacacaccacatacccccacacacaaacacaccacacacactacacaccacacacacacagcacatacaacacacagcacataccacacacacaacacacatcacacacaccacatgcacacaaccacataccacacacaccacacacacaccgcacacacatacacgtgcacacaacacacaacacgacatacacacacacaccaggctgtgtgtgagcacagtgtgccttgccttcttttccagagcaggttaaatgatgtgcctgggatgggctgcttagaacccagcaggggctgctccggaacccagttctcctccctcggtttccgagggctcccccaaccctaggggcccctgctgctccaggacctcatccgggaaaggggagccaaggggtcattgtgggctttctggaagaggtgtggggccttgtctattacctaaaggaaggcccactttggagaacctgcagatgatcaagtcagggcattgcaagagaggaatcacacatgcagagggccggcagccctctgtcgcccagactggagtgc

SEQ ID NO: 18680 - DNA, 1033 bp, Homo sapiens
tgaattttcattatattttggcatttggtatgctgcctcgtttctgttttttttttttttttccccttcctgttttttaatgtgtctgacagctgtctttgggagcatttggttttgaaggtgctcctggtgttagagcagtgacgggggagtattacctggaagaggtttcttatcctgggccctgcttaacacattctgtgccaggccagaggcccacaggagcaaggccaggaataccggtgccctttgatttatctgatctctctctgggtaatagtatggaattagacatttaaccctggagctaaggttgtctgttaagaggccagcttttacaatgcaatttatttttatggtgcgtccttaatacacaatattaccaaatgcttcggagtctcttggattccagagggaaaggcacatttaaagggacatggtctccgatgtaactggaatttgaaaataaatgggttttccagactctacgaggaaatagtttatctcttaacgaaggactttgaaatgagcatagaggtgggcttgcttttgaaaagcgaagggaagccaaacgctgccccttccacacttttggagcctagacgtccttattggtctctgctagaggcctggggtagatgctggagctcggatcacctgacatctgggccgcatgtcttcctctagcaagtcccgaattgactgtctgctctcccgggagaagctgtccccagaccctttcttcctaactaagccctgccaagagcaggggtatgttatgggtattacggggcattttttgaagggtcacctattcttgatgtagagttttagaaacgcttttctttcccaagtgtccaggagggactaaaagcagttgtgtcctggggttgcaaatctgggttccaggcttgcttggggactgatgccctggtgtgtccttggggatcatggtgcttctgtcttgctttgccactgcaaagcctgtggattagacacggggaccctgggtcatcactgggctctcacagct

SEQ ID NO: 18681 - DNA, 1662 bp, Homo sapiens
tgtcacggtaatgggatgcgccagagatggccagggaagtccgaagacctcgtcttccaaggccaaatccagcgtatggggcaggagctttcactgacgggaaagaaaagttgcgaggacattttctaaaaggtgaaaaaaaaaggcgtgatcagctgctgagccgtttgccgctttccacctgctgttgtctctggcgaggccacagaggatgggacaataaaaacgtgctggcctgcaggaacccctgctgcagccctgcctgccctgctgtgtgtcaccggcgtcctggggtccagaggcttctacccattggtccccaagggctccaggaaccagaggcccatccaggatggctccaagccctgccctggggctttccttctctcttccctttttggcggttcttctgtatggcagccgagagggcattttcagggtgcccaggcatgacccctgagcttggaggcccgtgccgtgagaccccatggagtacgcccaggacagcaggactctcctctgtgtcgcctacgtttctccaaacactcgctttggcacgtggttgcctttggggtgtctttctgcccagctgggtctccatgtggggaggagggagggagactttcctgccctgtcccagccccagtctagacccctcccatcattgcagtctgctgcagggcccaaggggcccatcctggttctggaactcttcctgcatggccatgggcaagtgccgtcccttctctgggcctcactttccttgtttatagagctgacggcgatgacacgagcatcatcccactctgagagcttcccagccagtgtcttaagtgtctgatccacatacatttcctttggctgcagggtgcgacttgggacctgtgtgaggagtgtggacttggagccagcctgcctagggtcacttcctgcctctgacaattgttagctgtgtgaccttgggcaagttactcaacctctctgtgcctcagttccctcacttgtaaatgggggtaatagaagagcctgcatcttggtgggaggtgcaggttcaccccaaggctggctccctttgagggctgggagggaagggtctgtccaggcaggcctctctcccctacttggccgtccgttccctgtgtctcttcgcatcatcattctgctgtctgcatctgtctctgtgtccagatttccccttgttagaaggactccagtcagtgggttcaggcccaccctaccccagtgtgacctcatctgaactaattaattacatctgcaatttccagatgagggcacattttgtggcactgggggttaggacttcagcgtaagaatttgggggacacagtttagcccatgacataggtgttgcctcggacggcggagccctggcctggatgcctttgtccgtgaggttcccgagtgccgagtgccgggagggacagcccctctcctccagccccatctctctgatctcgccttcccatgggctcagcccgaaggctgtttcatgagcgtcatcatcggtcggccctggtatgtttgttcttccaggggctcccaggatggatccagtccctcccgggagccgggccacaccagctgtcccactgccaggccgcatggccaagagtcgcagctgctcctacaacgtgctcacgg

SEQ ID NO: 18682 - DNA, 1854 bp, Homo sapiens
ggttgagtttccctggcatctctggaaggtggggcggggggtccctggtatttgtttaccagctctccaagtgaataacatttctgaagcatcgtgcctgagcatgtgtgacccagtgtgtgtgtgtatgcgcatatgtgtgaatgtcagtgaatgtgtatgtgtgacgtgtgcaaatgtatggcggtgtatggaatgtgaacgtgagatattgtgtgtgtgtgaacgtgtgaatgtgactgtgtgaatgtggatgactgaacatgtgtgaacttgtgtgacattgtgaatgtatgtgtgaatatgtgtgagacgtgtgtgaatgtgagtgtgaatatgtgtgaatgtgtgtgaacatgtgtgagatattgtgaacatgtgacagagacattgtgtgtgaaggaatgtgtgtgatgtgaacctgagtgattgagcatgaatgtgaacgtgtgtgacattgtgggaatgtgagagtgatcgtgtggtgtgtgaatgcatgtgtgaatgtgagactgtgtgacctgtgtgaatgaacatgagacgtgagtgtgaatgtgtgaactgtgtgtttatgaatgtatctgattgtgaaggtgtgtgtgaggcgtgtgattgaacatttgtgcaattgaacgtgtgtgatcatgaccctgtgattgtgagcgtgtgagtgaatgtgtgtgacattgtgtatgtcactgaatgaatgtgtgtgattgtgtgaacatgtgtgaccttgtgtgcgtgtgtgaacgtgtgggcccgcgtgtgaatgagtgtgaacttgtgtgaacatgtgtgactgtgtgtgtgaacgcatgggcccatgtgtgaatgtgagtgtgtgtgattaacgcgtgggcctgcttgtgaatgagtgtgagtgtgtgagattgtgtgaacatgtgtgacattgtgtgtgtgaacatgtgggcccgcgtgtgaatgagtgtgagcatgtgtgattgtgtgagcgtgtgtgacatcttgtgcatgtgtgaacgcatgggcctgtgtgtgaatgagtgtgtgtgtgattgtgtgagcatgtgtgacattgcgtgtgtgactgggcccgcgtgtgaatgagtatgaacatgtgtgattgagcatgtgtgacattgtgtgcatgtgtgaatgcgtgggcctgtgtgtgagcgtgtgtgattgagcatgtgtgatatgtgaatgtgtttgagacagcgtgtgcgtgtgggagggatggagtgtgtgtggagcatgtgtggcgggccctttgtgggagaagtgggtgttgggctcccgcccggccacgctgcaccaccatttggctctgtgaccctccgcagctcactctgcctcttgggacccctcttttccgtcctgtaaaatgggaaccccgttttccccagggctagccgagaatccctgggatgaagcttgggccgcactcggtgctgacatgcggtgggggggaccagacgtgctctcggagctggaccagggacagcccacagctgtgtgccctcctggggagcagggcacagggcatttgaggtgcctgtgtcccgagggccaccctgccctttcctccttactcttgttcgtgtgggaagagatgctagggcagaggccatcgggacttacagaccccctgacattggtggcaaaattggggtccttccctgtagtcctagcagaaggtccacggctttcatcggatccagagaacagcgcctgaccctggggttgaggtgtaggggcctctgtcgggccctcctggtttatttccagggcccctggaggtacccaggagtttaattgtttaactctagtttcccctccagttgctaccctgtcacccccagcctgaat

SEQ ID NO: 18683 - DNA, 1637 bp, Homo sapiens
ccttttcaaaatcaactgttgttctttgtagaagaggcgtttcatttcttcattcattccataaatggacagccagggacggttctgggtgctaggaattcatcaccaacaaaagacaaaaatcccgtgttcctggagctgactttccggagcagcgctgtctgctggaacattctacactgatggaatgttctagatccgcgatgcccaaatcggaagcctccagccacatgtggctatagagtgctcagaatgtggctggagcaatgaggatcggatgcactcgttgtatttaattttaattcacgtcagtttaaggctaagtagcacctgcggccaggggcaccccccgccccccgctcccgtcagtacagagctagtgggaagagctccgtgtgaggaggagcttttctgtgcagattttttctttttctttttttcttcgggtttttttgtttgtttgtttttgttttttttttgagacggagtctctctctgttgcccaggctggagtgccgtggcatgatcttggctcaccgcaacttccgcttcctgggttcaagtgatcctcctgtctcagcctcccaagtagctgggaccaccatgcccagctaatttttgtattttttgtagagacagggtttctccatgttgcccaagttggtctcaaactcctgacctcaagtgatccacccaccttggcctcccaaactgctgggattacaggcgtgagccactctgcccggcctgtgcatattttcttcactgacgctgtttccaagtcacagaggccttcacacgtgtctgggagggttttgcccgggcacttgcaggggtggggtgggaggagcatttctacccgtggccccttcttctgcttaaacacacggcagatccagaaatttctctccagcagaatgcagcccctcaaggatgggggccttggttacatcggtttttatgtttaacttccacccagagcttggcgtttcaggggagcctgagttgaaggcacaaatgcgtgacagttcctgctctgccctttacaagctgtgtgaccttgggcaagttactgaacctctctgtgcctcagtcaatagggatgatgacggcaccccttgcagaccttttggaaggcttaactggatgagtcaccctaagcattcggagcagtgtgggtgggggcgctctgggtggaggagaccagctctaggcgagggtgcctggactccctcatggctgcctctctctccaggccccgccacctctgttcagccagctctgggagacttggattgcatttggctattggagagtgtcaccccatcttttaaagctgcagggaagtgaaggaatcatcctctctagtccttttgtttggaaactgagcccagagaccacaagcaaactggctggggtcacacagctgctgggtcagtcacagagctgggggcaaccgtgggcatcctggtctatcgagtgggtcattgtggtggctgccgcctacctaaccaaacctggtcccacgggccagctctcactgtggggcagccagctggagggacggggccagcttgccccaccccgcccctcccctccacagcagagagtgccctggctccatggggcccagcaca

SEQ ID NO: 18684 - DNA, 1084 bp, Homo sapiens
gggaggatttctgggccagtgatagcagggcaggaaacagaaagaggagggtggaatctaagtggtgggggcttgcaccttcaccgatgcgtagggcagggctgggggctgagggcagatggggtagctgggcagccttccacccctcagctcttcgtgccccccggattcagtgcactctgtggacttagccccccgccccttgcccctgcaccggggctggtagccttggggagggtggactgtgcatacaggggagctgggtgaatcccagggtgctcagctctaggcagctaacggctccctcccccggcccccaaccaaaatggttttcaggcactggacagctgcccagaggtaagagcgtagacctgaaaccgcttgagacctgtcgtacccctgcaggtgtatctttcttaataatcagagtgaccatggcaggtggttaccgagaagtgctgccaggtgtaagagccacgtctggatgagactcgtgctggaatgtgtgtgcctgaggcaggccaattaaccttctcaggtctccccactcgggctgtgtaatggaggtcactgcctgccttgcagggccgggagggcttccagtgacatgcgctgagcagcgctggctcttgttaggtgcttggtgaatggcacaggtgatctttacctcctggcccacggacatccaggtccctgatacttattggcggatccaggcgctgaacaaggtgcccaggcaacataatgaaggtgacatgcagttcctacgtgctaggagcaactggccaggatggagaaggaccttgggttaggctgtgtgctgtcctgctgagccctagaagaagcaagaaccagaaagaacgtgtccgggatccatcctccgccagggctaggccgtgtgctcagacttagtgaggttgtgacagtcacgggtggcgcccgcacccctgagcacctgacgtggcccaggttgatgcccaggcagtggtggtggtggtctgtgctgtcatcctgcccccttgccttccaaatttccttgctgccttgaagtgtcccctctgtcagcatctgccctctgctgtct

SEQ ID NO: 18685 - DNA, 1733 bp, Homo sapiens
tgccctgttggggaacccgtttagatggtctcggccctggatctctgcactgttggggaacccgtgtagatggtcttggccctgggtctctgctgtgttggggaacccgtttagatggtttcggccctgggtctgtgctctgttggggaacccgtttagatggtcttggccttgggtctctgcggtgttgggggaacccgcttagatcgtctcttgaaaaaggtttgtgtccaccgccccccgtgctggggtgtgcagggagtggagtgtgcgctgagatcgtatctattttaaatcaagccgatgtcctggcgtccttttttgaatacagtcttatcgttttacaacgtgttgtttccacctaaatgtacatcttataagactttataggactaaggaagttaatccatccttagcagggatgccagacccctggagcctgtcacctgggcacagggaggacattttaactaagcagctggtttccaggttgagactggttgggatcctgcggagtgactctgaatccactaacagcaggactgtgtctgcttggatgctggagctggggtttctccagccacggctggcagagtggaccctggggttttgtgtcatccgtgtctcttatccactggagagactgttgtgttccttctgccagattacccttgaagaagcaggggaggggagggcgctccggcccacctctgcttacctgcccacctcgggctcattcttcccaccccatactccccatgcagccttcaggacaggagacatagcctggactacttctcatggcgcaacaagaactttgttaccagtcttggtggcagagactgccagctcccaacagccaggtctgcacctgactgggaaatttactagttcctcactgggattctggaggggcgtgtgtgtgtgcatgttgagaattacagaatcatttagacttaagcagtcagccattcagcagttgacaggatgattgtggccggaaaaggtgaccagtttgtcctgtttggtggctgggttggatgagggagtccaggactcctggcgcatgactgttatgggagcttttcctggacagctccattccaaagtccatcttggctgagggtgcttgttggttttttccagtgaggcatttagtgatgtctgggcacagcacttggggctttgaagatgggagacgagtctggacgaggaaacgccattagaacgtggatggttctgggccctttctttttccaccctgtatttcctctgtccaggcaggtcatattggggagggtgttcatactcgtgggttgccacttagggaactctgtgctgtaggagtttgtagcctgggttcatggatgctacacatcttcaaacacacgctcccacagggtttacagataggctcttcgaacttggtaaaactgtatgtaacatgcagtaggtgtattttcctggggagagggtctggtccgccactttgaaccatcttgagagtggacctttttgcaaaggcggatgtaactgttttatgacttgaggggcaagtcctgacttggtgagcttgctttgattcaggggagacctaccttggggttgacacacgccagaattgtggccttcataggcgtcccctgaagctgagcctgggaaggggttgacctctttctgttacaccctcatggagttaccgtgtcgatgacatctgagtggagtgtctgtgc

SEQ ID NO: 18686 - DNA, 1073 bp, Homo sapiens
gagggcctccctggtcaccagggaagggctggggagctgtgggtgagggctcaggttcagactcctgcagggacaccccagttccctccacctctgccctgtggctggacagccccacgcttttgttggcggtgctgacttcgtgccgtcgagccgccatccctttgaatgtccgccttttaaaagcctggttcactgcagaaaaattagaacatacagagagagaaaaaggatgaaagtgaaagacatagctcttctcgttgccatctgaagacactgccagtagcctcaaggtgtgtgcgccatctggggtctggtctgggactcgcgccatggcctctgtgtaccactgatagggtttggatgtgtgtcccctccgaatctcatgtggaaatgtgtcctccagttttggaggtggggcccagtggcagtgattggatcatgggggtggatctctcatgaaggggttatcaccgtcaccttagtggtgagcacgctctcgcaagatctgggtgtttaaaagcctgggacctccccactcttgctccctctctcaccactggatgtgctggcttccctcgccttccgccatgattagaagcctcctgaggcctccccagaagcagatgccagcaccacgcttcctgtacaccccacagagtcaggagccaaaataagcctcttttctttatgaattacacagcctcgggtatttctttatagcaacacagacagcctagttcagccacccagcccgtgcctgtggctggtggtcatagcacatctgcccgggtggccagccagcctcatgaaggccacaggagagagaattggcatctgctcccagaccttcagggcgggtcacctggaggtgaaatgaccatacggtgccccacgttccccttttgcggtagcatgtggtgtggtttgcagggcatagtcagccacccagcctgcaccggagatcggcccctcctgcggccctggagcaggtcgagctgggccctggctggcttgtcacatgggcactgtgctgaggtcatctcagccctgctctgcactggacctgggct

SEQ ID NO: 18687 - DNA, 1054 bp, Homo sapiens
tcctggaggccctgtgcgggtgagtacatcggcccacgcatcagtctgtcagaagaaaccacccgctgggggtgtcccgttattttctcctgttctggaggccacaagttcacaatccgggggccggcagggctggtttccccagaggcctctcctgggttgccggtggctgccttctccctgggtcgtctgtggtgtctccatgtctgggtcctgatctcctcttctcataaggacaccagtcagctggtttagcgcccaccctaatgtccttattctcattcggtcacctctttaaagaccgtgtctccaaatgcagttccgttctgaggccctgggcatcagggctctaacacggatttgggcgggggtggcagtccagttcaagctgtgaaagtggtgtttgcacgctgagcacccggcacactagctgtgactgtcatagtctgtgaactgaacaaagaattgaggtaggaaagatcccagcccagacgctatcagaacaagacatctggtgggttttgtgtttctgtcttacttttggggctcccagcggaggcccctccccaagttttcggggctccttatgtctgtgggcccctcgctctgcactgactggggcctgcctgtgtggaaggagctggcactgggagctgctcttctgccgctgcctggggcctgtgcgccctcaggtgggtacctgcagctctcccggccccccacccctggcgcgcagcctggagtgggcccttcctaattaagagcgattctcaggggctgctgtcacctggacttttctgctgagttcccagagggacagccccacttggaaatactaattaaaccacaaagaaggtggggaggaggggagagtcactcttgcctgaagctccctctcccccaggggaggacatgggtattggagccacctgctcatcatcagggcctgtctgccctctatccccagaggtgtgggaagggagccagcctcagtccacaggtgacagcccccgggcaggccctgatccagggtcccagtgggaatccctgggag

SEQ ID NO: 18688 - DNA, 1057 bp, Homo sapiens
aagtgcgtctcgagccgaggagcccctctgccctccctgtcccttgatggcagctgggcagaaagcctgggctggaacctgactggactccttggccatgcctgtcctcacagtttgtccacctgccaaatgggacaatgatcgttcaggctctgctctgaaatagcgcctgtctcggtagccgtggtctcctgcagtaaacctgcaggccgaggagctctcgggcgtgcttgggcattttgtaagccgctttgattgtatggaccttaagttcttcctgcaccagtgaaacccggctcacctcccgtcactgttcagattagcgccctggctcgttcctggttatgctttttaagggcctgccccaggtccgtctcttgttcctggtgcagcagagcccccaactctttccatgtgctgcaggctgcagatggacgaggagctaaggcgggagagggagcgcgagcgcgagcgcgagcgtgagcgtgaggctgaccgcgagcgggagaaggaacgtgagcgcgaacgcgagaaggagcgcgagcaagagaaggagcgtgagcgtgagaaggagcgcgagcgcgagctggagcgccagcgggagcagcgggcccgggagaaggagctgctggccgccaaggccctggagcccagcttcctgcccgtggccgagctgcatgggctgcgtggccatgccactgaggagcggggcaagccctcggagcagctgaccccaacccgagcaggtacctgggcgtgggtgggctgtgctgggcaaggtctcagccacccgcggggaggagccctgaatcgcagcacctgccggttgccgtggtgtaaatgttccccagctgagttcgccctaaaagcgtggtgtggctgaacatggagtagggagcagaggcacgttggcacacgatgtagacacagtggatatagctgaccccaggaggacagttgtgaaatgtagccggggcattaggaagggatgttttgagtgcttcgttgattttatttctctgtaagtttacgaaacaattgtccagtaataacaacc

SEQ ID NO: 18689 - DNA, 1028 bp, Homo sapiens
gaggagaagtggctggcgcggcagcggcggctgcggcaggagaaggaggaccggcagtctcaggtgtccgagttccggcagcaggtgctggagcagcacctggatatgggccggcccccggtgccggcggaggcagagcacaggccggagagcaccaccaggtgagtgagccccaggaaggaaggagggatgagccttcacgttccgatttgttcagcgtgtattgagcacctcctgtttgcccaacatcctgccccagcgtttctgcctgcctctttcatttctgttctttcatcttcacgttataatgcctgtcttgcctatggggaagctgagactgaggaagaaaatggattgctcaaaggtatccccaccagtaagtaaagagaccaatcaagtccatgttgagagccagggcactgcacacgcagcctgacctagttcccaggaggccattcacagcagatgaagagtgcaaggtagaagctttaattactaataatacctgttctctccatcttcctctgcttttgagcctggacttctttttttaacaagaaggggacagcttttgattttaaggaaaaaaatgagttttattgcttttgtattaatagtaaaaacacatgcccgttttctagccctttatgaaagcatttcccaggaaactgtgtggtggtcccttggaccccggctgcagacacaggtcttatgagctgggccccagtgcccccagtcctccctgcccctgcctgccctgggattcctgccttggggctgtgctggtcccaggcccccacgtcatatacccccagggctcactctgaagggctgagctaagatcctcagccagagttggtgggaatgacctgccagccttccatagctctgctccaggcccagctcagggacctagggacactgattctgttccctgagcctcactttcctcaactgtccacaaaggagggtgggtaggatgatttctgagcatctttccagctctcaaggctgtgatgctgtcctgg

SEQ ID NO: 18690 - DNA, 1057 bp, Homo sapiens
gaagcagggcctggcctcccctggctgcggtggttcccctgtggccggctgcacacgtggccttacagcattgtgaacttgggggcctgacagggccctcatgctccaagctagaaaactgttcagtgcttggtgtggcgcatgaaatatttattctcctgcaggtttcattcccttgctgtttacttaaggacacagcttcttcctgtggttccctgttgtattctgctaagagggacagcagcgtcggatttgtcccttggcctggagtctggaataactagggagagccttggtggctgtgtttaaacagggctcccggggcaggctagagatccctgagcccggccgtgtgcctgctgtggcctctgcctctttcttcccctcaagctttgcccagggtctctgcacagtattggtccagacatcctgtgagtatatctccctttaaaaaaaagaaagatagccaggcacagtgacacatgcctgtaggcccaactactctggaggctgagatgggatgatcgcttgagcccgggagttctcggctgtagtgtactatacccactaggtgtcccagctaagtccagcacaaatatggtgacctcctgggagcgggggaccaccaggttgcctaaggaggggtgaaccagggcaggtcggaaatggagcatgtcaaaactcccgcgctgatcagtagtgggattgctcctgtaaatagccactgcactccagcctgggtaacacagcgagacccatctcttaaaaataagctggaaaaacaatactaaaaatagccctgtgagtagattaaatcttgttttaattgcactgaggaaacaagccatttagtgtaactaaggggcagcttcttgtttaatggaagggttctgatgttagaaatcccttctttccctccctgcctcagcaggccttagcctgggtccttgaagacactttgaggcctctgccacaggccacttgggcagtggggtcgctgcagttgtgacaggggccactggggggcagtctcggcacaggccccatcctgactggg

SEQ ID NO: 18691 - DNA, 1063 bp, Homo sapiens
gtttcctctagattttagtcactctgccataccagtttgagccaagtcactccattgactgggctggtctcaggccccaccaggggctgccatccccacgggaggccaggtgtgctcctgaggatgtcacccaccaggccacgccatgagacagggcatgccctcttgaaacggggcacaatgaggctgattcctgggggagggcagagccccattatgcctagggatcaaaacagccacgccttgtgagaggatgggctggtgtctgctgagggctgactatagaccaagctcaaagagatggaggcagccgggcgcagtggctcacgcttgtaattccagcactttaggaggccaaggcgggcagatcacctgaggtccggagtttgaaaccagcctgggccaacatggcgaaaccctgtttctactaaaaatgcaaaaattagctgggcatggtggcacatgcgtgtaattccagccactccggaggctgaggcaggagaattgcttgaacctgggaggggaagttgcagtgagccgagatcacgccatttctctccagcctgctacccagaggactgagggcagccaaaacaaaaaatggagtctcagagatgaattccaacaaaaatggtccacgtaccagaatcaactagcactcagggctgcgttgtctcctggctgtctcggactttctcaagtggcccagaggccttgggctaggtccctcctctctacgcgatgtcatcttggtccccggagccctgcagtcatgttgactctgcaccaagggcagagcagagctcccttctgagacagcaccctgtgtcccttcccccaacacactgatgcaagccctgtcccctccacagggagcgtggctgtgctgtctgcagagcagaaccacaaggttgacacgtccgtccactacaacattcctgagctgcagtcctccagccgcgcccctccaccccagcacaatgggcagcaggagccccccactgcaaggaagggccccccaacccaggagttggaccgggactcggaggaggaggaagaggag

SEQ ID NO: 18692 - DNA, 1027 bp, Homo sapiens
aggtgttcagagggagtctgctacaaactatcagggcaaaatctcactggatttctccactgaaaacctacttgaggtttctggtctgaaggcttaagagtcacatcttagcacttccgctctcaggcctcctcctccatcacagatgtctggatgcttttggaaatggccttggctaaagtaaaagggaaaagtagatccgataacttaaaaacgtagctcatcccttaccatccaaggggcactcccttggttggattttctatgacagcacaggggacaggtggcacaccatgagaggtctgcccagggtgggagcagtgtcactgtgctagcaatagttggcttctcccctgtcagtggaaaccccacttctgcccggcccttgagcttcttgcccactgtctccccatccttccacctacttgtggcgatctgagtactctactcttgctcaagaagtaatacgacaatcagaatacaaaccagtaaggcaacacgaataaactaagaaaaaggtaagaactgtctcaaaaacgaaagcacaccacccaagacacagtacccagtcatggtttccccatccaactattagtttcatactttgaaaacttactttcagattattctcaaagaacacagtagcacctaaatctgttttcaattgggcttaaaaattgacatgcaatctcttaagttttttgttcagctacttcacactgagtacctcaaatctgctctggagtcgattatgccacctgtgtgtcaggatgcacctgaaagccctcggctcggtccttagaccatcttcctacattacctggaagggagctgccatctgtccctctgcagagggataccttccaatagtaaattatctggttcctcactgaaacaagttatttttgcttcatatagtcagagtcagactgacatgataaaatatcatgttcctaatctgttgtctcagataagtgaccaagacgggactttccacattttagtctacattctaatcttaaaggaa

SEQ ID NO: 18693 - DNA, 1051 bp, Homo sapiens
cttggttctagattaagaagtgtttataagtcaaattgaatctcttctggatctttggttatactgatacttccccacttacccttcccttccgttccacttttttaagcttcgagatctacccctttcaaaagatcttctgcaccataactgactgaccttaatgacctccctccccaccttgcccccacaactcccaaccatttgcatcacctctgtttacattatagaggcaatggaaacgaaagagcctggacttcctagcctgagctgggttttcatctcatttctatcaaggactagctactgaagctcaggaatctctttgctcacctgaagtatatggacagagcttagttctgtgtctggcatacagcacatttacttttgcatgtatctggcgtctatctactttgtaccagacactgttaggcaccgagaagaaaaagaatatgaaatacacacactttccaggaggctgtttgcaatctgaagagggacggatgggtgaagacagtgttttattaagagatggctcctgggtagaagcatttagcccgatgtgggtttcagggaaggcttctggaggaaactctccagggtcttttcattgccttagtagagtctacaccctgcctggttagagctggtcttgcctgcctttccgatcttattactgactgttgtactcaaaacccaaaaactaccatcagaaccacccatccccacttgctcactgccccagccccctggccttactccattcctcccgtagagccccgagttgtgggtggtcgctcctgtctaatcattcaccctcgatacaaatgtgcttttagaacggcctctcctgaccatcctttctcaggaagctccctgtcacctcaccttgctgtgcttttccttataacactggatgcctcatgaatgcatgtctatttgagtattgctgtctcagcctcttagagtgtaagccttttgaggccagggagcctgcctgtcttactcattgccgtatctccagcacataggaggcagatgaagacgaact

SEQ ID NO: 18694 - DNA, 1853 bp, Homo sapiens
aagcgaactgtatgcattttcttctttccttgccctgtcacatgcctgcgtgggcacgtgtgtgcacgtacgtgcgtgaacatgatgtggcctgggttggtgtatccttcagctctgtgtttcctccttcacaagtgtggttttggggagaagtggttgaatgttgcagaggagggagctgctgacctttgtgcctgtaaatggctgtcctctctgcccccagtgtatcgcattaagttcaaggagagctttgctgagatgaacaggggctcgaacgagtggaagacggttgtgggcggtgccatgttcttcatcggtttcaccgcgctcgttatcatgtggcagaagcactatggtgagtagagagggaggaaggcatgggcgcctggactggggctccagcctgcagtgcccattggtgggctgtcggggacctccataccttgaggctatgagatagggactgcattccagagttcatctcaggattgtttccaggccttggtgacctggagaactgaagtcgtgggaggttagtttataagccagcatctgattattcatagccatgcttgttgggtggtgaaataccttaactactttgtacagcacaccacgttttcagtagcaatttatgtgctcaccagtcacttagcgaaagatgacttcgtgaaggttcgagcaaggataaggggactcattcattgaatgactgtctggactgttgtgaggactgcatctcaacagccagcatctgggggtcccgacctgatagtttgtgtgtgggcattgccgggttgctcgctcgtggtaatgactcttccccgaggttctttctgtccaggcagaacaggcatttttgcattctgaataggtatattctcgtacttttggtttgaatgtggatgtgggttaataacagacccgaatctatttgatcttccaggtcaccttgggctctgtttgtcagatcctgttatccatagcctttagagaggaccttctgcttttagcttattttgttgctaactttttacaaacaaagggctaattttaaaatgtcagtgttgtcagtggtcagaaaccgtgtgtttgagcgggtgttgagtggcaggtggctctgctgacctggtggctggtgtgtcgggaggatttaacctgtgtgagggattggcctagaaacaacctgttgagatagtcttgccccataacctgtctcacaccgtagtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctgaaaccctttgtgatcagttctttaatgatacctaaatgaaagctaattaaaacaataggtttctcccaagggtctggagtaaatatattttgggtgcaaatgaaatggcaaaaatctagtatcttaaattgtataaggggacattatataaaaactgaaaatatagaattccttgatgtaggaaatttgaggtttttggcaagagatctttatataagtaaaatcccattatcgtaggcacaccggcaggagttaccacaaccctttttttttgttttgggagacggagtcttgctcttgtcacccaggctggagtgcagccgcacaatcttgggtcactgccacctccacttctcgggttca

SEQ ID NO: 18695 - DNA, 1030 bp, Homo sapiens
acaggaattctgctgaggtcccccctccttccggccaatggcagaagtgggggaaaatttttagaagaaaagcaaacatgtgagaccaatcattatcaaatacttttattttttggttgagtatttatctttttattttttattttttttttgaaagaatgtcttggaatgcgcaagtctccctttagagccgtcttttgcagggagcgggaagtgacaagagctcagatctccctcccgatctccctccccacctccgaagtctcctccgtggaccacaggtggatctttgtgcgaacaacttgcatttcggaagccactgtccgtctttaaacagaaagtcaaaggagccacgaagcaagcggccgtccgggcgtccgcctccgtccccttccatgttcctcctcttccttcgcttcagcctcttctgttatgttttgtcttgaattttatttagactttttcagtgggtatttttctgtctcccaacctctactgtaaactttctggtccgagaacgagccgaacacagcgcgacgcagggactaggacggcccggtgaccgcgcggattcaggattgcggggacgcagaaaggttaaggcacttttaaaaactatagcaaggctcctgtttatttattctactttctttccctaataatcaaaacaccgcgtaggctcctccgtttatcagtattaatggtgtaactttgttggcaatatttgccgtgtagaattttttttagatatccattgtaaatttgaaacaaagaccgatctgtgtaaaaacaaatttccatatgttttatataaatatatatataatatgaaggactaccctccttttttttttttgtattttggctgctagagtgcagcatttgtgacacgtatttgaaatttgaaatttccttctgcactgtataaaaggaccatttgaggatgttttgccttttgtgtattttttcctaaaaaaagaacaaaaataaaaatgtataacatttgtacatggcctttaaaattgtatca

SEQ ID NO: 18696 - DNA, 1077 bp, Homo sapiens
ttaatgttaaatgtgtaactcagtattactgaaaaggtacccacattttgaatagtagttatcactcttaggtcagacagccatcagaattctcccacaccaagtgcatgtcagttgtggagaaaacatagcaaaaagagccgtacgctctttacagatactaatgtcaagagttaaacctcctcaggttcaacctgtgataaaagactagtgcttcccagtacttgcatggggttcactatttatagttttcttgggagtatcacaggaaaatcacaattacaccactttagaccctatgtgtagcaggtcacaacttacccttgtgtgtttagatgtgtatgaaatacctgtatacgttagtgaaagctgtttactgtaacggggaaaaccagattctttgcatctgggccctctactgattgttaaaggagttcctgtcacctgctccccccacccccgcatgcgtctgtccacttggctaacttttaatatgtgtatttttacattatgtatattcttaactggactgtctcgtttagactgtatacatcatatctgacattattgtaactaccgtgtgatcagtaagattcctgtaagaaatactgctttttaagaaaaaaaataacatgctgaggggtgacctatatcccatgtgagtggtcactttatttataggatctttaaaacatttttaatgaactaagttgaataaaggcacaattaaaaactgtcatcaaagcccagtttaatgggattccgtatttgagacttggatcccacactgtttgtactttccaaagccaagcgggtccttgtatttccaaggaggggcatccaggctggtcctctcgtgcagagggggcactcacgtggatgagcattgccctccgagggcctctgccttgtcaagggcaccctccaccttggccaaggccctgccaccaggtctggcctttacaaagccaagtcctcttgagaactcacgtgccacgggctatcaggatggatgcgaattgacctacatgttttgtgggactataacacccaacaacctactgctgtaaaccaccc

SEQ ID NO: 18697 - DNA, 1030 bp, Homo sapiens
ggggcggggggcgggcgggggcgcgcgggcgggcggggtgcgggcgcgcgccgcgcggcccgagcgcgcgagccgggcccggagcgcacgccgccgccgccaccgccgccgccgccgcccgagccgccgcattgctgctgctgctgccgccgccgccccgcgcccggcccgcggcccccaatatggtgcagccgccagcgccgccgcccgtgccgccgccgccgcccgcgggccccgccgccgccctcgggcgcccgcagcgcggcagccgcaggtggggggccgcggcccgggcctgagctgccccccgcccggcctcggcgcggcgccctccccgcggggctgccggcgaggggccctctcgccgctgaggtggagccgcgggccccgccgccgccgctcctgccccctccctccctcctcccctccccctcccctccggtcctgtctccagcgggagcgcgagacgctggtcaggctccgcggcgcagctcgaaaaggaataatcgcccccgattgactgaaattcctccggagccggcgccgcggccgcccgcgcccgagaccgcgctccggggccgcgtcctcctctcctccggaaaacgctcgcgacccagggccgccggcggccgcgactctgctgtgtcgatcgcctgagtccgttttcaccgtttgcgggatctggaaccgagttacatgcatgtccagtgggggcaggtttaattttgacgacggagggtcctactgtggaggctgggaggacggcaaggcgcacggccatggcgtctgcaccggccccaagggccaaggcgaatacaccggctcgtggagccacggcttcgaggtgctgggcgtctacacctggcccagcggcaacacgtaccagggcacctgggcgcagggcaagcgccacggcatcggcctggagagcaaggggaagtgggtgtacaagggcgagtggacgcacggattcaaggggcgctacggggtgcgggagtgcgcgggcaacggggccaaatacgaagggacc

SEQ ID NO: 18698 - DNA, 1066 bp, Homo sapiens
accactgggcatggtgaggtctgcgtttggaggaagtggggtgacagtgacagctgtgactattggagcacacagtcggtgctgggcaggtgggtcattcctgaaccctcagtgtttccctcctcgggggtcctggccagtcactctcctcctccacaccagcccccagcagctcgcaggctgcctgggcccagccccatcatcagccgctgggcacccacctgagaggtctgaaccctgcccttggtgctgcacggtcacttgccattttcgcagaggggccccctgagcaggaggagcagggccagcatgcacactgcagccaaggtcccaagaaggaagtggcgaggaggaggaggaggactggccccacctgttgccctatgtctcacagcgcagactgggggagacgtgaggatctaacaggggttcctggggggccttcatcaagctgtaatgaatgttgtgccaaacccctgtcaacaccagtgggtacagcacagggttcaagggctgaagaagtgacccagggctagcaaaggagacccggggtttactgcgagccgtggggtggggagggaagtgcagggacgggagaaccgcagcggcttgtagacagcgcaaagttcctatggcatgttcaccccataccctcccctgatgacctccacctgccaaccttcattcaacccaaaactcagggcctcaagcccctgcacagcgcacgttccacgggacaggccaggggctcagaagttcctcatagccaaggaggcaatctccagattggccactcctggattccttagctcaggttgttcttggagtatgcgtaagttactgctatcgggggtgtttaccctccaacaggtgtttggtgggggaggagcctccttgggggtgccaagagcaacagcggccggggtctcatgtctgtggggccactcccattgctttgtgcttagtaactgggtcttcaaggcagccctgtggggtgggaatcatttttatcctgtgatatttcattgtgcacacgtgcagactgaggttgcttaactaccccagg

SEQ ID NO: 18699 - DNA, 1052 bp, Homo sapiens
tgtcaggccgcgtgaagtgagaaacggtttgcggtgtcctccgcggagtgccgggcccttccccggagagcagctctgcagggaagggaagtgggttttcctggaaaacggggcgggaggtgtggagctcggagagactgaggtcctgcactgctaaggggactggccccggccctgggctgggagagggggagctgggactcagcccagggtggagtcaccatgggttctaaggcacaggatggataccctcctcggccatgtgacatcattgtttgggatgcgcccagtgttcggagccttcgaggctctccaggtgcctggagggcttgtagaaatggtggtcaggccccacgccccagactttgtctcatcatgtctaggtgggggccccagcacctgcatgctgacctggtccccaggacgcagatgctgctggcctgagcgtccccggctgtctcctgtctggtgtgggtgctgccgccgggaggccttggccccacggggagatgaggcatcacacacgcagccacaacacgggtcggaggcagagtccagcccagcaagggtgtggcagtggagacgagggaggggtgaagctggtggttccaggaggttccgtctgggtgagaccctctgctgcagagaggggcgggagccagtggccccgcggagctgaggtcatgtgagaaggggctgcagtctcttctgtgtcattctcctgtggggtcagcctcaccccagtgggaactcccactagtgaaagtctgagatggccccatcctgccgtgtcgcctagcagtgcaccacagggcattcggcccctcctgccttcacacactcaagacgttttcatgactcatctcctgccaggagggcacacacagggcacctttgcacggcgctgcctgtcctgaatgcctcgctgtccccgggtggacataggaattcatcacagtcctcctcgaagcccgggttgctctagaagatgaaactcaattgctgtccttgatctgctgctcactagaggccctgggttgggaatcggaatg

SEQ ID NO: 18700 - DNA, 1057 bp, Homo sapiens
ttaattatttgcccagcagggcagcttgactggctggtgtcttgctgagcaataagcagctgaataagggtgcaattgctggaggcggggtcgcagctgcagacctgggcggtcacttagtctgggacagctgcggcggccacagcgaaagccatgcagcctgccccatgcctggctttgtcgcgacggctgctggaacagacgggtgtggtggctcatgcttgtaatctcagccctttgggaggccaaagcaggcggatcacttgaggtcaggagttagagaccagcctggccaacatggcaagatcccctctctactgaaaatacaaaaaaattcagccgggtatggtggcaggcacctgtaatcccagctactcaggaagctgaggcatgagaatcacttgaacccaggaggcggaggttgcactgagccaagatcaagccactgcactccagcctgggtgacagagtaagactgtctcaaaaaaaaaaaagaaaaaaaaaaagaaaactacacacacatacacacaacataaaatgtatgattttggccaggcacagtggctcacgcctataatcccagcactgggaggttgaggtgggtgaatcacttgaggtcaggagttctggaccagtctgggccaacatggtgaaattccatctctactaaaaatacaaaaattagtagtgtattagtgggtgtggtgacaggtgcctgtaatcccagttactcaggaggttgaggcaggagaattgcttgaacgcaggagacgaaggttgcagtaagccgagatagcaccactgcactccagcctgggcaacaaagcaagactccatttcaaaaaaaaaaaggatgatttttaaccatttttaagtgtaccgtaagtggcattaagcatgtggtgcaaccatgaccaccatctatctccagaactcctttcaccttgcagaaatgacaccctggacccttgaaacactaactccccctcccaggttccctcccccagcctggggattaggcatctagcagctgctgtctggagagggatagcatggc

SEQ ID NO: 18701 - DNA, 1126 bp, Homo sapiens
gaattgtgtaaacgaggtaaagccggaggcctgagattgtggggatggggattgaggtcaggactgtcttaccaaggagtgacatttggcctgggattgaaaagtcacgaaggaactgaacattaagaccctgtatgtaaggctgggtgtggtggctcccactgtaatcccagcactttgggaggccaaggtggaggaatgcttgaggccatgagttcggaatcagcctgggcaacatagtgagaccccatctctacaaaaataaacaaaattagccaggcgtagtgtcttcctgcccacttgggtggctgaagtggaaggactgcttgagcccaggagttcaagactgtggtgagcagtgattgtgccactgcactccagcctgggtgacaaagggagaccctgtctctaaaaaataagattataaaccagccaggcgtggtggctcacatctgtaatcccagcactttgggaggctgaggcggttggatcacctgagggttttgagaccagcctggccaacatgacaaaaccctgtctctactaaaagtagaaaaattagccgggcttggtggcacatacctgtagtcccagctacttgggaggctgaggaaggagaatttcttgaacctgtgagaaagaggttgcagtgagccgagatcatgccactgcactccagtgtggacagcagagccagactccatcacacacacacacacaatatatatatatgtgtgtgtctgtgtatacacactcacatactcacactctctgtagtgggctgaatggtgtccccaaaagctaggtctgcctggcaactcacttccaacttcttggaataagggtctctgcaaatggaattagttaaggatctgcagatgagattctcctggatcaggctgggccccaatccaacgaagagtgccctcgtgaggcagaagaggagagagacacgtgccggagaaggccacatgagggcagaggccgagaggcgggagtaaggccaccacgagcctgggaacgccgagggcgccagcagccgccagcagctggagagaggatggatgggaggattttctaaagccttccgataggggtgtgacttcttgattttggactccgggac

SEQ ID NO: 18702 - DNA, 1050 bp, Homo sapiens
atccatcaaagtaaaacagttaaaaaactcaaacactgaaagggtgagttgtagcagtggttgaaataggatcattgctgttcttgtccagcaagtgactaaaagcatgagaaatacttagttttgaacacaggttctgtcaccaataaatggtgagacctgggacagatcctgatctttctgagcatcagtgtcttcatggtaaagtgggtaaaatagccaggatggctgggagtgagaccatgtgttcctggtaaagtgggtgaaatagccaggatggctgggagtgagaccatgtgttcgtggtaaagtgggtaaaatagccaggatggctgggagtgagaccatgtcttcatggtaaagtgggtgaagtagccaggatggctgggagtgagaccatgtgttcgtggtaaagtgggtgaaatagccaggatagctgggtgagaccatgtgttcgtggtaaagtgggtgaaatagccaggatggctgggagtgagaccatgcacacgaagcactcagtactccttgagctcagcagaatcaggactgttacttcctggtgagtccctgagtgcccactcttggctgggtctcatggtggctgctggctcccaccagtcagccctcagactttaagtcacctttagtttagcacttcctggtggaattcagaactgaccccgcacagtggatgagaacattctaggctgtcttttggcatcctgctcggtggattctgctctgggtcgggattctcagtctttgctttcggcacgcagagcagcagcatgtgaaccagcgggtcgagaggcatttccctccaaaatgggaagctcactcttgaattcctccgtgtcccaaacagtcttcacccatgtcctgtgcattcttctagggactttgggagacatcattggacgaacagaaggacccctgtacaggggaaggccacacggaaaactaaagcatagtaaggacgtggcaaaatagatgaaaaagtgctgagggttgtgggggcagtgagtggttttggttaggaatgtcagctgt

SEQ ID NO: 18703 - DNA, 1050 bp, Homo sapiens
cagacacgtctccatgcacgcatgtgcgcggctgtacttacctgtccttccagacacgtctccatgcccgcacgtgcgcggctgtacttaccaggccttccagacacgtctccatgcacgcacgtgcgcggctgtacttacctgtccttccagacacgtctccatgcacgcacttgcacggctgtacttaccaggccttccagacacgtctccatgcacgcacgtgcgcggctgtacttacctgtccttccagacacatctccatgcacgcacgtgtgcggctgtacttacctgtccttccagacacccagacacgtctccatgcacgcacgtgcgcggctggacttacctgtccttccagacacccagacacgtcaacatgcacgcacgtgcgcggctagacttacctgtccttccagatacccagacacgtctccatgcacgcacgtgcgtggctggacttacctgtccttccagacacatctccatgcacatacatgcgcagctggacttagctgtgttttttgtcacttagtattgttgtggcactttttccacatcggtccttagatagggactgcatcctccttaatgtgataaagatgttccataatttaaaaaaagtattcttttgtgcaatttgaggttgatttaaatcgcgttagttgaaagcgtgtagtttctggcattttttaaacattaaaataatttacttttacagcatattataatattgatctttaaaaacaaaactggtttatttatttttttaatttttccattataatctaaatatcatgatggattttgaacgtctcaccaatgagcttttggcagtcgaatgttatgtcacttttcttttctttgaattttcgtttccatttcatttccctcacaaaattttatcctgttagcctggctgtcgtatgcatttgcaacagaaatagggatgtagatcgaagctgaaaaaatttatgttcctaaccataaggccctaagtgctaaaaaaaaacaaaaaaacaaaaaaaaaaaaaccttctggattgaagg

SEQ ID NO: 18704 - DNA, 1090 bp, Homo sapiens
gcctttaggtttgaattctgtgtgggtttgctctgtgttatccattgttggaaccatgtatttcattttatgcagagttgcttttgaaattcataaacagcttgagtaagcctttgcaaaagccagatgaaaattaatttttggcgtggatggcatatctaatgtgaatctgttctctgaagacttacctggagatggtgaggctgaccttgaactgaattgacatggagttggttgtgttgtggaacgtaacaccatgctctaaggctctgaacaaccgtgcagcccagtgactcgcaaaggatggccttctgatttgttcactatcctgctggagatggaaatctggcattcgtcacctctgtgactgcaggggactaacgtgtggaatcccagggacaggaacactctgagccatcgcctgaaaagtgaccgtggagctacatttcccaggacattcatggaagttagggcttcggtcttggacaacacacagataacatttgtcggaattattctttcatctgttcttggaaagtcagcattcaaatgaaagtaggagagagagggatcttaaaaagattgtgtttcaattattggttaattcctttctatagacggcctaagaaaaaaggataaattaataactattcactgtggtctgacagtacaaattccaggctgggatttttaaatcatcgttttgtttccctttttcccgacagtagggaattctgaatatataaaaagttgagtaatacagcaaattatatcaggaagcagatatgagacagtgccttccatttcagtgtagaaaaggcatcatttaaactcagagtctttgaggatcggcagctttctaggaagagacactagaaatgtgtgaatcactggttgttaataggcagggactctcatggcctagagcgtttgcctccattcccagtctgcctctcacttggcctgcgacctcgatcagggtcattcacttctggagacgtctgagcgcctctcccgtgagatggatcatgggctggcttagctgctggggttactgtgaggactgaggaaatgaggcctctgaagtggt

SEQ ID NO: 18705 - DNA, 1044 bp, Homo sapiens
cacacctgaatgcgctgctctgggcggctgcattgtaactgccctgagaatgctggcgtcaagggcatgctgtgacttacactgtgcagaggcaaggactggcattgtgtgcacgggggcgacgccaggccggctgctgatgctagagcccctcacctctgcgtctttcttggtgggagtggctggccagtgggagagcatggctggcagtgaggtgtgagggaccccggggagggttccgctctgcaggtggctggggcaggtaccaactgtgtgcaaggatatcggtattgctggggtcccgggtccagggtgagcagagtgtgtgaccgtgttggcgctcaggtcccgaggccctgcagccccacaggcacgtggccgcttctcgggggtggtgggatcgtgtctgttccgcgtcagttctttcttgggcagcagtcggaggctccagcgctcttggtgactgcctcacaagttacgagggatttgcccagccctgcgtggagcatctttcccgactgtgcctgagcagagcgctctgctgtcctgaatgtgagcttatttgagccttggccatctgaggacctgtcttctgtttttcagaggactaccccaatggcacctggctgggcgacgagaacaaccccgagatgcgggtacgctgcgccatcatcccctccgacatgctgcacatcagcaccaactgccgcacggccgagaagatggcgctcacgctgctggactacctcttccaccgcgaggtgcaggctgtgtccaacctctcggggcagggcaagcacgggaagaagcagctggacccgctcaccatctacggcatccggtgtaagtcgggccccgccttgggggactggggtgtgcggggagctgggtcaggacccacatttcaatgctgaggacgctggcatcagtagcaccggcacggggctgcgtttctccaggcggtttgaaatctcagcccgaggatcagtgctcgaggggatggatgagctgttgaccctgatgtgcttattacgcacggcatgc

SEQ ID NO: 18706 - DNA, 1032 bp, Homo sapiens
ccaaaagcttaatttaaagaagtgaccacagactatattgcactattcaggatttagttatctttttgaattgtaaacagataatcaagaacaaacattccggaagatgtttcttgtttcctttgcttttgattttcttctgatgcttcttggtgtcttttcttgctgcggatcccacagggacacctccacatcgcccaggtgccgcagggggagcaagtccagatcacgcaggacagcgaggtgagtcagctctcgctgcagcactgtccctgcaggcaccgtgcccacatgctcccgaccttcatcggtgtcacagtgcgagggcagcagggagcccccaggacagggaacgtgggcaagggctgcaggactccgcttccagggtgcacatagcgggcctgcagtctctgtggcctctctgcctccccctcctgtccgttggtctccacagcttctggtctgtcttggtaaagatctcctgggtagatgtttctactgctggctggaagtgccctctgagtacccttctctccctgtctggccctgcccttcctgccaggggaggcccccagtgtggccgagatggggtctgcccctgcgtaggtgacctgacataccccctcacctgccatgtggccccagcttcctagtggcctctacgggattagtgccgatttcatgggatggtggggaatcccacaaggtgatgctgccagtcctgagagctgctcatagcccttgacgcacctgctgggtctgtgattgtctcagtttctggagctctacccggccacgcactcagaagtgcgggctcagctgctgttggggtctggaatgtgaaggcggcagtgacagtctgagttcttggaaagccgaggccagcctgttgcgatgctccatgtttgcatgccagagcaggactgtctcccgggtgaccgtccttcgactctgggctgtttcctgcagcacaggcagcagcaggcacagggcactaagcagcacacacgtgttgtactcagtgaccgtggt

SEQ ID NO: 18707 - DNA, 1045 bp, Homo sapiens
gccttcgaagggctcgctgttagctgaagctgaaatgtctttatcacaacccctgagatgctcccactgctctggtcacgcttcacgctggcccctgcactcctggcccttttgtttagccccgcatcagactctgtgatgtcagacagtggtggcaggcctgatgattcgaagattgtttttgatcaattttaccattttcaaatatatatttaaaaggttattcatttcttttacctgtcatacccagtgtagtatacttagcaacactgagtgatcattgagtgaatgaatacaatggcaactgttgccaagttagcagttagttatatgatgcacacattgaagacatttggaaatactcttgtttgagccatttaaaactacggcttacgttcaccagatctttaatcatgaaaacatatagaacagtactgatttaaaactctgtaactcaaaaagcagaaaaagtgtgatttctgaataactttacaaatccttttggtgggatccaaatgtgagaactttttctgaataagggagttttggtgattctttgggtgttctgagacttttctgttgccgttgttgagctgtgtctgccttttctggtgggcgggcctgccgtgttgtggtggggagcgacttcacacagctggcacgggatgcttcgaagtggggtacgggccagccgccaagagctcacccagcgcgcctgttgctttgggtgcctctgtggggagcagctaatggatgtgtagactcttttgccccaagaattatcttctggaaggctaccagagtagctgcctgcgaaaggaaacctgggcgttactgctgcaccaggattcctggcctccagaggaaggatggtggctgaaggtgagccttctccagggggatgccctggagactcttgcggtcccctccacgtgttcacctcgtcagagtcaagaaacgaggagtgaaaaacacccctcaggtcgcttcatgctgattctgtttaggccccggcttttccctcatgcaaaatgcaggcactctg

SEQ ID NO: 18708 - DNA, 1046 bp, Homo sapiens
gtaaagaaaccccagagtccagcagaacatctgactctggccatattccttcttgtatagcatctgtttgagacaacaaaatcccgaggcagaaggtcgaccgctccttaggttcattctgatggctcagctattcgcccgaggctggtccccgaggctggtgtgctcgcaagtcgtggctggcagggttgccaggcttgtctgcaaaggaccaggggggatgggttttcagctttggggggcacacctggtctcatcacagctgctcaccacggcccttgggtcatgacaggccagcacgtggggggcctgcaggcctgtagatgctcactgaagatggaggttcctagatttgtcatgtggcacaaaatatttttttgcatttttttctgtcattaaaaatcatttaaaagccattctcagttcacagctgtacaaaagcagccagcaggtttgctctgggcgccgtactttgctaacctcaatgtagagtgaattatacttcgtatctttaaaaggcttgtcttctagcattgcaggtgaactttgcttagaaacataactatttttaaaagcacatgtaggtgaagtctagtctttaaaagcacttgcaggtgaaagccctggtccggcgctgtctctgcagtgtgtttgcgggggccaagtttgctctgtgcagtgctgctgttgtccagggcaggtcccacggaggggatgctgcggccaggctccgtggggtggggcaccctgcgacgggctgctcctcttcccagggccaccggtgagactctcagtgcacagagtgcggttctgtgtggaggtgtgggatgcatctcctggccctcccgtagtggggtgcaaccccaagtgaagaccccgtggctcatgtcaagtgccctcagggctggggctgcccacccgcctgcctgggccgtcttgacaccggagctgcctgcctggatgttggagcgcccagtggattgagtgggaagtgggcctgggtgcttacaggcgatggggtcaccagagcccacccaggggcctcg

SEQ ID NO: 18709 - DNA, 1033 bp, Homo sapiens
tcgtaacagccaaggaagacggcgtgcttaaggggccgctttccctgcagaaaaccccagcgtggttggacttggtggtgagcgggtttgcccatctgaggccagacaactgcagggtgcgttagcttgtcaccaagggcccagctctctgccttaccatctcagcttgtcctcaggctagctctgccccactgggaagtgaccgaaggccttcatggtgactctgcaggcgtgactgcacccaacagagacaggtttctggttgagcctccttatccacatgaagcccccaccccagtcatgcttgggaatggtcttgcatcttgcatgggtcagagcagggtcacgcgcttgagctcgttctaggaaaacctgtggctcagctgtgagggcctggctctgagaagatgggttcccttaggagggaaggcaggtagctggcctgtgggggtggccaatcctcaaagtggagagtggggcctgttccctggagcagtgggttgggagggtaggggggtgccatttgcaggggaagacacttgtcttaatgcgcggtggcctgtgggtgtcacaggctccctgaaccatctgtagcagaggcagcacctccaccagcctctgcccagaacacaggtctggccactgtccttggagggcaagtgagtcccagccagcccagacctgtgccccactgtccccacccacccaagtccccagctgcctttccagctgtctgggggaaggggctttgcatcccaggcggtggcccccctaccccaacctcccatggccttcagccacccaccccagggccctggtgtggctcctccattccagctgaggttcaccccttcccgttaggccttcccagctgtggccgggctcgcaggagacagtcctcatactgacccctcatcctaccctggaaggcccctcctccatccagggaacagtatatcgagtgtcatttgacatttgtcttgaaaaagcacaacctggaccaggtgcagtgtttcatgcctgtaatcccagt

SEQ ID NO: 18710 - DNA, 1108 bp, Homo sapiens
tctggcagctcatggtcagcagttccgaaagacccgacccaggcagctgcccacaccacaggcccgggtgaatggcccgcgtcattctctccaaatcaggctgctgtcctggcgatgggaccagctccggctgccgtccgcccatgtcatgcaattgcatttgggaggtgtgatatagaatcccactgtgccagctgctgcccgggagactgtggccaagtcccccgcagcctcagtttccccacctgttcagtggagtgataagatgtggagagcacctcaatggtgctgaggcagcacagggcaccatgtgcagggtctgggtgccagcaccccgtggagaaaggaaagagccgggcagcacacagggctgggattcaaagctgccacctcttgcttggcagaagggacagagccaggacagttgctccatgtgactgtgcttggctggctgcgttccccaggtcccagcatccacaggctcaagtctgatcctgggcaaagccctggggaacagcgaattcagggccatcgttttggacagactgtaagggttggctgtctctgccacccaaggcaagggtgtccctctctggctttggtgtcctcttcatcaagtggagggctgagtggtccccacaggcacaggcccaatgcctcgggatcgggagcctctgacctgtgtaggtgggaaggctcttgggacaggtggggccgggggacaggaggcggcggggagcagtgcggtctgtggcccacggcaagcacccgacacatcttcaggagatgcgaggggacaggcttatggcggccacatctcatcggctttcaagagaagcctgactgaacttttctgtaacatctcttggctggaaatttttatgagcattttgaaccctgtgcaggcaggctgggtttgcagtctgtgggtcagagctcaccaatagaaatagctagaaaaatttagtataatatgatatacaacataatgtaataaagtataatgtaatctaaagatatgatgtatgacaacctgtcatataacacataacatgatacggtatcctattatgatgcagatacattatatcacataacatcatacaat

SEQ ID NO: 18711 - DNA, 1075 bp, Homo sapiens
gcccatggatcccacaggccagatagaaccctaggccatctgggtagggccttccggaaggagccggggagggagggtccctgagcccctcctattccagcccaggcagctgctgcagctcagaacaaggtgtttttcacacactctcagagtttgattaaacaaattattggtaaccacaggatgactaattcactccaagcttcaaagtcacccacctgctctccccagcagcccaacgcccacccgtggggctggcagtgccatctggcaagggccatttccagttccagagagggctgggttgggcccagagggagatggggtggtttctgtgatgtgttatgaacatgagtgggatgtcagcacagagccatccacactggccttccatgcgtgggaggcacccgggtgttgaggctgtcagaggccaccttaccatgctcatgacccagagtggtggcagagcatccaggaaagaaggggctttggcagcctggctgaccctggtgctgaaccacaggggacaagttactgtgctttccacagctctcagtttccccctgttggaaacatggatatgatagtgtctgccatccaggggctgcaggtcctgctctcagcttacctggtccttggcccagttgcctcgtccccagtcaccatcctgaggggaacggtgcctgcagcctgcttgatgcttaggctgcgaagccatcattgtcatctcagagtcctgatcccagccacgtttttctctctttctctctcttttttttttccttagttaaaatttttttacaaaatagacatggagtctcactacgttgcccaggctggtcttgaactcctgggcacaagctatactcccagctcagcctcccaaagcactggggttccagacacgaggcaccgcacctgccctcaagccacatttagcagagggaattagagatcgggaggtactctcaaggccccccacccctaaacctggactccagcagggtctggcggaccccggagtccacgccgtcacccagctctgggccgattgtggtttaccccctttcctggg

SEQ ID NO: 18712 - DNA, 1030 bp, Homo sapiens
acgcccccgcgagcccaccgccccgacccacccgcgagcccaccggccgctgacgcacctgcgagcccaccgcccctcacgcacccgcgagcccactgcccctgacccacccgcgagcccacaggccctgacgcacccgcgagcccaccgcccctcaagcacccgcgagcccaccgcccctcaagcacccgcgagcccaccgtcccgacgcacccgcgagcccactgcctgcggcgcacagagccaccagatctagagggagagctgagcactcggggtgctctgaaagtcatcatcatcatcattttgcaaagaaagcccccaaatagccctccctgaaacaaggcagccaaaaataagaagtcgctctcaacaggcccccacaggagaaaagaggccggccttggagaggggttgggacttggggccaggtcccagctgtgccggcctcttggctgtacgaccttggaccagtatctttcccactcagagtcatccctgaatggatgtcagggagccttcgaggaaaggggagagcctgcactgtaactgaagccccccaccagccccatgcagctttctgaccctagacttggggctgggaccagtcacccagaatctgatacccccagggccccgccccccagagccccacccccatggccagggcaccactgtcctaaccagcctgttggcagccaatggaaatggggtatgcaaatgagcaggggtgaggcccagggattggctgagctgctgtgtgggggcagggcctcctccaggggctgcccttgacctgggggagtagttcccatcctggaccctgccccaggacgggagacctctgccaccaccaccaccggctctggaagggcccgccttttaggggcctcgctgtctgggcacaggcggatggacaggctggcctctggatgacctgccaaccgtcagagcccagacccacgtggcctcagttggggaccaggacccaggagttcccgagaggagtgcagccagcagccactcccag

SEQ ID NO: 18713 - DNA, 1057 bp, Homo sapiens
cccctgggacccagcacctgcccggcccctgccattcaccccaggcccccaggactgccaccctccactgccccttgggccaaccctagcgggaggtgggctggacaggccccagaccgggcacgcctcatgcctgcgatgtctctctgcagacgagctggagccggtggtgcaggatgggcagaggcgcatacgggcccgactcagcctcgccacgggcctgtcctggggcccgttccatgggagtgtccagaccagagcctcatcccccaggcaggcggagccggtaagaagcccccatccccgcccctgcccgcccaccccaatgcagggcaacatggacccaggggacaggcccagcttagatgccagctccggggctctggccacttgaagatgtgggcctgagatattgggacctggaggatagggagggattcgctgccttggggcccagggagggcttcctgtaggaggtgatatggggcctttggtgccccagggaggacttcctggaggaggggttctttaagcaggaccttgacagatgactgggcattgaagcagaggagaagagcattcaaggggagggaggaacaaaccaatggcccaggccttggggtactgggacggtggggatgctacagcagagagcgagagggtagttctgtgtctgtccccgcggactcttctgacgacaggcacggccgtcaggcccatggtctccatggcctcggcacgtgtgctcatctccttggtgacagcccctgcctggcagagccttccaaggcagccccttgctgctagacacaaaggcctgtgtcgtttgtcttggatgtacttctggggctacctccaacttatgacaagtcagttcggtttcctccgaagagggtataatggtttcttttaaaccacgtctcagctaagaaagggcactggtatatagaaacctgtaagtacgtgtggggctgcatcatgggcggcatagggtctggggcctcctgggccattcacacagccttttgcagctgagcgggcagacgcatgtcccagg

SEQ ID NO: 18714 - DNA, 1034 bp, Homo sapiens
cctctgcgtgtggtgcaaagtgtccgttctagaagacatttttctcgttgctttcaagtagagccctggtgtcacgtctactacccagatgtttctctgtggaagaattactctctttggcctgtaccttcgcaaatggatgtttctgaggcctcatagcattccaggtcccagcagggtcttaccggcccagtcaggagagggactgattcgcctagaggctttccctgcatgcctgcagcctcgtggcctaccccttggcaccctggtctactggatacctggaaggattgaatggcaaagtctagagagccgtttgatttggcattcttttctctttttcttagttttgatttttaatttttgttgcttttaatttaaaaaacagatggggtctcactatgttgcccaggctggtcttgaactcttggcctcaagtgatcctcctacctgggcctcccaaagtgccaagccactgtccctggcctgatttatcattctttttcagaagcgctttctcttctctcagggcacatgtcccttttagattttgggtcactgggacaggtgaactgattatggggtacactttccttgatcgggacatcaatttgtacaataagcccttgaaattgtttaaaccacatagcttgtgcctaaggccttgaatctgtgtttggtatgctgccagaacaccccctgatgcaagtatcttctggaagtgccgctggcctgcgtggtggggtggaaagtttccgtacagggctgggaccagcagtttgcagcacctggctcatttgtggtgtgggtgagggcgtccctgacaccagctgaccttcagtcaccggtctcttacctgttcaggaagcggcatggaagagagctgggtgcagcaggccttgtttttatgctcctgccgtccaaagagtgcgtggagcccaccctgacccactcatgccatgtggcagcctctcctttctcctgcacgtctagtctctccccagaaccacctttcctgctgggagatgacaagc

SEQ ID NO: 18715 - DNA, 1044 bp, Homo sapiens
ggtgtcagcttgtctggctccttaaagaagctcattggtgtttttgctgggattgtgttaaatttatcagtcagtgtaggaaggactgacttgtgggcgattccgagctgcgctctcccagtgcaagaggcgtctccccattattcatgcacgctttgtgtcaggtttcaaaacccccatttattcatgcacactttgtatcaggcgtctccccatttattcacacgcttcatgtctctcaggcgtctccccatttattcacaggcttcatgtcacgtgtctccccatttattcacacacgcttcatgtctctcaggcgtctccccatttattcacacacacttcatgtctctcaggcatctccccatttattcacacacacttcatgtctctcaggcatctccccattcacatgcttcatgtcaggcgtctccccatttattcacgcacgcttcatgtctctcaggcgtctccccacttattcacacacactttgtgtctctcaggaatcagctctgcacatttctggtgaaatgtgttgatattttattcctaagtacttttttcttctttcttgctattgtaaatgcggttttctccactctgcctcctaactggttataatctgtgtctgtgaagacactgatttctatgttaatttttttatcctctgcctttccaagtttcttcattgtttgtttgaattggctttatcaagtctctgggtttttcatgtatagtatcatatcattttgcaaatctgagctcgttttgctccttgttttcgtgttcttgtgcctctagtgggctccccttgtccagtcagggggtgcctccacacagggacaggtggttgcggagactcctgggggagctcctcctattccccagtgagtaaggtgctgacttttgttccaaagtgtgtcagtatatttttatcatgctaaagtatcacttcctattttctttccttttttttttttcttatttaattttcaagacggagtttcactcttgttgcccaggccggagtgcaatggcaca

SEQ ID NO: 18716 - DNA, 1096 bp, Homo sapiens
cgagcgtcacaggcatgcagtgtcgttccccgagctgtgggtccattgaaaggggatgtaggccagcggggccccgtccaccagccctgccctgctcgagcctccctgtctcacagagagaagtcagtgaagaagccggccccgcctccagccccaccacaggccaccaaaaccactgctcctgtccccgagcccaccaagccaggagaccctcgggaagccaggaggaaggagcggccagccaggaccccccccaggaggtgagcactccggcgtccggggccctcaggctttccgtgttcttggtgccactgtgatgctggcactgctggaaatccagagtgccagggtccagagccaggtggtgggaagcgccccctagccgagcagcacccagtgagcccttacccgggaacctgccctgtcccctccctgagcctgtgtttctggagcgtgaaggggaagggacagcgtggcacggagcacaggccttcccgccatggccccgtctgcactggaaggtgctgcccccgagagactgtactttttatcttgacaaaacactgagcctaaaggaagacaggcccaggccctgttccaaggtggtagcaaggccagtctggaggctcacctcacagggctgctggtggggaggggaggccgcgaggggctgtggaggccacgccccctgagccccgctgttgcttgtattacaggcggacgctaagcggcagcggcagtggcagtggtagcagctatagtggttccagctcccgatccaggtcatccccatcaccctgtgcctctgtttctccctccccgtcggggccaggaagtcccagaagcagccagtgtgggttgggctgtctcccacaggtgggctggggcccttctggatctgagtcaccctggggctgtggaaggctgcggttgaagctttgacacaggagaaaatgggccaggactcgtgataggaagaccccctccccccaccaaaaaaagattcacaaactcgggggcactcaggtcaggaggaggtgcctctgccctgctgacttgatgcccagcaccctgagagagcacctgcacctgggga

SEQ ID NO: 18717 - DNA, 1028 bp, Homo sapiens
ggtgacttttgtcattaagaaagactggggtgggtgtggtggctcacgcctgtaaccccagcactttgggaggccaaggtgggcagatcacgaggtcaagagatcgagaccatcctggcgaacatggtgaaaccccatctctactaaaaatacaaaaaattagccgggtgtggtggtgggcacctgtcgtcccagctactagggaggctgaggcaggagaatggtgtgaacccaggaggcacagcttgcagtgagcgaagatcgcaccactgcacgcactccagcctgggtgacagagcgagactccgtctcaaaaaaaaaaatttcaagactggagaggtgatcctgaattgtccagctacgccccatgtcatcacagggccttcatgacagggccagagccagccagctttgaagacgcggccctgccccgacacaggcagcctggagaagctgggcaggacaagtaggacatccctggagcctccagaagggactggcctctgcccacaccttgacttcagtatttctgacctcctaaactctaataaagtcatgcttacagccactagatctgcagaagagccctcgcttgctcccctagaagatgggcccacatggcctcttcctgcagtgcctggagggttctagctcctgaggtgagaaccaggacaggttctgctgggcatcacgccaagcagcacatgcccacagtacagctgaagtctggtgttgtcctggggctccctgccctggggaacaggaggacaggagacggctcttgtgggaaagctgtttactgcgttctcccgctgtgtgtaattgggttcagtgtggctgaaacacagctttgccccaggctttggcacttccagccccaggagaggcgctgaaccccagcaaaggaatgtgttccctgtgggcagccggtgcccctggtcactgcagttgcccaaggctgatatttccctgggatccagctggagatgttgggctgggaggccctgtggtcactcatactgcaggag

SEQ ID NO: 18718 - DNA, 1041 bp, Homo sapiens
accgtcgagccggcggggtccgtgttcaggcatcctcagaacgaatcgtctttggttgtgtttggaataaattcacttccatttctcattgggcttcagaagtcacccttgaagtactccccgttttagttgtttgctgcgtgcaccttgctgggcgcgtggggcacaggttcacagccggcctagcccctgagggcatgtagatctatgagcaagcaatggagacgtgcggccggccgtgaagtatttggaaggtactgcaggcagcccattccctggagagagggaaggtttaaaggggtgaggcccggtgcagtcaggagttgatgttgctgtcctgagtctaaattccaccaggcaggccaggtgcagtggctcatgcctgtaatcccagcgctttgggcagcagaggcaggaggatcacttgtggccaggagttcaaagccagcctgggcaacatggtgagacccctatctctacaaaaaaatgtaaaaattagctgggtgtggtggcgtacacctgcacttccagctactggttaggctgaggcacgaggatttcttgagcccaggaatcggaggctgcagtgagccatgacagcaccattgcactccagcctaggtggcagagcaagacactgtctcaataaataataaaactgaaaaagaagaggtgatatttgaactgggcttggaagaatgattaggaatttgctagaaagggaacacgtttagagataggaacacgaattgtgtctggggcatagttgttgctttcccatcctgggaggacagacattcgtgttagggcccaaggctgagaccttgttgaggagggggttcacatggtggacccaggagcacgggtgttactaccggtggaccctggggaccctgcgagctttgtagcgtgaagcctggctcaggctggtgtcctctccgcaggtgttggaggacataagatgaggcttcccttgctcttgctcctttggctctgaaccatctcctcaaggcagacagaaatggcggattaaactgtggg

SEQ ID NO: 18719 - DNA, 1065 bp, Homo sapiens
tgaggaggccaagcgcccacgaaccgcattccctgccttgctagttagttctccaacacgcgaaaaaggtagacgaggactggttttctttgcagctaaaatgaatcaagcctctggtaagtgtggatcctgttctaagtgcacctgtgttctcctccagaactaaaccaaaaagcaaggtgaacaaaatcggtgctccttcagtttcttctttagttctgcatgttactggggactaagacaacgggtaagcaaactatttataggcctcaatttacgaaataacggaattgcaaagtccggagtggataggaccgtgaggacggtcttttttcttgggcaacacgcattatggtcgagagatcagttgttaaaccgcccctgttcaaatcccagccctaccagtgactagcggtcaccctgtaggctttgtctctcagatcttcagtttcttggtgggtaaaatgggaactacaagtagcacctattcttttttttttttttttttgagtcagggtctcactctgtcgcccatgctggagtgcagtgctaactgcagcctcagcttcccgggctcagaggatcctcccaccttagcctactaagtaggtgggaccacagtcaggcatcaccacacccggctaattttttaaattttcgtagagataggctctctgtgtgtttcccaggctggtcttgaaatcctggactcaagcgaccctccctcctcagcttcccaaagtgctgggattagaggcatgagccacggtgcgggccaggagcacctatttcataggcccatcgggaagattaaatgaaggggctgtggaggctgtagcacggtgcttggcacgtatgtgagctctggggaaacattagttatgctataactggaccttcagccttctctaggcagccagatttcgggctccacccacaactagtcacgccattggatgaggggtgagcgcctgataaaaacagccggcgtatgcgctgatgtgcgttcacgaagaggtgatccaagtgtttccatatttgcctcactggacgaagtatttggta

SEQ ID NO: 18720 - DNA, 1096 bp, Homo sapiens
gcaggcggatcacctgcaccctggccaacatggtgaaaccccgtctttactaaaaatagaaaattagccgggcgtgatggcacacgcctgtaatcccagctactcgggaggctgaggcaggagaattgcttgaacctgggaggtggaggttgctgtgagtggagatcatgccattgcactccagcctgagcaacaagagcaaaactccatctcaaaaaaaaaaaaatttaaatttaaatttaaaaagaccctatctatacagaaagaaaagaagaaaataattggccaggcgtggtggtgtgcacctgtagtcatagctcaggagttggaggagcttgagcccaggagttggaggctcagcttcagactcacagccccagggggcagaagggttgaactcagcttcaggaatgctttgcttttggatccttgaggcctctcgctggaaatcagcgttgttaagatggacgccctgctcagcagagctcatctttctagaaaggcacctggccttggaaggcgagtgaggaactgtcataaggactttttcttcccatgttgcttttcaggaaagctttcaggatgtggaaatgatggttcagctattggatgaggggattattattgtgaattcgagtttagcaggagtttgtttcaggagtgacgtccttcttgattgattttgtgtgagacgctgcatttgccaaggccagggacagctttactctgtgagagaggagctctgactctccctactgagctctcgaggggaggtcataactgcgggaagggacaccagtgtttcgcaggtggattcagtttaggcgtttctggctttaggctcatcttcagcttactgttggttttacggtaagtgtcaatgcttacagccactcagaactatcttctaaaagacttctgaatcttcatacaaaattgttctgaattgatttcagggctctttccctgtatacttcaacatttcaataaagtgtgtcctttgacttttttttttttttttttttttttttttttttgccagaatctcactctgttgccccggctggagtgcagtggtgcgatctcagctcaatgc

SEQ ID NO: 18721 - DNA, 1290 bp, Homo sapiens
aggactgctgacttgatcagacaggcacaacacagtcccggccctcaggcaggccttctccctggtctgatgctgaactgcatggcgtctgttcagatgaagattcttttgccacctccttaaatgaaagaacgatactgaatgtggcttagaaacagctttgccagccgtgcagaatgattgtaagtagtggttgcccgaaaagtatttgcttggaataccactcactgataacactggtgaacctggaaggaattatacggagtgaaaaaaggcaccactcactgataacacgaatgaacctggaaggaattatacggagtgaaaaaaggctccgctcactgataacgcgggtgaacctggaaggaattacacggagtgaaaaaagaccctgctcactggtaaggcgggtgaacccagaaggaattacacagagtggaaaaaagactccgctcactgataacgcgggtgaacccagaaggaattacacggagtggaaaaaaggccccgctcactgataacgcgggtgaacccagaaggaattatacggagtgaaaaaaggccgagctgaaagatcacatgccgtatgattttttttttatacagcattctctaaagacaaaaattaaagagatggaacacagattcgtggttgctaggggttaaggatgggggaaggagacagccggagggagcctgtggttggattgcctcagctgcggtgggcacacactgcgcgtgtgtcatgggatgaccccggggagcttggtggaccgtcgtggtgggagagcctggctgtgatactgttcatagttttgtgagatggaacccctggaagcagggggacaaggtattgctctgcgtcatttatttttatttatttatttttttttgagatggggtctggctctgtcacccaggatggagtgcagtggctcgatctctgctcactgcaacctccacctcccgggttcaagcgattctcctgcctcagcctcctgagtagctgggattacaggcgcgtgccaccacacccagctaattttgtttgtttttagtagagatggggtttcagtatgttggtcaggctggtctcgaactcctgacctcatcatctgcctgcctcggtccccacaaagtgctgggattacaggtgtgagccactgcgcccagcctgctctgtgccatttcttacaactacatgtgaaggtacagttacttcacggttgctaactagaactagaaaactagaaaaaaagcagttgctaacattttttttttctttttttg

SEQ ID NO: 18722 - DNA, 1208 bp, Homo sapiens
cctgggtgcgcaggcacaaatgaccacaacactgaaggcgtggcgggaagaggtgcatcgggcagcgcagtggaagggacgcgctgggcgtttgggttgaacagaagttaaggacttcatgggaaggagatggggggtcttgcaggcagaggaagttccttttatacctagagtgcttttgtttgtttgtttgtttgtttgtttgttttgagatggagtttcactcttcgttgcccaggcaggagtgaagtggcgcgatctcagcccactgcaacctccgcccgccatgtttaagcgattctcctgcgttagcctccctagtagctgggcttacaggcgcgtggtaccacgcccagctaatttttgtatttttagtagagacagggtttcaccatgttggccaggctggtgttgaactcctgacctcaggtgatccactcacctcagcctcccaaagtgcctggatgacagtcgtaagccactgcgcccagccccagctacgttgtgttttttttttccccctgtagagatgggttttcgctatgttgcccaggctggtttctaactcctggactcaagtgatccacctgtctcgactcccaaagtgctgggatgacaggtgtgagccattgcgtccggctggaatttcttatggttcgtttccttaggttaaagtttcagaagtaggatttttgaattaaagaaactaaatactgtctatggcgcttgatacatcttgccaggcagttatcagacagggttgtactggtttgcgccaccccagaacgtgtgcaaggcctgtttgtggaccctccttggcctggctctctaggtcatccacctgcgtgtgctcacagagcatatggatttttccctgcggtgccttcacttgtggctggaagagccttctctgtgatcctgtgtcctgggtgctctgttggcctccttcttgccaccgaggaagacacggaggctagagagggctcactgaacagtgaaatgattggaacctaaggagcttcagcagaaggtgtcatgatggggctaggctctcccgagggctgtgtggcctcagcgtcttgttgggcagatcctgctccctgacacagcggggctaagagccagcctgtgtcacacacctgtgaattaacatgcctggctgaccctcactggagaagggctacacgtttgtgacgaaagcagaagag

SEQ ID NO: 18723 - DNA, 1033 bp, Homo sapiens
cacttgagcccaggaggtggaggctgcagtgagcccagatatgctcatgaagcactgtgggtttctcctgcagtgcaccaccgcactccagcctgggtgacggagagagaccccatctcaacaaaaataaaaaagaaaagaaaatgggacactgttgatacagtcacagagctgaaggagcagcatgggtcgtgattctggatcgtccctccagggcagctagagtagctgctgggaagtatttctctcagtttcccgggagcagtgtgggtcgtgattctggattggccctccagggcagctagagtagctgctgggaagtatttctcagtttcccagtgcaccccatgtttctagtagaaaacacaattggtaattaaatattggaagtagtttctaacaattggatactcacctgagaacataaatttgctctctgaaataagcggtgggctttaaataattgcctttgtgaatatgaaatttaagtattagatgcacgattaggatcgattgtaacaaaacagtgatatctaaaatataccttcatgttttcaaagtaattattttgccacctttttagtgggtttcattttgtgtttttaagccgatttaaaaattgtttgaattcgtctaaaatgattgttggaaaggaaggtggtacatgggacgtgcccaggccaggctttgatcccagcatgaagcccccgcaagacaatgcaggaggagaagagctgtgaatctcaagaagacgtgagcctctcgtcccggctgctgggtccgtggcggtttgtccgcaggcgcaggtgttctggaaatgacgtcgttaccaccgctgggtctgtggcggtttgtccgcaggcgctggtgttctggaaatgacgtcgttcccgccgctgggtccgtggcgctgtgtccgcaggcgcaggggcgcaggtgttctggagatgatgtcgttcccgctgctgtgtccgtggtggtttgtccgcaggcgcaggtgttctgcagatgacgcccttcccagaactggagg

SEQ ID NO: 18724 - DNA, 1515 bp, Homo sapiens
ctacagatgcacaccaccacatccagctaagtttttttgtatttttagtagacacagggtttattcttacatttttcttttctttttgagatggagtcttgctctgtagctcaggctggagttcagtggcacgatcttgactcactgcagccttcacctcctaggttcaagcatttctcctgcctcagcctcccaagtagctgggattgcagacgcatgccaccatgtccagctaatttttgtatttttttagtagatatggggttttaccatgttggccaggctggtctcaaactcctgaccttgtgattcacccgccacggcctcccaaagtgctaggattacaggcgtgagccaccgcgcccggcctgagatttgctttttactcttaggctgatcttgcctgcctgattgaagctgatcgcttacatttgaaaacaaaatatactgaaaatagaaaaacctgaacgttgttattgtcacaaggctggctagatctccggcatctgcacactcagtctgaccatttgggaagctttcatgaaaaagcacagtcagcgagaatgagacgagagaacccatttccacaaccattttaatctgcgcatcggtcccagacgtagggattcctcgtctcatcttggaaacattgccagcagtggttctgatttggaagcctgcgtctgtcacgtgacaccgtctgagcctgtgcctgcctctctttcttccggcagtgccctgtactctgtggggatgacggcagtgggcctggccatcctgtggtatgttttccgtctggccgggatgactggaagggaaggtggattcagtgcttttgtaagttctgtaaatcagagctctctgaactctttctggtttgtgtttgctgaatacttttcccataagctatacgatgaatacacagggaaaacctgttgcagagagtagcctgaagccacaattagacagcagctcaccttcctttcccatggtccggctgtaaggcgtgtagtaaccaatgttgcctgagggcctctcacccctaactctggggtgcctgagccttgtgagattacagggcagttgaatctgcgtttttcttttctttttttttgagacggagtttcgcccttcttgcccaggctggagtgcagccgtgcgatctcagctcaccgcaacttgcacctcccgcattcaagcaattctcctgcctcagcttcccgagtagctgggattacaggcacgcgccaccacgtccagctaattttgtatttttggtagagacggggtttctccatgttgttcaggctggtctcgaactcccgacctcaggtgatcctcccgcctcagcctcccaaagtgctgggattataggcatgagccactgcacctggcctttcttttttgtgtgtgtgtgtgtgtgacagagtctggctctgttgcccaggctggagtgcagtggtgcgatctcagctcactgcaacctctgcctcctgggttcaagcgattctcctg

SEQ ID NO: 18725 - DNA, 1048 bp, Homo sapiens
tgtagttgggggtctcaccttgttgcccagcctgctcttgaactcctgggctcaaatgatcttttcacctcagctcctcaaagtgtggggaatacaggtgtgagcccccatgcctggcctctcatgggtatcttatagaagttttatatttaatccatgatcttattttaagttaacgtctacatgaagtgggaggtttggtcaggttcattttctgcctgtggaaaagtgctccagccccactggtctgaaatgctgtcttctttccaccaagttgtgcttgcacctttgccggagctcaggtgcatgtgggggtctgtgctggctctgtgagtctgtccttccgcacacaactggtctctcgcttctgtgagacgagagcaggtggagtgattcctcccactttgttctttaccagaattgtttcagctattcctttgccttttcctgtaatttttagaatacgcttgttcctatctaccaaagtatcttgctgagattttgataggaacacacacctcttaggagagctagagtaaagagcagtgaccggcccagatctgggccatacgtgtgatcccagcattttgcgcgtctgagttggaagcattactttagcccgggagtttgaaaccagcctgagcaacatagtgagattctgtctctaaaaaaatacaaaaattagctggcagtggtggtgcgcacctgtagtcttagctgctcagaagattgaggtgggaggatcacttgagcctggcagttcgaggctacagggagccgtggtcaccccactgcactccagcctgggcaacagggcgagaccccatctcaaaaacaaaacaaaactcaaaaaacagtgacaacaccacacgctgctgaggatgcaaagaaaccagatcccttgtacgctgctgatgggggtgtgacgtggtgcagcctcactgggaaacagtttggcagcttcttaaaaaactaaacgtgtgctcaccatgtgaccccgtgtccacatgcgctcaccacatgaccccgcatccaccctcctgggtgc

SEQ ID NO: 18726 - DNA, 1044 bp, Homo sapiens
tgatctcccttgtagaaatgtgactgggacttagcatcccagcttatcacattctgacgtgtggaaccagggagaatggttgtgtctttcaaagtttctttgaaattcgggagcgatttgcttgggagtggggtgtgtcttggactgagctgctgtccagacctggcggctacggcttagtgaggctcaggacagtggccctggagaagctggtcaggcccctcagcctcctcagagcgttcaaggtcctgtcctaagaacatggggttgctggagccagggtctcactccattgcccaggctggagtataggggcatgatcatagctcactgcagccttcacctcctaggctcacatggtcctcccaccttggcctcccaacgtgctgggattattaagggtttcttacattagtcacggtagatcctgctcttacattagtcatggtagatcctgttcttttttttttttttttttttttttgagacggagtcttgctctgtcgcccaggctggagtgcagtggcgtgatctcggctccctgcaagctccacccttcaggttcacgccattctcctgcttcagcctccggagtagctgggactacaggcgcccgccaccacgcccagctaattttctgtatttttagtagagatggggtttcactgtgttagccaggatgctctccatctgctgaccttgtgatccgccctcctcggcctcccaaagtgctgggattacaggcgtgagccaccgcgcctggctatatcctgttcttacattagtcacgggtcctgttcttacattagtcaaggtaggtcttgtcgtatctttacttttaacactgtttattgtggaccttttcctttttttttttttttttgagagtcttgctctgtcgcccaggctggagtacagtgacacaatctcggttcactgtaacctctgcttcctggttcaagcgattctcctgcctcagtctcccgagtagccaggattacaggcatgcgccacacccagctaatttttgtattttagtagaaa

SEQ ID NO: 18727 - DNA, 1049 bp, Homo sapiens
actctgaccgatgtgaattctacccagctcaactgaaacttacgtgttccatactttttatcctgaactcgtcaagtgtgttcccccgaggtagaaagaaggctgccacagtctcctgtgcctcttcctgccattagcaattaccaatgttttgtcagttttgtttaatcttttcccaagtcttacacttttttcttgaacatttttttaaaacaaagctttaattttagagtaggaatttttttttctttttttttttgagacaaagtcttgctctgtcacccaggctggagtgcgatggcgacatcttggctcactgcaacctctgcctcccgggttccagtgattctcctgcctcagcctcccgagtagctgcgactgcaggcatgcaccaacacactcggcttttcttttttttttttttttgagatggagtctctctctgtcacgaggctggagtgcagtggtgcaatctcagcttactgccacctccacctccccagttcaagcattctcctgtctcagcctcccaagtgtctgggattacaggcacgcgtcaccatgcccagctaatttttgtatttttagtagaggtggggttttaccacattggccaggctggtcttgaactcctgacctcaggtgatccgcctgcctcggcctccccaagtgttgggattacaggcgtgagccacagccccacgctgattatagtgttagatgtagaaaagttgcaggcgcggtgcagagagctccctgccaccctgcctcgctcccgtggaggcccccatggggcagtcctcccacctgaggagcccccgccgacccgcggtgttgggtccacacgtgattcagatgtgctgagtctccccagtgtcctttccggtcttgggagtccacatggcgtttgatcgcccatcttcttaggctcctctggggtgacagttcctcagacctcccttgttttgagggctctggcagttttgaggattggtctcatgttttgtaggacgttcctcagttgcgattgtctgatgtgtttctcacag

SEQ ID NO: 18728 - DNA, 2018 bp, Homo sapiens
tctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctgccccgcccgtggttcacaggtagataactgtctcgtgcgtgttgcgtcaactcagtaagatatagtcacctaactaataaggactgttcttaacattggggccacaaagtgtgttgtagaaaaggctcagacactggtcctgaacacggaatccccaggggaaagtttggggccaggtgagggtggagtccttgcagcagtgcggccaaccccacttaactcttctcattcaccaacaggctgaagaactgaaactggccacccagctgaccggaccggtcatgcccgtccggaacgtaagtgaacacttactcaaatccaggcttcagacgagatcagtgggtgaacacgtgggtatctgagatgcgggtgatgggggtcaggcttaagaacgttaatagtggcagttgtgggtgtggaggtttgcggaaaggaacatttcttcttagtttttacttcttgcaaccatgaagccatacattgggaagtatttttgtttgttttgtgtttttttgttgttgttggaaagagagtttctctatgctgcttacattggttttgaattgctgggtttacaggcttgagccgccatgtccagctcagggagggtttttctttttttttttaaatcccagggaaggtgattgactcagggttgcttttcagcagtacttatggcagcgaacctgacccccaatccccgggaggtcctccaggttctcctgacgcttggttgttcccttgccctttggtgcatgtgggtttaacaacctgtctttctcttctaggtctataagaaggagaaagctcgagtcatcactgaggaagagaagaatttcaaagccttcgc

SEQ ID NO: 18729 - DNA, 1053 bp, Homo sapiens
cgtggggggtgcaggggtctccagcgctctgccctccagcctgcttcctccctgcccacaccgcactaggggaagggcctttcctgctgcctgcggggccgcacctggagtaggtaatgccatgtggtgacgtgaatggagcagaggtctgtgccccatcacaccgccttgctgtttttactgtgggacaaaagcactctgatctgcgtgttccgggggccctcctaccagccgacttgacgggaagtcagggttcaggtatcatctgtgcacctggggcggggtagtctgcactgaacctgccagagtcccctcctcatttcactgaaagtcacagtctccagggctgtgttgctaaccttacgttctctccgtttgcttaatctattaagagccctaacaggagaggatgggctttctctgttgtctggggccctgctgttggccggtgctcttagcaagaggtcatttttctaggttgcgctgggacattgtgagtttggtgagggtcatggatgtgggctgggctgggctgggctgggccgggctgcctgctgcctgctgctcccctacctgaaatgcagctagtgcggctctgcccttcctggggctgaggaaggcttctgcaggatagctggggggctgggcaggtgggtgaggcagcctccctgctgacactcagtccttgtagctggagcaagatctcctgatccaggtacgggcctgtctgctccaagaaagactctgccaccagatgcaaaggggccctttgttttaacttagtccctggggaccgcctgattcagcacctgtcggcccaggataccccgctggtggggacaagtgcctgagtgtgggccgtgcccgagtgtggccatccctgagtggggccgtcctgactaggaagtggcttttcagttgtgatgtgtgggcctgacctagggggcgctgtggaacccgggctggaaccagccctctgtgccaggccgcagacaggttccgccggccctgaggggcagctgccatggcgtgggtcactgggagctgagagga

SEQ ID NO: 18730 - DNA, 1017 bp, Homo sapiens
ccatcacacggaacatcccatcacctgcagacacagaacatctcacccatcacacggaacatcccgtcacccgctgacacagaacatctcacccgtcacacggaacatcccatcacccgtcacacggaacatcccatcacccgtcacatggaacatcccatcacccgtcacacggaacatcccatcacccatcacacagaacatctcacccatcacacggaacatctcacccatcacacggaacatcccgtcacccgctgacacagaacatctcacccgtcacacggaacatcccatcacccgtcacatggaacatcccatcacccatcacacggaacatctcacccatcacacggaacatcccgtcacccgctgacacggaacatctcacctgtcacacggaacatcccatcacccgtcacatggaacatcccatcacccatcacacggaacatctcacctgtcacacggaacatcccgtcacccgctgacacagaacatctcacccatcacacggaacatcccatcacccgctgacacagaacatctcacccgtcacacggaacatcccgtcacctgtaacacggaacatcccgtcacccatcacacggaacatcccatcacccgtcacacggaacatgccatcacccgtcacacggaacatcccatcacccgtcacatggaacatctcacccatcacacggaacatcccgtcacccgctgacatggaacatctcacccatcacacggaacatcccatcacctgtcacacggaacatcccgtcacccgtcacacggaacatcccgtaacccatcacatggaacatcccgtcacctgtcacacggaacatcccatcacccgtcacatggaacatctcaccaatcacacagaacatctcacccatcacatggaacatcccgtcacccgtcacacggaacattccgtctcccgctgacacggaatatctgatcacccatcacatggaacatcccatcacccactcacacggaacatcc

SEQ ID NO: 18731 - DNA, 1088 bp, Homo sapiens
cgagactcagtctcaaaaaaagaaaaaaaaagcccaaacgtgtggttgcctttctgtttggtgagcaagacgtgagtgggctccctggtacaaattccatttgaaatttcctcagttgttccatcagctgccaaatttccacactggcaacacccttctgtttcagctgggacgatgccggagtgtgaaggagtttgagaagctgaaccgcattggagagggtacctacggcattgtgtgtgagtggccaaggctaggacatgtggccgcagctcgtggctgtgacagtgtgggacgagactgtcgaagcagcagccgcgttggggctggaagggactcagaccctgtgctctgaaacagggcagaaacctgttcaggaacttcaattcctgatgtagttatcacaaacattgtaccatttctgggtaaacgtaagcatccggttgctaatgcccataatccaaacgtgtcactgcagagtacacagaactgttagagaaataaaatacagaactttccagaagcagcaggagctggacatggtgctcatgtctatcacctcagcaactctggaggagtcacctgagcccaggtgttttttctttttgtttgtttttgagatgggtcttgctctattgcccagactggagtgcagtggcatgatcatagctcactgcggcctcgacctcctaggctcaagtgatcctcccacctcagcctcctgagtatctgggaccacaagagtacataagcacacccagctaatttttaaatttttggtagagatgggatctccctatgttgcccaggctggtcttgaacttctgggctcaaatgatcctcctgcctcggcctcccaaagcactgggattacaggtgtgagccactgcacccggccaagcctaggagtttgaggctgcagtgagctgtgatcacgccactgcaccccagccttggcaacagagtgagaccctgtctcaaaaaaaccaaaaacaccacacacaactaaaggttataacagatgtgaaattggcgtaggtcattctggaagctgcacacattagcaggatgttttgtagagccatctt

SEQ ID NO: 18732 - DNA, 1033 bp, Homo sapiens
gcctgcgtcatccgaacatcgtggagctgaaggaggtggttgtggggaaccacctggagaggtacgtggtctcctggtctgcacattgggccctagggagcatgtgtcttgggctagaggtgttgcacagagcgaggactgagtgtcactgggcatgaggttgtcagagaagagatgaccccacctcaccgcctggctcagcccattgtctgagggggacacaggttgtcctgcccatgtcccctcctgcagcaggggaggctccacttccaccccttaggagaaggccggagagtggcatgcatcttctgtttcttccagcatcttcctggtgatgggttactgtgagcaggacctggccagcctcctggagaatatgccaacacccttctcggaggctcaggtgcgtggcagaggggcctggggtgggggaatgggcttcatgggcccttgtggtgcacatttataacgaaacagggcacttggggacttgaagagctgctgctgcctctgcctccacctcccagtgtttcagcgagcttcagtgaggtggaattcctgtggtgggggcatctgctgggagcgggcagccccagggccgagagccttatgagggcactggtttcctgggctgttgggagcaggcagccccggggctgagagccttctgagggcactggtttcctgggctgctgggagcggggagccctgggcggagagccttctgagggcactggttttctgggctgctgggagagtgcagccccggggccaagagccttgtgagggcactggtttcctgggctgctgggagcgtgcagccccggggccgagagccttctgagggcactggtttcctgggctattgggactgctagtcctgctggccagtgtgggtgtggcagggcccagctgggcttccctgcaggctcaccctgactggtacctctgaccctctgcacaggtcaagtgcatcgtgctgcaggtgctccggggcctccagtatctgcacaggaacttcattatccacagg

SEQ ID NO: 18733 - DNA, 1047 bp, Homo sapiens
gaatccagagctcctcatttgtcctagctgtgcgggagcccagccgcctgcttcctgttggtgctgtgcaaggcgtcctcagagcagtgatctgattctctccacctccatccctgggtggtgtggccccttcctggtcctcacagccccggcagcagttcctggctggggttcaaagttcaggtagggcactgtgttgaccttagggggtggtacccacctgtggtccagttcattttttatttgataacgatctttgttttctgttcataaccctgtctcatgaaggcgaatgagttttatgacttgctctctcttgaaggtttaagaaaaatctattaccctgaactttctgtgccatccttgtggtgcttctgagtcagctgagacatcaggccagctgtctcctcaaaggtggctaacccagcctttctctgggacttaagtgataagtaaatacattaaaagatgcatacttatttctccctgtagatatcaataggaaaacatccaatctcacttgttggcattgtagtctcagttttttgctccagttgaatttctcaacctgtaaccttgggtcttcagtacccaccctctcacacaaactgaatatgggcagtaggtgtgtaaaaccactttgaaaaaaaccaacaacaaactagaccatacttaggaggatgaataatattatcttagcacacaagtagtaatacttctcatttccaagccaagattaggaaaaaaatgactagaagagacttcctaatctttactctgaagactttgtaactgcttagaatctttttttttttttttttttgagagggagtctcgctctgttgcccaggctggagtgcagcggcacaatctctgctcactgcaagctccacctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatct

SEQ ID NO: 18734 - DNA, 1316 bp, Homo sapiens
aggtggtatcaggggcaggttcagctcagcccctacgccctgctgggctcaggggcaggttcagctcaggcctacggcctgctgggcttgagaagcttcgcctttgtgcctcggtttccttctccgtgaaatgggaggtgcagcgtggtgctaacgtctgtgcagccctgggcacgcctggctccggaagcactggccagtggaggtggcagcaagggatctgcacctgtgcactcgctggacctgccttggggagcagcacgtgtgggtccaggctgcgaatcccgaccggattctcagggaggggttctgcaaggtgcacccggtgggggctgggagctcctccggggcgtgtttccctgtgacgtaaaatgacctctatccctgagccctcccatgtagaaagcgggaaggaggctggccgctgtgtgtgggtgtgggtgtgagctgggtgtgtctctgtgtgagctggggtttgtttgtagatggcattcccgatatagtctcacctctgagcaagggttacctcacaggaaggcagtcctgcagcaagactcttctctttacggagacatctgtgaacctgcctgcgctcgcggttggccgtcgtagaagcatggataagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtgaacctgcccgcactcgcggttggccatcgtagaagcctggataagcatagcccgtgtgaatctgtgaacctgcccgcactcgcggttggccatcgtagaagtgtggataagcatagcccatgtgaatctgtgaacctgcccgcattcgcggttggccgtcgtagaaggccccataagcatagcccgtgtgaatctgtgaacctgcccgcactcgcggttggccgttgtagaagcctggataagcatagcccgtgtgaatctgtgaacctgcccgcactcgcggttggccgtcgtagaagcctggataagcatagcccgtgtgaatctgtgaacctgcccgcactcgcggttggccatcgtagaagtgtggataagcatagcccatgtgaatctgtgaacctgcccg

SEQ ID NO: 18735 - DNA, 1043 bp, Homo sapiens
gggctgctgcgtggggcactgggggtctgtccacaagctgaccatcatccttctgcaagtaggggttgccttgctctcccggcccctgtacctgggtgtcctgcttagagccagctcgagccgggcctcatgggtgttcgtccaaatgaccaagtggctgggcctgctgtgagctttctggtgttccggcggagagtggggctgtggtgtgtgtccccgagggggaggtggggggacagcagtgtttattggggtcccggggatgctgacaaataacttaactccctcttctcttacagaacctgcaaccatggtcgtgccactagccagctcggaagcccaggtactttttaaaaaattccaagtattacttgatgtgtgttaaaacgtacctgcatcttaaaatgtaaatcataaaacatatatagttacacagttgtttcagggaggcagggtgcagatgaagtacccaacaggcttagttgcagggactggatgaaacgctgttcacagagagcagacgtggaggagaccgccggggtggggagggtccccgtggtgcttccggcctggaggaggcagtggtgttacttccttccacagctgcacagatgaggggcacagctgacgtctgcagggccggcctcccagacacagagccggggtcagggagacgacttcaggtgcaaacaggaaaaatcagcctggtgaccagtgccccgaaaccccacccgaccaaaactggaacctcaccgcagggcagggccttcctctcccattcacctgccctgaagtcatgtctggaacgtcatgtttccactttctactgcctttttagttttctttctttgttttttttgcttttgttcattttattttattttattgttttgagatggagtcgcgctctgtcgcccaggctggagtgcagtggtgtgatctcggcttactgcaagctccgcctcccgggttcacacctttctcctgcctcagcctcccaagtagctgggactactggtgcccgccaccacgcccggctaatt

SEQ ID NO: 18736 - DNA, 1023 bp, Homo sapiens
accgaagtctatgtcaccacaaacagcacttaacaattcagtgataaggcacctgccaccgtggagaacctcggggcggggatgtttagactgcatgcgctcaggttgcctggcagctctgtgtgtggagatgccattgtgctatacgtagtgtcctgggacgtgagtgggggcctgtctgtgtggctgtgtccggttgtcgtgtgtctcactgttgcgttgtacacgggacagtttacctttctgaagtccaggactccagggctgggaggccggctggccctgctgtcccgagtctccaaacagagcagctgctgcctaccgcctggaagaccttccaaagggggcctgccgtggtacatcttaaacgttttacagagagcttggtatgcagggacgcagcctggactgtttgtctcagaggcgcatacgttaacctgatcgccctgtccccaggaaagacggcaaaggagttccttaacgtctcgctcctggattccatgaaatgactgcacagcccctcagttactgggcaggtgtcctgggctggcagtactgcccacctgctgccccaggcctgcacctgctgtgggcgggtggaggtgggaggccctgagactggctgcctgcccagaattttccttatgggaaagcaagttttttgcttttcagagaaagttgccagtgacctgggcacagaagagcttttatggacgcagccttcagataagaggctcgggttggagttaaccctttcagtaatgtgatcaggaaaagcagggagtggcctagaggggctgggtgctgctgtggaccgtgtgggggttgggggctttgctgcttcctccctctgtctgtcctgtgccacgaggcacaatcggagccacgcgaccagggacagcacgagctgaggccagccccacccggagcaggtgggaaacacatttcccgctacgctgtccttccctgcccttccctctgggaatttgtgtgaacagcggctcttccagtcggcttcctcac

SEQ ID NO: 18737 - DNA, 1047 bp, Homo sapiens
agctgagagaggggccatgagcagccgcccgtcctgatccagcttgggcagtcgagactgtgttcaaggggaccgacctctccatgcctccgtccctgtccccacgtcagtgtggctcgaggtgaggttggtacgtgatgtgcagggcccggcacagcatctgacataaggagtgctgtcgttatatttgtgtgtgtgggtctttctttccttgttgtaaagcgaaactatgagaaccctttaagacatggaacacagcactgtgcagctgagagtgtccgtgtaattgtccatcgacctcctgtgtccgactgtgctgcctctgcctgcctgtcccagcagacctggccacctggggaccacctgggcctgtgggcctggaagtcggtgcagacgatggtgactagggtgggcaggtcggcacccccatatcactccacagaaccactggtgcccttcgtggtagattatgaaagtcagggtccctgtcaagtaaaatcgagaaatgctgagttaagaggtcgctactgtgaagcttcactaatttttaatgtgcttttaaaaaaacttctttttttttttgagacagagtcttgctttgtcacccaggctggagtgcagaggcccgatctcggttcactgcaacctccacctcccaggttcaagcgattctcctgcctcagcctcccaagtaaatgggatttcaggcgtgcaccaccacgcccagctaatttttgtatttttagtagagacggggtttcatcatgttggtcaggctggtcttgaactcctgacctcgtgatccgcccgcctcggcctcccaaagtgctgggattacaggtgtgggccaccgcgcccggccgggaacatccttttcatccggtccatgtcttgcttgtgccttggtctcttgtggaccgacagctgctgtctccctggccgggtgctgggccctctgcacccaccagccgcgttctccccgccccacccccctgcagtaccgcccagtgaccgcgcccctgtcccgcagaccgtgcagtccctcgg

SEQ ID NO: 18738 - DNA, 1055 bp, Homo sapiens
cccgcgtgctgctcaaggcgcctaccttggctgaaatggaagagatgaatacatctgaggtcagaacccatggggattcctgaaaagagaccaggaatgggaggatgggggccaaggaagtgagaagggctaagctaagccgggggcagcagcaattgcggtgtctcctgtccaggagccctcccttgaaactgacatcctgccgtaggaggaggcctgtggggatcggggaccctgccatcttggccgctcagaagggtgactgggagagggcctgggctgcctcctcccacagacgatggaaggctgacagcggaagtgcctcgctgtcccaggccccggaaactgagcccctggctagttgatgtgaaaaggtggacccagcgaggctccctgcccaccctggctgccctgtgaatgggacgctcctctcttcacaggaagggctggtgatggccttgttgggggccatcccagagggctctgcctccgtctgacactagacctgtccctttccggaaggcctggggaagggcttggttactcgggtgcttgccacgaactgtccagaggcgggcaggctgggaagtgggtggaggctgccccacatcgcagcagaccctgcggcacccctgggtcctctgcttcattccaggcatgggcaggaggcactggcgggcattgtcagggcagggccgcgtctggtgtgtccacaggaagaagagtctccgtgtggggaggtgacgctgaaacgggaccgctccttctcagagcatgacctggcccagctccgaagtgaggtggcctctggcctgcagtcggccacccaccccccaggagggacggagccaccacggccccgagctggcagtgcgcatgtgtggaggcccggctcccgagaccagggcaagtgctgcttctcacccccgtaccctccttcgcccccaccccgatccatcctgtgggcaccatccctccacctcagcccacatcttcctgagcaggcagctcccagggacccagggagctcgtgcctgcaagacggcaccacctca

SEQ ID NO: 18739 - DNA, 1007 bp, Homo sapiens
cctgacgccctctccctctgcctgacgccctctccctctgcctgacgcccctctccctctgcctgacgccctctccctctgcctgacgccctctccctctgcctgacgccctctccctctgcctgacgctctctccattctcttctggctgttttccaaggtggtgttgaaagaagcttacttagtatttttattccttcctattaggagtataactaagagatcagggaaaaagaaaagggaaagttactttctaaatgctgcttcttgtttttacccttgttcctcgactggttggcgctctgctctgtgtctctgtgggaatgtgtgatctgatggggacatcccttctagttctggtgctcctgtgacccgtgggacacttgctgtttgccctgacatctgtcccatgcttatgggttaattgcatggtgggtacagaaccctccactggagctagtctgtcatcagaaaaaaatatgttttcatcattgcccttcgtcctcgtctgactgtgtcctgagacaagggtgtagctttgttgccgtttagttggagccacaagtcccaaccctgtttgcctgaggaggtgagcacaccagtgtgatgtggaatgcccagttttttctagggtccttctggttctgtgattctgtctatgctgagcgcttcttaggaaacatctcttcttttttctaaatgtgtggatggtacatagtgtttgacttatgctgtcctttaggaagtaaatacagtgtaataggtctcttttaagataaataattttgttattgttacaatatttaaaataatgtcagtgtggtgattaagaggttgttttggggcttttaggaaaacggactagaagatatcgatcgcatcctagagaggattgaggacagcactgggttgaaccgtcccggcccagctcccctgagctccaggaagcacgttctctacgtggagcacaggtgtggcccccgcccttctctgcggctgcccttctc

SEQ ID NO: 18740 - DNA, 1022 bp, Homo sapiens
ggtgtgatcatagcccactgcagcctcgacctcctgggctcaggagattctcttgcctcagtctcccaaaatgctggaattacaggtgtgaaccaccacgtctggtcaaaaagttcctccttaccctgtcatccttggatgattaattcatctcttggtcttacagatgcttaatgaatcgctgtccctacttcagaaattattgccagcttaaaaaaaaaaaagctccgtggagtcagttaagacgcagtagtgtagtcccagggtgcgtgcactgccccgactcagcctcagaaacagacgtgtgccacacacagtgcctcttgacacagcactcaccgagcgccctcacggcacagtgacggcagcttccccatggtgcccgcagtggcgaggcctcagctgtggttggggtggtgattttagagaaaggcctggaagctgcctttcaaaccaaaaatccgtgttctctccttgactattaggtggctttctgaagcttttggaatcgtcttagaacataatttcatgttttttttctacaattttcaattccccagacacttgaatccagacacagaactgaaaaggtattttggtgcccgggcaatcctgggggagcaaaggtaaggtccacagtgagctgcattctcacagctgcttcattccttcttagactcttggccgggggtggtgttcctgaagctagtttacccttgagggagagtatttaaagccagagtgcacacgtaacccttagaattggggtctgaatgggagtccacagattgtctgtgtataaccttgtctgtgaccgtgggttgtagagatgctcagagtagctggtctccatccctcacactgccttgtccagcatgaggtttcaaaagccatgccgagtgcagtgctcacgcctgtaatcccagcactttgggaggctgaggcggacagatcacctgaagtcaggagtttgagaccagctgggcaacatagtgaaaccccgtctctactgaaaatacaaa

SEQ ID NO: 18741 - DNA, 1039 bp, Homo sapiens
cctgggttcaggcaattctgcctcagcctcccgagtagctgggattgcaggtgcacgccaccacgcccagctaattttttttttttttttttttttttttagtagagacggggcttcaccatgtcggccaggctggtctcgaactcctgacctcaggtgatccacttgccttggcctcccaaagtgctgggattacaggcgtgagccatggcgcccggcccagataaatttcatctgtgtccattcagtagttcttagcagttgggcagccccagatgaggatggctggctgcgatggggagcacagggtctttcagctccttagaggaggaagagcagggggggtgtctgcttctgggactttatgtaggaggtatattccacctctggactctccatcgaagtgtccagaaggctttgtcttttttttatttatttatttttatttttttattttttagagacagggtcttgctgggttgtccagtctggttttgaactcgtggcctcaagtgatcctcccatctcagtctcccaaatagctgggactaccggcacatgccaccgctaatttattttattttattttttatagaaacaaggtcttactttgttgcccagggtgatgtcaaactcctggcttcaagcgattctcctccctctacctcctaaagtgctaggattacaggcatgagccaccacgcccagccagacacatcctgttttattggaccatggagagtattgctggtctataacatgccctgggtttgcacgtctgagttcttttttttttttttcgagacagaattttgctcttgttgcccaggctggagtgcaatggctcaatcttggctcaccacaacctccgcctcccgggttcaagtgattctcctgcctcagcctcctgagtagctgggattacaggcatgtgccaccatgtccagctaattttgtgtttttagtagagatggggtttctccatgttggtcaggctcgtctcgaactcccaacctcaggtgatccacccgcctcagcc

SEQ ID NO: 18742 - DNA, 1191 bp, Homo sapiens
gagatgtgttcggaggctctaggccaagcgagctccatccatactcagaggagaggctggagcgctgctctctcagccgttcctggggaccgtcgcagtagtgccgtgtgatgcaggcccaggactctggggcttctcactgctgcccttgcctcctgcggctcagtgcaggcgagcagctcagattcccggcccccgtgcagcccccggacggcccccacacggccccggacggcccccgcgcagccccagacagccccggacctggacagtccccgtacagccccggtgcaaccctggacagccctcatgcagcccctggacagctccccttgcagccccggacggcccccgcgcagccccagacagcccccgggcggccctcacgcagccgccggacagctccccttgcaaccccggacagcctccgcagagctccccgtcatctccctgtgggaaaagcaggctgctgctttccattcctctttcttggggcttagtggggagttaggtggcccctggcctgggcatgtcaggttctgagttcttgctttaagtcatataattggttcagcttagcaataataactagcctattttgagttggggggacgttgtgagtgtcgacccggtaattcccccgtttttgtttttgtttttggagtcggaatctcactctgtcgcctaagctagagtgcattggcgcagtctcggcccgggttcaagcgattcgcctgcctcagccttccgagtaactggaattacaggcacacgccaccacacccggctaatttttgtatttttattagagaccaggttttgccacgttggccaggctggtcttgaactcctgatatcaagtgatcctcctgcctcagcctcccaaagtggtgggattacaggcgtgagccactgcgcccagcctccgctggttttaaatgtctgaaaaaaaggcatgcctgggagctggggccttgctgagtgcctttcctccagggctgtcctcccttctggtaggttctgctccagacgagcccttaccacgttgactcactcctgcagctcagcgatgcctgccgctttcaagaggatcaggagatggctcgagacctcgtaggtaaggcagagcccccaccccattcccctcagctgtgggagcacctcaagctatcaagacagatgcgatggtgt

SEQ ID NO: 18743 - DNA, 1026 bp, Homo sapiens
caagtcagagggtcgcaggaccgtggaccgtccactggggacagcttagtgcctcctggtttaacttcagctgctctgcgggcccttatgaccggcatggctggctttgtctggggctgtgagcttctgactctcctcagtagagtggcagcacgtggcactgtgcaacccgagggcagctcagggtccctgtagcctgcatttgctgaagtgggagcttctgacacgtggtgaagatgttggcaggcttgagcggcacgtgacccccttccttccccaccacacactctggtgtgcagggcagacgccgtgcaggttcatctcgactcccgtgagtgtcctggtggcagaaggactgtcccaccctcacccaaagctcgttggtacaaaaagcacagccgtttctgtcagactctgtggctatctctcagcagatgcatccagtccatgctggagtcgacagaaggactctgctgggagaggtagaggccccctggcagcatctgtagcatcttcgttttatgtccctttctgaaggacgtgaccacgcagtctgtgatggggtttgatcctctgcctccttcggacacaatctactcctacgtcaggccagagaggtacctccctccttccagttcccacctcccagctcccacctccctcctcccagttcccagctcccagctcccacctcccagctccaaccttccagctcccagctcccacctagcagctcccggctcctggctcccacctccctcctcccacctcccacctcccagctcccacctccctcctcccacctcccacctccctcctcccagttcctacctcccatctcccagctcccagctgccacctcccagcttctgcctccctcctcccagttcccacctcccagctcccacctcccagctcccgcctccctcatcctagttcccacctcccagctcccagctccctcctcccacctcccacctccctcctttcacctcccacctgccacctcccgcctcccaccttcca

SEQ ID NO: 18744 - DNA, 2021 bp, Homo sapiens
gagttttgctgtgttgcctaggctggagtgcagtggcacaatctcggctcactgcaacctccacctcccgtgttcaagtgattctcctgcctcagcttcccaagtagctggattacaggcatgcaccaccatgcccagctaatttgtttgtgtttttagtacagacggggtttcaccatgttggtcaggctggtttgaactcttgacctcaaatgatccacccgcctcagcctcccaaagtgagccaccacacaccggccatgattcttaaaaataacagtaataggccaggcatggtagctcacacctataatcccagcaatttgggaggcagaggcaggagggttgcttgaagccaggagtttgagaccagcctgggcatcagagtgagactccgtctctacaaaaagttaaaaaaaattagctgagtgtggtggcacacactggagttccagctacttgggaggctaatatgggaggaccccttcagcccaggagtttgaggctgcagtgagctgtgatcgcaccactgcactccagctcgggtgacagagcaacaccctgtctcaaaaaaaagtaataatgataaattataatcaatatttattgggtgcttactatgtgccggccagtgttctctgaacttagtattaactactttaatcttgacaataaccctgtatggtactattgtaatccccatttgagacatgggagaatggaggcagagaaacgtttatccacttacccaaggtcacacagctaggagctagcagagttgggattcaagctggacgtgtctgtcttgttaccatgaaactattgggatcatcagtcagaatcttttcttttttttttttctgagatggagtctcactctgtcacccaagctggagtgcagtggctcaatctcggctcacctcctgggttcaagcgattctcctgcctcagcctcccaagtagctgggattacagatgcccaccaccacgcccggctaatttttgtatttttggtagagacggggtttcaccaggttggccaggctggtctcgaactgctcacctcaggtgatcagcccacttctgcttcccaaagtgctgggattacaggcgtgagccaccgagctgggtctttcagtcagaatctactttggccgcaagagacaaaaacctcccctataacactggtgggaatatcgtatttctctcacttgaatgaagtctggctgtgagcagcttagggctcaggtgcagtcccctgcaatcacgtcactctccccagtgtggctattccagctgcagcctttacatctgcattccaggcagcaggaggcagggatggctgaagaggggcagcccctacctttaaggacaattctcagaagtcttttcttttttctcatatgtatgtatacacacacacacatatatatgtatatacacacacatacatatttatgtaaaaaagattttttttttttttgatatggagtctcgctctgttgcccaggctggagtgcagtggtgcgttctcggctcactgcaagctccgcttcctgggttcacgctattctgctgcctcagcctcccgagtagctggggctacaggcgcctgccaccacacctggctaattttttgtatttctagtagagacagggtttcaatgtgttagccaggatggtttcgatctcctgacctggtgatccgcccgcctcggcctcccaatgtgctgggattacaggcgtgagccacggcgcccagcccatatttgtataaaatttaatagagatagggcctcattgcattgggcctggccggatgccgtcctcctgccttggccttccagagtgctgggattataggtgtgagctaccacgcccggcccattactgttgttttcagatagccctgatttagtctctggttctcccttttcttgcctataaatcagggagaacacgtacttcctggggtggatggaagggctaagcacttgggtatgtcagtgaagccaggagcc

SEQ ID NO: 18745 - DNA, 1043 bp, Homo sapiens
tttctcctgtgtcctgggtgctccctgggagactggggaggtgctggcatcgggtggccgcctctgactctgtgacccacccacagtcatcaggtaataagagaaggaggtgggactggggcccactcacgttccctgtgtcttccccgtgcctccctgttggggtccacgggcagcctgtccatgggtgctttgtcctttcaggctggcgtgcaggtgcccaacccacactcctgccccacaggcacaacaggcaggacaggccccataggtggtgtggagtcttgcccagttgcagggcagccatgtggggttggggtggcctccttatcccactgccagtgaggcaattagttcaaatcccagttcttccaggccacagtgtgaccctgagcagggccgtcccctctgggctcagctctctttcttttgggagaagagacagaggataaatcataggattgattattataattgtgaattatttcagactgtagcaggtgtagtgaaagcataactaacactgtagcaggtgtagtgaaagcataactaacactgttgcagttactgaacaactttaaaaagacatctccgactttctataacatcaacagaccttacagcgagcttactttgtgctcagtctctgttaactcatttcaccctcacaatggcccattacggatggggaaatggaggcagagaggctaaggaatgtggcccaggaagttaagtgggagggctggatgccaactgcctctactcccaccccaaccaaagtcccttcctccctgccaggagccatcagccctgtgtgttctgcagtgttctgagcctccgggtggggaaagagcaattcttgatcctgagcttctgccacgtggagaactaggcccttccggcctgtttcctgggttcctgaggcacagagccgtgggcctggttcaggtcgtgttgctcatcacaggatcagaacccaggccagagagcctggatgcatttgtagggggcttctctgtgtgctggcagggaatcctcccaag

SEQ ID NO: 18746 - DNA, 1442 bp, Homo sapiens
cacctgtaatcccagctacttgggaggctgaggcaggagaatcgcttagaacctgggaggcggaggtggcagtgagccaaggtcgcaccattgcactccagcctgggagtgagactctgtctcaaaaaaaaaaaaaaagaaacaaaacaaaaaacaccctaacagctctcctcatggaagcttatgctgtggaggcttccatgcagtcatctttcattcattgagctacctactctgtccttgttctcgtagagtttacgtgctgtgcaaggaggaaccagacaatggataagcaagtattaggcatgttaggaaaaggaagcagaataaaggaaatagaaaatgaagaaagggaatggaggagggataaaccctgttatttgttgtgtcccctgcaggaagtgagggattgagatgagcttgctaggaagatggaatagaaaatgcactgccctagggtgggtccagccttgagttctgtgtgatcagtatgaggaagaggttagtgatagacaggtcaaggaggggcagggcctcataggcctgctgacgttgcacctgtgtgctgtgtgtgtctgtgggacccggaataagggtcaactcatttatggcctgactggaaagaggacagcagcacttggccctgtttaagggagtttgtgttttgcctaccttcacatcttggctttacatatacaaaaactaatttagcaaggttatttactgtgagctgtgaactgacttgcagaaaactccaagaaggaatggtaaactcctatcttagtgtttacatttactgtgagaactgcatcaggcttaaccagattgtctcctaaccaaatcacaaaaggactaaattgcgaattaaagcaaaggaattggatgttttatcaagttttggaagcctgaagagtcatactttgtaccttcagggctgtaggctacctggtatctacccagccaccagtaccagtgccacactgtctttgaggtggtcctggggtagtcatggaaaagctctggaagattggggcatcagaattctcattgcacactttcagctaccagctgtcttcaggcactcacattacctctcaggttctactttctcagatgggcaatggggatcaagtgaggtaagaggcacctggcaccctacaacgtgcagtatggccaccttctgttgtttgtgtaggtctcctgttgacccacaccttgggttccaaacccccatcggggaaacattcatgggatccttcgagagtcattgctagctctgtgtcaggtactgtgtgccattggtgctgggatggctgctgcagatcgatttcgttcacgatgtggaatcgtttgttagccccacagcctttactgtcagcattctctttctgagctgcttttttttttttttatgattttaataattttttcatagtatgtct

SEQ ID NO: 18747 - DNA, 1022 bp, Homo sapiens
ttcagcaacttccacaagggggtggggttagaaggttctctcccatccttgtcaaagttgctaaaaccacgcacgacgccatgtgcagttccgtctggcagcccatttacagggctctcgtggtgggtgctgtctgcccaagctttcttgaccaggcttctctgaaggaagtttctctttgaaagaaaggaaacttgtggttgtcacaaccgatcgtggttatggaggcatttctccctaagcttactgaatggtgtcttgcaggtcttttccatggtggtcaccaatgttgccgccagcatggtaacatttggcagtgtggtattgagggtctttcctctgttttgcatccacagcagaggtctttactttttaccaaggagtgagtgggtttggaatgggttcccccctctcttagtttttggagacggggtctcgttctactgcccaggctggagtgcggtggtgcaccatagctcactgcagccttaaacttctaggctcaagtgattgtcctgccttggcctcccaaagtgctgggatgacacgtgtgagccactgcgcctggtcaccgtataccaaggaatgagtgggtttggaatgagttccctctcttttctttttttttttttttaagttacagtttgctttttgagatggagtctcactttgttgcccaggctggagtgcaatggtgggatcttggctcactgcagcctctgcctcccgggttcaagcgattcttctgcctcagcctcccgagtaactgggactataggcacacaccagcacacctggctaggtttcctctcttttttttttttttgagatggagtctcactctgtcgtcctggctggagtgcagtggtgtgatctcggctcactgcaaactccatgccccaggttcaagccattctcctgcctcagcctcccgagtagctgggactacaggcgcccaccggcacgcccggctaatttttttttgtatttttagtagagatggggtttcactgtgttagccg

SEQ ID NO: 18748 - DNA, 1038 bp, Homo sapiens
ggtgaccaggtgtgtacaggtatggacaggtgaggaggtgtggtacaggtgtggtgtgggtgagcaggagtgtacaggtatgtacaggtgaggaggtgtggtacaggtgaccaggtgtgtacgggtacggacaggtgaggaggtgtggtacaggtgtggtatgggtgaccaggtgtgtacaggtatggacaggtgaggaggtgtggtacaggtgaccaggtgtgtacgggtacggacaggtgaggaggtgtggtgcaggtgtggtatgggtgaccaggtgtgtacaggtatggatggacaggtaaggaggtgtggtacaggtgaccaggtgtgtacaggtatggacaggtgaggaggtgtggtacaggtgtgctatgggtgaccaggtgtgcacaggtacggaaaggtgaggaggtgtggtgcaggtgagcagatggtactcccattgccctgcaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctggtaggtgtggcgggggcacctggaggctgacaggttgttgggacggcaagcctagtgctgcatgaactcctgtttattcaacagcaactgggaattcatatttctgcataagactttctgcatttttgcaatttgttgaaaaaaaattttttaaagcatgcatccaaacaaaccccattttgggaccaagtacacaattctgtctcagacctgagcaaaaaattgacgtcaccgaagagaaaaaatccagcttaggatctttcatgtgctgctgacacctgacacccagagacttttcctagggaatagcatcatatgcatttagtagaatgcaaaccaaccattaaaatatccagtgtgttgactcctgggcac

SEQ ID NO: 18749 - DNA, 1058 bp, Homo sapiens
gcagacgaaacccctcagacacagagttaaagaaggaagcggtttattcggccaggagcatcagcaagactgctgtctcaagagccgagctccccgagtgagcaattcctgtcccttttaagggctcacaactctaagggggtccacgtgagagggtcgtgatcgattgagcaagcagggggtaggtgacaggggctgcatgcaccgatggtcagagtggaacagaacagaccgggaagtttcacaatgtctttctataatctatagataacatcagttgctaggtcaggggtcgaattttaactaccaggcttaggtcaggccggcccaggcctggtttcgggtctggttccttggtttcaggtctggttcctaggcgccaggctacctgcctttagttttgcttctttttccttttctgagtataaaacaatataaaacagtatgagagggtctgtctctcttctctcagagtattcaatttccttaggattttgagcgttattcctaatacacccttgaaacccccacactcacacagatacgtacacagagggcacatacccccacacccatgcatgcaggcttaacacacatagcacacgtgaacacatatatacacacatgcgtgttcctgtctggcgttcacttctggggctacagagattggaggaaatcaggagaggagacagggggagccaagggggagtatggcagcagaggagaggggtccattagaagaggtcacacttcccaggagaccagggagctctctttcctgctgcgactctgtaaaaccctacatttctcttcctggacttgggaatcgattctccaataattaaaccagatggactccaagtttatgtctttctggggttgaattcctgtggagacttgaactgaacgtttgagttctctgtggcccttctggactcttccttccttcagtgataagggaagaatgaggtacacacttggggttcagatatgtatggagacaaaattaattagaacaggaggcaaaacacaaaaaatggaggggatcagtgcgggaa

SEQ ID NO: 18750 - DNA, 1052 bp, Homo sapiens
gctccgagcctgtcagaggctgcagctctttaaagaggctgaggaatttggggttttctgtccaaaattgcttcagctctggccagccccccactatctgtctcgtgtcatgctcaggggcccttctcaatctgggtctccactggaatcgccgtgtggtccccctgggttggggacagctgcaggtctgccaggaaggtgtaagggggaaatggagtcgtagtcatatggccaggcagtggtggccagaatcgaaccctggcctatctgctctggggccttccgtggggccctggccccgtgcctggcatgtcatggtagagccaagcttgcaatgccccgcagccccggcaccgagccgcctcactgctgtttctgggcgcgtggcgtcacctggtggtcactacggtgtctgcgcccgggtggtttctggaaagtcatttgtgcccaggagcctggggccactagctgctgctgtgtcaccctctttcctgaatgtggtgactctatgcactggaccgatcacacacctcttgcaggctgtcatgtgcatagtgggccctttgtccctggagtggaagtctgggtgggtaagagggtgaggcctggtaagacaggtgtgagatttgccctgggcacagactagggtgagcctcctgtcactgagacctcagatcggctgtcccctgtgtgtggaaacccctgcaaccccagctgtgctcactcccctccttcaagcctttgctcagctgttacttcatggggaggcctcactgcctcctgtcaagcaaccctagtttgcttcccccgctcccatcatacttagcatcttttaaccagtacattcactcatttaaaaatattgtctagactgtaagctccaggagggcagggattttgtctcgtttctccaccaatgtgcctcaagcacctagagcagtatcctgaccatagtgtgtgctcagatagttgtcccatggacttatgttgtctgaggacctaggctgtgcccagcactgtctgctgggatgaacaaggcaggcacagagaaa

SEQ ID NO: 18751 - DNA, 1089 bp, Homo sapiens
tgccttgtgctgtgcccagggatccaggccaaggaccgcctttgggtagtagggcagcctgaggctgcaggtcctcccacacaggggagggtgggcagagcgcatttgcagggctctgagatgggagggagtcaggtgtgaggagcagcggagagcaggagccagggaagtcatggatgtgtgtgagcccatcagctggcaacggtctctgttggcaaaggtcactcacactcctgagtgaagaaccagctggatgtcgcctagtgctgctgggcacaggtggagactcctggagaggctggccccctggattcagcctgctgattcctggcagtggccccagtctctacgctgggccctgctcctctctggcccccataatggcctcactaagagcattcgtccattttctgggtgagaacatgctgggagtgtactcagaatgctgtcccagcactgtgggttccggaagccccttgccgagcaccacctgccttcccaacgtgtctgatgctgtctgaaattccacccttagtgtctgagactcagaggtggcccctcctggctattccttaccagcagggtgatggtactgcagtccatataccctgtggagggagggctgggggacgatgaggaagtctagctgtgaccccttcacgctgtggctgggccgtatccaggacacgcaggtctgggctgggtttgggtcacgagtcagatgcagaggggtctcctggtgcagttcccagagggaccttgacccacccagttctcagttaggatgcctttctgtccgaccctgttgcactctggggctctgcatgggtgaggggccctggagggatttcccagtgatgtggagttgctgcccttggctcgtgcccctgattccaggccaagtatgggccagggacaggaactcagccttagggggccatgtggatggaatgatccctgggcaccatgcctggggagtgccccaaagctttgccccccagctctcacctgggacctgaagtgcacagtcagctcagataaggggctggagcgtgaggggtggggtaagagccagcagaaggcatccct

SEQ ID NO: 18752 - DNA, 2043 bp, Homo sapiens
ggtgagaccctgtctcttaaaaatttgtttaaataaaaaccaaaccattgactttatatttctttttcttcttcttttttttttttttttttgagatggaatatccttctgttgcccaggctggagtgcattcttctgcctcagcctcccgagtagctgggactacaggtgcacatcaccatgcctggctaatttttgtatttttagtagagatggggtttcaccatattggccaggctggtctcgaactcctgaccttgtagatccgcccggctcggcctcccaaaatgctgggatgacaggcgtgagcaccgtgcccggctcgttgactttatatttctaaaggaagaatggactatgatttcttaggtttgaatcgtgctggaaagttgaaaggagacaaaaccttggactgcctgttgtgtgatctgcaggctgcggaggagctcagaacttgaggcaacccagcgccacctagtggatattaaaggaggacaggaatctgagttttgctgaaaaaggctcctaagctgttgttcagcatgtagcattctttcctgacctacgcattctgtttgttagtgcccaggatcacatttcctccatccaaactcccaccctaacagtcttgggtcctggagcttgccccagggatgctggcagctatgtttctctggcaggagtccaggcagtagtaccctccctgtacccatccttgtctggcactggcatggctctgcagccacccaggagcccctctgggctgtggcctctcgtctgtcctcatcccatcaggtccatggttggcctcaagggtctggtctgctgctgctcactcttctgcactgagaggaggagactgagtttccattactgatcaggtgacctaggacagagcgcctttctcctgatggtgactgactgccagatctgggggaatctcagaacagaactgaaagaccagaagctgtgagattaatgaggttggagattggggtgggatttttcaaaggaattgttcctggttctttttttttttttttttttttttttttttaatttaaggcagggtctcactctattgccaggctggagcgcaatcttggctcactgcaacatctgtctcccaggctcaggtgatccttccatctcggcctcccgagtagctgggactataggcacccgcccccacgcctgaatagtttttgtatttttttgtggaaatgggattttgccatgttaccctggctgatcttgaattcctggactcaagcaatctacccaccttagcctcccaaagtgctgggattataggcgtgagccaccatgccctgcccccagttgctattttatttatttatttatttatttgtttgtttgagacggagtcttgcttcgtcacccaggctggagtgcaatggcacaatctcagttcactgcaacctccgtctcccgggcttaagtgattctcctgcctcagcctcctgagcagctgggattacggcgcctgccaccaggcctggctaatttttgtatttttagtagagatggagtttcaccatgttggccagcctggtcttgaactcctgacctcgtgatctgccaacctcgacctcccaaagtgctaggactacaggcgtgagccaccacgtccggtccccagttgctattttaattaaagctagggttatggtgtggctgaatagcctggtggccctgtcctgcaggacctaacatctgtgaatataggctgggaatgtgaatcgctcaggaggccaccccaacacttgtgccatacctagcacttgtgtctccctgtggatcccagtggccctcagtgacagcatgtcactcattcatatgaccattgaattgtgtctcccaggagggcagggatgtctcttcactttctgcaacacagcccctacactcagcctgtggaggagcacagctcatccgctaggggtcgacggaatgtgtgggtgggaataacagcagtgtagattccatggagtgtgaagaagtgatttgctgaatggttct

SEQ ID NO: 18753 - DNA, 1035 bp, Homo sapiens
ctccatgaacagccactaagtcaatgtgactgtttttttttttgagacggagtttcgctctgtcacccaggctggagtgcagtggcacgatctccgctcactgcaacctctgccgcccaggttcaagcgattctcctgcctcagcctcccgactagctgggactacaggcttcactgcgcccggctaatttttgtatttttagtagagacgggggtttcattatgttggccatgctggtctcgaactcctgacctcgggtgatccacccacttcagcctcccaaagtgctgggatgacaggtgtgagccaccacgcctggcccagtgtgcctttttacttcagctcacagatttccagttggccgtctctgcagaccctggcctctagcagggaaagagccttttatttggctgttgtgagggcgccttgaagtttaggtatttataaacgcgaactgggctaccactgcttgcctctgagaatcccagggaccatctcacagccaaactaaatttggtccctggactggtgcctgagggctgaggctgagacatggctgtgactctttatgacagagcagcagtttttagtggagattttgggctgtcagagcaagggacctttctggagtggtggtggttatttttctgttacctctgtgtcccctgagtcactgggtggcagagtggaggggcactgtttagataggatgtgaggcgttggccctgggtcagttgctagagcagaagtgtttggtggcgttttaatacctcaaaccctccttcaacattaccatgtcccacagatgggagttatagaacagagtgagccatttagggtttttgaagaaagcatattatgcctgtggtgtaaggcacttgaatcctccatctctgcaggagagacctgcagtgggctgctgaggacttggctgtgggtcctgcgtttcccaggataactctaacaagattgatttcagaaggtccaactgcaacctgactgggttgagaggctatttccaaatggcacaaata

SEQ ID NO: 18754 - DNA, 1034 bp, Homo sapiens
gcatttcttaggatttatgcaattgctaatttgaccaacggtgctattttgtttcagaaggtaaatcctagtaattaggtattttggttacagcttaaatctgtacatttaaacctaggcattttattaccatacccagaagaaaaagtcataaagagagacagcctagacaatgaccaatctgtgatgatccttggaagcatgtcggaagtgacaaaggtgccactggtttcattggaacataggactcgtttatggttacagtctcaatgctggcagtaaggatgccttcattgttaagtgtggatctttagctcttccacttattttcagactggaaatggagcaggagaaacccttgttgcctttgcattcactttcattttcagatgtctgcttacctcattctttctcctcacaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggttggtgagataagtgccttagggcaagagaaatcttagtaatttggcagcgttgaccgttggaattaattgagcccatgcttgctcccattttttaaaaaatttatacattttgggcccagcacagtggctcacgcctgtcatcccagcactttggaaggccgaggcgggcggatcacgaggtcaggagataagaccatcctggctaacacagcgaatccccgtctctactaaaaatacaaaaaaattagccgggcatggcgccaggcacctgtagtcccagctgctccggaggctgaggaaggagaatggcgtgaacccgggaggcggagcttgcagtgagctgagattgcgccactgcactccagcctgggcgacagagcgagactctgtctcaaaaaaatttataaacgctgtttttgcaagcagttttagcttcatagctaaattgagaggaaagtacagagat

SEQ ID NO: 18755 - DNA, 1029 bp, Homo sapiens
gatggagtttcgctcttgttgcccaggttggagtgcaatggcacgatctcagctcactgcaacctccgcctcccgagttcaagtgattctcctgcctcagcctcctgagtagttgggattacaggcatgcaccaccacgcctgggtaattttgtatttttagtagagatggggtttctccttgttggtcaggctgatctcaaactcctgacctcaggtgatccacccacctcagcctcccaaagtgctaggattacaggcgtgagccaccgcgcccggcccctctgcggctctttggaggtgtttagcgcacgtgcctagtgcagcacaagggcacctgtctgctgtgacagttctgactgacatcatgggcttttctcaggctcagtgaccaccggcctgtgtcagtgctgctgggccgggagagctggtaacagcaccaggcagtccgtgtgtggagggacagcctcctcagtggagatgacgtgtgctgatattgtccagttttgccatactgttaggacacaagtctttgtgctggtgctgtctgtgctcaggggcttttagggtttatgtttcataacgctactcagagatagagagagattgggtgactttctagtaagtggtaggttgtgattaggacttaatttttggaatcgaatgtcttttttttatcatttagatctgctcttttaagaaacaggctaaagttgagaaacactttgaagggagagggcagtagaacagaaagccaccttttaaagaacttggcagctcttggttggcttgttctctgttgtgaagtttaccatttatagttgttgttttctgtttgagccagtcttgctctgtcgcccaggctggagtgcagtggcgtgatcttggctcactgcaacctccgcctcccaggttcaagcgattctcctgcctcagcctcccttgtagctgggattcacctcgtaaggcgaattaaccttagcatatgatagttcttttagtgtttcccaccacccttttcagagtaagc

SEQ ID NO: 18756 - DNA, 1278 bp, Homo sapiens
ccccggaggcagaggttacagtaagctgaggtcgcgccactgtactccagcctgggtgacaggtgagactccttaaaaactggcaaaagccaattaatgtagttgtgatgattacagtccaattatctctgggtctaaaatagaaactttacactattaaatgcatcagtttcaagtatcacgtagtcacgatggtaaaagtgaaatgaggcttctcagccatatctcctttcttaattttcttattgcagtgtcagtgttccaaaagtgatcatttctgttggtgacagttgaaacaccaagtcgcgttgtgtgctttctacagtaggtaggcactgaggtctgcattttctgtttctttcccacagcgcatggatttaggagaatgtaccaaaatccacgacttggccctccgagcagattatgagattgcaagtaaagaaagagacctgttttttgaattagatgtaagttttatttaatgttgatttattcctactgcgaagaacccaatattgaactaacaagaaaaatgtaacatacgtaagttatgaagcaaaataataaggtagttgcttgttatcctgccactcaagctcagagctagaatacagccagtactgtttatatgttgtgtccagcgtcctgtcagtgtcctaaatgataatatgtgttatctcattttgttgcttttaaaaattttaattacatttttatgagtccttgaacagtgtttatttttgcttagttttgaatggtttcatagtgtagagtctttaaaattagatttttttggttcagtatcatgtttctgtttgcccaggttgttgcatatagttttcattgctgcttgaataattctcaaacgatctttgctttattcatagacatttagattgattctagttttgctactgcagacaatatgaatatttttgcataacttccttgtcacgtggataaggatttattttgggtatattcctaggagagggattgctggtttataggagatacccgtatttatcctcgcaagacaattttgtaatgttgtcttcttgtttctatttggtaaagtcccatagcagtgtctgcacgctcaccaacactttgtattatcagactgtttaatttttgcagtttagtggttgtaaaatggcatttctttctgatctcaatttgcatttttttagtactcagtagttgtgttattttatctacattagtaaattctttttttttttttgagacggagtttcactcttgttgctcaggctg

SEQ ID NO: 18757 - DNA, 2260 bp, Homo sapiens
gtgggctccaggtcgctggcagccgggtggcagaactcttccgaggctccttgggaagaagctacacccgagggagccggatgggcctcgaaaacctggcccgctctggttctgtaccattgcaaggggaaccgtaaactgagcttttctaacgtgggtttctgccaagtacttttccagctgcccccttccccccagcacacaggagagcctctgtgtagccagcgcttgacagtcgttaggtaggttgtactgtgtagggaggagctcaagatcatgatggttgtcacaggagaaagcggttgcatctttgcaaaactatatacctgctgtggtttgtgttttcttttctgctgagtaatgaagttgtaagttcacactggcacattctcagggctgtgcagattatttgcactttatttcataggtgaataagtgctttttagctttctttgtatattgagttgcttttgaattgcttcccatatttttatttcatacaaactgaacaattgtggcccctctattttatttataaaggttcagtgtatctttgcctgcctacatcaatctgcaagggagttgcagaaagcctcatgttcatcgagccgtgagtcacaaccaatttctaagctgttataacaaaaaagtgtttgctttttttcacaagtaactttaaaagtgtagtttagaaagaaaacattttcaataaaaagacactacattaatcctggatgcttgcaaatcctaaaatatattcctcctctagcgttgcacagctctgtgttgtatacacagactagctttaaaatttgtcacataccactttacctttacttttatgtatcattcccccgacttccttactgcaggtgtgggcaagaaaacttttcctttaacacttttcaacagcgggcataaaattctgcagctgaggtcttgaagaatgcagatgggtacagtatgtgttggagctcacagtgtgtattgactaacctagttccttttttgctttttttggtattgtcttgttaaaagtgactcccaggtagcaactctcttttttaagggtgggaacgaaagggacgtaggaagaatagatctagattatttaacagtcttcgatagagtttgaaagctttcttcttcattcaattttgggcaaaatactgcctctgcatttgttcataacaaaaagattagattaataagtagcttttgttggtggaaattaccagctctataagtcacccttggtggttcatggacctctgattagcttgggttttgcagtctcattgccacatgtatatgtggagccaatggccttttggtgctcagctgtttacgtctgactccttgacttctttggtacagtgatggagtcagatctcattaagtgtgattctccatgatataactagcctcaaaaaaatgtgtattccactccagttgtaaatatctttagatcagcttttcattgcatttgatggggagaacacagaaatgatagtctgcaaatcatccaggtgaattgttatactagttattttttggtggttaatgtgataatattgtcttatttaaaaccacaaatgaatttcaggagacgaaaccagacagagggtcaagtttacagatgaccgtgtctgcaagagtcaccttctggactgctgcccccatgacatcctggctgggacggtaggtgcattttgggggacctcatggaacactctgacatgagtgctgtataggcagtgacggtttttctatgttgaattttgttttaacttaagtctctttttctctaagtggcttaattatggcaggtgttcctccactcgtatgtatgtttgcatgcatgcatgcgatggagtgtcactctgtgttgcccaggctgaagtgcagtggtgtgatcacagctcactgcagccttgaactcctgggctccagcaatcctaccacctcagcctcttgagcagctggtactacaggcatgagccactgctcctttctcaatcctccactcttcaacaggcagaaatccctgatgcccttaaaatgatagattctattcatttggtaggattttatattatggaacaaatttcactgttgtaaaattctgtctgtaaagttaccagattttttgtaaagtcatttatactgagatattcacaactaaatagggcaagtattctaatttggctgtagcaaaaaatatgctttaggtcagcctgaagttctttgaagattctgc

SEQ ID NO: 18758 - DNA, 1045 bp, Homo sapiens
gccggggggccctcagcctccctgaggtgcagaccgagttgccacgcacgccccagagccagtgtccacgctatcggtggggaattcatgccaagagactgaaggacagactctcgggacgagatgtcatcccaccagaggggatgaggtggtgggatcccagcacccctgatcggaagctccccaaagtgcggtccagggaactcagggggttggtgccgggatcatgaatgtggggcgcgctgcagtatcgggtaccaccaaggcaggcctaggaggggactcggtgtcttgtctaccctgcaaactggagcctgcgcagggtgggttgttcgggcccttcacgctccgtccgtccctgcgcagcagcattggtcgaggctccctccccagggctggtggccgccggcacagccacctttgacgcgggttgttccctaggtatgtgcaggaggttatgcggcggggacgcgcctgcgtcaggccagcgtgcgcgccggtgctgcacgtggtaccagccgtgtcggacatggagctctccgagacagagtacgtgcgtcctgagggtcctcccggtcctgcccaccccagccctggcgtcccaagccaggtcccatcgtagagccgccgtcccggggcttgagctcgggtaccacgctcagaagcagctgtggcaggagagggtcccgtggcatcagactcgaagctgcccgagagccttctcctgtctccatcaaaggagacgctgactgtccagcatgatgacaagtgaccaaaaggcccggctggaggcctgggcacagccagcccctgcatccacacaggtgtcacggccaggcttcctgtggggcagagacctgcctgcgcctccacccggcttggaacgggccggtccctgccaggcctgacttgaccaggctcggggctgcaggtgctgaggtgcccggggtgcgtctgcttgcagtgtgggtctcagccatgcgtgtctgtccagcccgtgcagtcagtgagtcggggctctgctcccacctacaatgctgactgc

SEQ ID NO: 18759 - DNA, 1802 bp, Homo sapiens
tgaacccgggagacggaggttgcagtgagccgagatcgtgccactgcactccagcctgggtgacagagcgagactctgtctcaaaaaaatgaaaataaataggccggttgtggtggctcactcctgtaatcccagcactttgggaggccgagggtggtggattacctgaggttaggagtttgagaccagcctggccaacatggtgaaaccccgtctctactaaaaatacaaaaaaattaggcaggcatggtggcacactcctataatcccagctactcggtaggctgaggcaggaggattgcttgagcccgggaggtggaggttgcagtgagccaagatcgtgccactgcactccagcctggctgacagagcgactctgactctaaataaataaatacatacatagatacatggtaacttagttccctctctttcttttgtattgacaccagatttactcaatactgttttagtttgtcagtccaataagatgagaaaataagtatgagatgcaacttggaattaaagtgatcaaatgtttgctctgacagataagcttcagcacctgttaacttggagaatcaagtgaaactccaccggcttcatgtggaagctcgtcaggcagcatcacaacatgtacataacccaagagccgttctgtacaaggttctccttaaaatataatgggaggccgggcgcggcggctcatgcctgtcatcccaacactttgggaggccgaggtgggtggatcatgaggtcaggagttcgagaccagcctggccaacatagtgaaatcctgtctctactaaaaatacaaaaattagctgggtgtggtggcgcacacctgtagtctcagctacttgggaggctgaaggaggagaatcacttgaacccaggaggcagaggttgcagggagccgagatggcaccattgcactccagcctgggtaacagagcaagactctgtctcaaaaaatatatatatatacaggccaaggcaggcagattgcttgagctcaggcattcgagaccagcctggccaatatggtgagaatcgcatctgtccccaaagtacaaaaaaattagctgggcgtggtggcacacggctgtggtctccgctattctggaggctgaggtgggaggatcgcttgagcctaggaggcggaggctgcagtgagctgagatcacaccactgttctccagcctgggcaacagagcaagaacttgtctcaaaaaaagaataaaactaaactaaatctgtgcagagctctgcccacagccgatacatacgctgcattccttgaggccttgctgtctccgctccttctgtctatgccccgtcctgcctctccatcctcagggacaggaccggtggcgaggggcccccggccaccctgggctgggacggcatctgctggggctgctgggtcaggcctgatgctttttgttttccccaagtgtgcagctggtgctgagaggtgatggtgctgcttgtccccacacaggaggaggaaggtgaggacggcgatccatcgtcagggcccccagggccgtgtcacaagctgcctcccgcccccgcttggcaccacttcccgccccgctgtgtggacatgggctgtgccgggctccgggatgcacacgaggagaaccctgagagcatcctggacgagcacgtacagcgtgtgctgaggacacctggccgccagtcgcctgggcctggccatcgctccccggacagtgggcacgtggccaagatgccagtggcactggggggtgccgcctcggggcacgggaagcacgtac

SEQ ID NO: 18760 - DNA, 1028 bp, Homo sapiens
caccccatccttctcaggtttagatgctgtttctactctcattgtgtagatgagaaacgggtgcacagagccaggactgcgccagagcccacggcgggagggcaggaaggccacacacacggagggtcccacctcccatctgccaccctgcttgcttgtcacaggggagctgtccctggctgcatccctccgcggcttagacactggcggcctggattttaaaacatgttttgctatgaaggatgttattggagcagctggcaaaattggaataagatctgccacgtgatgttattgtatcagggtcagtttttttaaccatccatatttgtactgtggttaggtatgagagcgaccttgcttttgttaaatacactctaactggttcagaaaagtgagcgtgcctgtgtgtgtgcgtgtgtgtgtacgtgtgtgtgggtgtgtgtgcctgcgcatgtgtgggcatgtgtgtgtacgcatgtgcctgccggtaaggggatgataaagcagttatggcagaatgtgagcccttggggaatctgggtgaaggtggacgggaattccttgttctatttttgcagctgttttgaagtttgaaatttaaaatgaagtacccttgaaagttacacagggccaggcgtggtggctcacaccggtaatcccagtgctttgggaggcctaggtgggaggagtttgaggccagcctggacagcaagacccccatctctatttttaaaaaaagctataggggggccgggtgcagtggctcacgcctgtaatcccagcactttgggaggctgaggcaggcggatcacgaggtcaggagattgagaccatcctggctaacacggtgaaatcctgtctctactaaaaatacaaaaaaattagccgggcatggtggcaggcgcctgtagtcccagctactcgggaggctgaggcaggagaatggcgtgaacccgggaggcggagcttgcagtgagccgaaatcgcgccactacactccagcctgggtgacagagcgagaccct

SEQ ID NO: 18761 - DNA, 1050 bp, Homo sapiens
caacagaggcggcaggcacagacaggagcaggccctgctgcgttccgcacccccagagggcccttgtgtggtggggtgggggccgcagtgtgcgtttctgtgtgaacagtctgcagcaaacaacctcatcggaggctctgtaggaacctgcatcaggtccatgtggcctgtcaggtggggctgtggttggaaccttcggtgggaggtccctcagccagaggcccaagtgagaaacccacatcacgggcacagctgcccggggcctgctcactgctgctactgggaaactggacccgaggatggtggtgagcagaggcggggggaggcccaggaagccgataagctagcaggacgtgccgtggttgcactgcccacttctgctctgttgagggccttggttttgcaaaagctatgccgtttctctggtgagtccatggctctgcagcagggacagcaggaggggagtagcttagacgctcataggagcagaaccctgttgtggctgcacccacggaggcccaggctgtgtgcaccttgtgagactctttaacacctgcccatcagagttggagcaggttcatcccgaaaagccccctgcccccactgtccatggaaaaattgtcttctacaaaactggtccctggtgccaaaaggttgggggccgtggctttacagcatctggtaccagaatgcgtgccctgcggggaggggcctcttcatctttagcctttacaattacttggaagtttcacgttttcatttacttggctttttcctttatgatatttttttctgttcctctaaagctggagaggttgccattctctgtaaatctgatgactctgacagttttgctgttctcagaaccgtggtgacgcagcctgcaaggccacctggagtctttttatggagctcgcgtggcggcatgagtgctcctgttggcccctcagccgtgctgctctctgggcctgatgatgggcttttcatcctgcccttggtctctgtggtgctgactgttcagaccataagcgcgtctgtctgcgcctctgg

SEQ ID NO: 18762 - DNA, 1030 bp, Homo sapiens
agcagggtcactcctgaaggaaagtgggttctccacccagacagacggctgctccccagtggggagctgggggcagtcctccaaaggaaggctgcgggtaatgcaaagggaaaaggagagtgggtactgaacaggcggctggtgagcattgctaccacagcagggcctggagcttaggcctcacgtgttaggggatgcatatcctgtggagagccggttagtcgtcccggtgtgtccggaattggtgggttcttggtctcactgacttcaagaatgaagccgcggacccttgccgtgagtgttacagttcctaaaggcggcctgtccggagtttgttccttctgacgttcggaggtgttcggagtttcttccttctggtgggttcgtggtctcactggcttcaggagtgaagctgcagatcttcgcggtgagtgttacagctcataaaggcagtgtggacccaaagagtgagcagcagcaagacttactggaaagagagaaagaacaaagcttccacactatggaaggggacccgagcgagttaccactgctggctcccgcagccagcttttattctcttatctggccccacccacatcctgctgattggtagagtccagtggtctgttttgacagggcgctgattggtgcgtttacaatccctgagctagacacaaagcttctccacatcctcaccagattagctagatacagagtgtccacacaaaggttctccaagtccccaccagagtagctagatacagagtgtcgattggtgcattcacaaaccctgagctagacacagagtgctgattggtgtgtttacaaaccttgtgctagatacagagtgccgattggtgtatttacagtccctgagctagacataaaggttctccacgtccccaccagaatcaggagcccagctggcttcacccagtggatcccgcaccggggttgcaggtggagctgcctgccagtcccgtgccgtgcgcccgcactcctcagcccttgggtggtcaatgggaccggg

SEQ ID NO: 18763 - DNA, 1031 bp, Homo sapiens
cctcagtgtctttgagacggagccaggtggcggcggcatgcgctggtttgtggacacagctgagcgttatgcgctggctggccggccactggccgagctctgtgaccacaacgcaaaggtggctcgagagcttggccgcaaccaggtaggtaggtgctgagcctgggggtccctgggccacgacctcagggcaggggctggttcctccgtcagctgcgctcaccccacctcaagctccgcaatggactccagccagtcgcaccaacaggccttgccttggtagctgagggtgtcaggatcacacagggccagggctccagggtgggccagacccaggactgtcctctgaggggcgggggtctcgggagtcgtgtggctcaagctctctgttcttccccccttgcttctggagctctccaggcaccagcagcggtggagccgtgagctgccgttcccatgcccatctctagctgccccgcaagtccccactgcccaattctgttttcctctgtgctgctgtagggcggggaccggggtttttgtctttcccatgagcctcagctttcctacctggggtgggcctggacattgggtactgagggcagctgaatgctgagggcttgtgactgtccaggcagagagggacctgcatggggtgctgggtgtccaggacgcccacaagtgaccagtgcccgcccctaggtggcgcaaacgtggaccatgctgcggatcatctactgcagccctggcctagtgcccactgcaaacctcaaccacagtgtgggcaagggtggctcctgtggcctcccgctcatgaacaggtagatgccgggggcagctctccccaggggctggggctgctcgagcccacccacccatgggcccttcctgcccccagtttcaacctgaaggatatggccccagggttgggcagtgagacgcggctggaccgcagcaaaggagatgcacggagcgacacagttctgctcgactcctcggccacactcatcaccaatgagggtaggctgggg

SEQ ID NO: 18764 - DNA, 1035 bp, Homo sapiens
gggatctcccacccaggtggcactgttcagccacccgaagaccccatctccttgcatgtgggcacccactgctgtgcctcccatgactggattggcagtgaagggagctctgtgggtgagcaggtgactgagccttccccaccagtggtgcaggaggagtcaacggccaaactggctgcaatgtgtgggttcaggcctcattccttcactgggcaggaaagaggggtgatggttagtggcagctgcctggagcagtaggcactaggggcccaggcctcgcctctgagggtgctcatgctcttccgagcaggggctgagatgaggcctggatcccagcacccactccccagggtgtccagctttcaaggctgagctgccctgggcttgaccatgggccctcagtctgctggggcagcaacacgggtttctcttgaggccacgtgcctgctgcgccatggtgcccctcctcagagcccctggtgcacccccagaagcatctcaaactgggggcgggagaggagctctgccgctgtgccacgtgccaagtggcagggacgcgggtgtgcctgcgtcacggggctgccacggaatgtgtcagtctgcaccctgtccccaatccccagccaccccagctgtcagccaggctctggggctgccactgcagatggagcccgatgtgcatttctctggccaccagggccctgcccagctctaaggccctctgcaggcagggctcaatggtccctgaggttctatgagggctgagtggttggttaggctgtgccccagtctggtgctgacagagatgggggcaccagagatgggggaagagaccttcaaactgggggcgctgaggggtgaggaggtttcccaggcatgtgtccaaaaggatgtcccaggggtgggcacgcggtgtgcagcctctgcaaggaatgcagcgccgtggcagggaccctgcaggatgagggcagtacttggagagaccactagcccagggcccagcaggaaggcatcgagaccccatgaggcagaaca

SEQ ID NO: 18765 - DNA, 1027 bp, Homo sapiens
gggaaaccaaggcctgggttcacaggggatgccgaggcaacgtggctttaggaggtccccacagtggggctggggctttggcgcaacgtggctttaggaggtccccacggtggggccggggctttggcacggcaagcaggtgcgacacacgtgccctggcagcaccatggtggtccacacgccggcgtgtgctcgtgtgggcgtcccgcatggggttaaccaggcacccaccttcaccttccaggggtgcacttcgtcttcgacaccgccttctcaaggcacttcagcctcctggagagccagcgagagtttgtgcggcgattccgaggacaggccgactgcagacaggcgctgcccctgctggcctctgcctgcccaggtgtgctcatggtgcgggtggtgggagagtcaagttcaagtgcagttgaaacgtgaggtgatatggacacaaatgacaaggcgggggcatggggggtggagacgcaagcaggttttgcgggacgggttggaaatgttggcacaaatggccttttctggagaagaggctgccctcccgtgggagccacgcgcagtcacctcaggtccctaggcggtgtcgcctgcacgccgagctccgcgtggtggtggggagaacaggaatgagcactctttaatgtcatcatgatctcctgtatgagcgggcccgcccccagaatgtcgtgctgctgcctgtgggtgcgggggccgccgtgcgcccccgccagccccgtgtgccccctgtcacctcaggctggatctgctatgccgagaagactcacggcagcttcatcctcccccacatcagcaccgcccggtccccgcagcaggtcatgggctccctggtcaaggacttcttcgcccagcagcaggtaacggcgttgggccagccccagactcaggctggggagcggccagaagtgactttgctggcctcttgccatgaggctgcaggaaacagagtcctcgctgtgctgtgcggccttccccagcacacctccacccttgttcc

SEQ ID NO: 18766 - DNA, 1604 bp, Homo sapiens
ccaccttccagctctgccagcacctccagctcggccgcgaactggttgtggaaatcatcctcgacgccgcacagctcctgctcgtagtcctccataccgtccgcgagcccgagctcccgctccgaacctcccgcgccgccgccgccgtcgcgcactgcccgccccgagcgtgccgggcgccgccaatcagcagccggcgtgcccggcggcgcgcgccattggttggcgtggcggaggcggggctgcgcgaggggtgggcggggcgagttcctgctccgcagcccccgcgtcctgtcctggggagctcgccattggccgccgcagccgcccttccgcggcgggggcgggccgggggcgggccgggggggggggcggggctgcgcgcgcagcggtgcagggcggaagcgctgccaggcgtccggagcggagcttccagggtctctgggtcgccagcgcgcgggcgcgcggctggagccggcgccgggcacggcatcgggggcctggactgcacggcccggcagcaggttggtcttggcgtgggcgtgggcgcgggaggggctcggagccagggtcggcctgcccaccgggcctgtgcggggcgcgggtctgcgcggactgcggggagcgaggaggccccagccctaacccgcgctgcgggcagacctggctgccgggcctggtagtgctgcagcccctccccgcccccaccgtcgggcagaggcattcacgtgcatcccctggaggggagggtctgtggggaggatctgtggggcaggtttggaacgggctctttctccaggcttaggtcaggcagggcccttcaggtcagcccggagcaggctgactccttgactccccagctgacgccctggggactgatctcggggactgaggatgcaggtgcacagtagggctgcggacccggctcggtggcttcgcaccggagcccgggtggggcggtgcgggtacctctgtatgctgggctgggggcgcaccacgtgctcacagcacacgcacccacgcgtggctcggcaggccggccatggagccaggcagcgtggagaacctgtccatcgtgtaccggagccgcgacttcctggtggtcaacaagcactgggacgttcgcattgacagcaaggcgtggcgggagactctgaccctgcagaagcagctgcggtaccgctttcccgagctggccgaccctgacacctgctacgggttcaggtagggggggcggccggagccccacggtggcgtctgtggaggaaagtggctcagactctggactctgtcccactccaggttctgccaccagctggatttctccaccagcggggcgctgtgcgtggccctaaacaaggcagccgccggcagcgcgtacaggtgcttcaaggagcggcgcgtgaccaaggcttacctggcattggtaagacctggtcagtcctggggtggggcgtggggactcaggattcccaccccacttgggcagccctggctcagagcctcccaccacgctctacgtggttgcttggtgttaggtgggctccccggcagcactgggctgccccgtgaactgcgtgcgattctccctctcctgcagctgc

SEQ ID NO: 18767 - DNA, 1027 bp, Homo sapiens
aaaatgacccgagaaattgtcccacatgcagccacgtaccttccaatgagaacaacccgagaaatcatcccacacacggccacataccttccaacgagaacaaccagtaccttccgatgagaacaaccaggtaccttccgatgagaacaacccgagaaatcattccacacatgcaaccaggtaccttctgacaacaacgacccaagaaatcgtcccacacgcagccaggtaccttccaacgaggacaaccaggtgtcttccgacaagaacaaccaggcaccttccaacgagaacaaccaggtaccttccgatgagaatgacccaagaaattgtcccacacgtggcctggtaccttccgacaaaggctctgagaccattcaatgggaagaggacagccttttcagcaaatggtactgggaaagctttatctccacatgcaaaataatgaatgaagctggccccttacctaacagcatacacaaaaattaacccaaaaaacataggatgaaacacctaaatgtaagagctaaaactgtaagactcagaataaaacctgggaaaatcttaaggacattggatttggcagtgttttcttggatatgacaacaacagcaccggcaacaacacagaaaataaattggacttcatcaaaatttgacatttctggccgggtacagtggctcacacctgtaatcccagcactttgggaggccaaggcaggcggatcacctgaagtcaggagtttgagaccagcctggccaacatagtgaaaccccgtctgtgccaaaaatacaaaaattagcctggcgtggcaggcacctgtagtcccagctactcgggaggctgaggcagaagaatcgcttgaacccgggaggcagatgttgcagtgagctgagaccgtaccactgcactccagcctgggcaatagagtaatattctgtctttaaaaaaaaaaactgtggctataagtgagactgcagagctgccccgggctgctgtctgtggaagccctgccctgcgggagcag

SEQ ID NO: 18768 - DNA, 1075 bp, Homo sapiens
ccgtcctgggggcaggcacgccgccgagggcaagtggtgggtgcggaagaggatcggagcctacttccctccgctcagcctggaggagctgaggccctacttcagggaccgtgggtggcctctgcccgggcccctctagacgtgcaccagaaataaaggcgaagacccagcccctcggcggctcagcaacgtttgcccttccctgcgcccagcccaagctgggcatcgccaagagagacgtggagaggagagcggtgggacccagcccccagcacgggggtccagggtggggtctgttgtcacatactgtggcggctcccaggccctgcccacctggggccccacatccaggccaacccttgtcccaggcgccaggggctctgatctcccatccatcccaccctcctcccagaggcccagcctggggctgtgccgcccacaggagttgagacaatggccatcctgacaccttcctccactacagccctgaccatagacccagccaggtagctcttggggtctctagcgtcccagggcctggtttctgttccctcttcaatggtgtgttcccagccaggtcctgaccctcagagccaagtccctgtcacgtctggggcagccaaaccctcgccccacagggacctggacacgcccggccaggatgtggggttggatgggccattttctgtcctatccctcatctccacccccgccacagcctacacgcatcccacacatgcaggcacacacagcctgtgcacacatgtgttcttggcccggtttcatccccccatgactggtgtctgtgaggtgcagatggacacagcgcacacccagaccctccaccaggctgtgacctcgctgcctctgaggccttgacaaggcccctcaatcggaggacagccggccgtgcacactttcatcatcgtcggacaaacagcgtctactgcacatttttcttattcctattcttgagccatagctatggcatattcttctactattcctattataccacttaccagcttactcgaaaacacactgtttaaatgaagaagttcttgtacctccctcc

SEQ ID NO: 18769 - DNA, 1125 bp, Homo sapiens
attggcttcctcacagcttggtggcctcagagtagagggacctttaatggggttggagctgcctcttcaaggactgagcttgaaagttcagaacatcactcacgctgcattctcttggccaaagctgagtcccaaggtcggctgggattccaggggaggcgagccatgctcaggaggggcagtggccactacagctgagcctgatgctcttctctttttaacacagcattgggtcatgtcagccccatgtctgttacatttgtcaccgtctttatcactcagtgtcatttttctccatctgcagttgccttggtgggaagtgggggttccacgtccacaaaggcatcgcactgtgtccctgctgtggccctttcccaggtgaggttctgagagcccgtggcaattaccacttcgggacacaaacatccaagggccgcttcccacggggacgcttgtgattggcttgttcctggaacacatgggacctccttcttcatcccaagaccctcacctgataagcataagcagcccccgctcccctccccgtcagagctcagccgacacacgtcagcagccccagcatgcaagagggaaggagaggttaaagtcccccaccccaaaagccagaccaagagctgggacttcgggtgtgggcctagccctggagatgcttgttcccaacacctggccaagcctgctgcctcctgcatgggtctcgccgcaaccccaaacacacaacaagcagcctaaaagggaagtggcagaccaggcattccggttcttctctggcttttccctgtgggcactagggggtgggtcccacatggggcactcaagccctaacagacgacactcattctcccccaagatctgctgccttctaagtccctaaacaggtgtcatccccttcactctttcctcatgtttttcttatttaaaattgtctttttaggagaagtttgcaggctgtttcctgaggtctgggccagcagcaccgccatgccctgacccaccattcccctggccgcgggctgagtgtcccagctgcacgggaactcctggccttgcctgcagcatgcgacactgccacacccacctcacggctcacagccaagtttcaggtca

SEQ ID NO: 18770 - DNA, 1028 bp, Homo sapiens
tgcttcctccttcaggctctgatgacactgaagctccccggggagaacagcggtgtcctttgctgctggagatgcctgcagatgcttgctctgggcatgcaggggcccctggggaaggatccgcgcctggctccctctctccatctgtccctcgttttggacgggaagtcgactatcattcctgacgttccagtgtaacgtgttatgtttctctgatggctttggggattttatcttccgttgccagtttcttgactatgatatgcctactttttaccaaatttggataatttttgccaatatttgggggggttgccccatgttctttctcctctcctgtggctccacggacatggacatcaggcctctccctgccttccacgagctcctgggccctgtgcttctgtgtggtgttttctaaaagcctctcatctctagaatgagtcactgtggctgctatgtcttcgtgttcactgccttttctttcgttcttcactctgctgctgagctcagccaggggcatttgtgctctggagattttagttcttgctctggagtgggcctggccttcctccgaggctctgtgtctctgctcagctctccagcccgcctgcctggcaagcacgttttcctgtgctttccggtcctgatgctttcctgcgtccgtgtggagccagcgcttggggtgtggtgtgtagagaggggaatgtggacatgcagtgcgtgctgtgggggctgacgggctggggccggtgtggatgtcgtgtcgggggccgagccaacgggccagggccagtgtggatgtcatgttgggggacgacggactagggccagtgtgaatgtcttgttgggggcccagctgacgggccagggctggtgtggatgtcctgttgggagccgacaggctggggccattgtggatgtcgtgttgggggctaagccgacgggccagggccggtgcagatgttgtgctgggggccgacaggctggggccagtgtggatgtcctgtccagcaaggccctggagg

SEQ ID NO: 18771 - DNA, 1028 bp, Homo sapiens
gtaaatgcacgtggaaggtgtaaccccttggccgcatcccattctgtatgcacggactttgctttctgcacaggtttcctcttgtgtccagtctgcccgtctttccccattttcattgctgccttaggtgctttgtcgaaacggcctccagcactttttccttacacttttaagggctatttacatatttacatcctgttttaaattgcttacctgtagtgaatggactatgtactctgaggtcggttttcacacagtaatgggagcactgtccatccatcccttcgtctgtccatccatccatctgtccgtgggagccacacatgcacttggtgctccctgcgctgcctggcttcaacagcccgggtcctcccaacagccctgggacctggacttcctcttggcagctccagtaagaggcaacaggcgacagatgtttgcaaagacacctcttgttattaccattttattttctctgttgtatgaacttaaacattagggtggcagcagtcatgtcttcagtgaaccagttgcctcactggcactgccgaactggtatgtgtggtccagccccacccctgccatccccacgagctgccatccagccccatccctgctgtccccgcgagccgccgtccagccccatccctgccttccctgtgagccgccgtccagccccgtccctgctgtccccgcgagccaccatccagccctgtccctgcaagccactgtccagccccatccctgccgtccccacaagccactgttcagtctagcgcttccctgtgccaggcaggccatggccctgcacagcgggacccagcgtcccggccttgccagtgctagctggcaccccgttccgtgattgagtgggaggcacagtggtctggtgggtgctccaccccctctcctgcgaggcgggtagacatggaagccccccagctgctctcacccaaaggcgcccctctttttttgtggtattttttttttggtaacttctgtaaataaatccacgtttggccttcacc

SEQ ID NO: 18772 - DNA, 1059 bp, Homo sapiens
atttgaggagaaaatgaaaccaaaaagaatacttgaaaccctgctcagttggttttgttctgagctttcagtggctctaagagctcatgggaaatgagttctttttcttttctccgggccacttgagttctaatgaaatgcaccacttggttttacaagttcttctataaaatacttgcttgtttaaaaagcaaacagcactgccctacttcggagctctgcagcacatcccttaaagaaaaaatacttgaggtcactgtgctgaggcccagaatttaaccacggccagtaagaaccatcaacagagaacggcatttctgggatgactgttttaatcttacaacaatttatctgaaaggagaaaagagaaagctgattttttttttctgattctttttttttttttttttttgagacagagtttcactttttcgcccaggctgcagtgcagtggtgcaatctcctctcactacaacctccgccttccgatttcaagagattctcctgcctcagcctcccgagtagctggggctacgggcacaggctgccacgcccagctatttctttctgattctgaaacaaagtatttatcggccatgcctgctgttggctgctcgggcgacacggtatttcctcggtatttcctcgttgcagctcccaggtcaggctctgggtccctgtgagaggcgggtggccgccatggctctgctgcctcccgtgtggggtagtgacggggccttccgaagcttgactgcttggttagttttgttttgagagcctgtgatgtttcaagatttttactgcatctttttatgtagctatttttataacatgagtagaggttgaaatagtttttttctctctgaaatctcaattcagtctgtcttcctttttcctgataagcaggaagcatcctatgcttcttgccttagaattactgatttaggctattgctttggtgaggccacatcttgttttcctctgtggtcctggagtttgcgttgtggtgaggggtggagcacatccacccttcagctagcgccaattaggtccctgtgg

SEQ ID NO: 18773 - DNA, 1375 bp, Homo sapiens
ctcctttgatctccgcagggattctctgttcaattcagaaggaactgcttttaagccactgggtcaagcggatattttaagcctggtgcccagcattgaacatttctccttgacatatgcacgttcttctgtcttgtgagtacatttggggtagaatcagtgtttttctgctgtatcaaggaaccagtttcccatctttcagggacatggttttctggctgagctggcccagggcaagcaggcagtcatcctgcatttatctccttctagaaagttctggattttactgggactgtgcgctactccctgttcctcagaatcccagggtttttccaagttgccataggggctctccaaatatttcacttgatactgaattttacaatgtttatagctattgaaacacttgtaattaaacacataaccaaatgtattctgtggaaactccccttgttaaaagacattgaactgagggaggcttacccttaggcagattgtctcagcagacatgtagtaaagatgtacagatcaggagaacacagaaacgcctgccctgtcggggaagcttcgaagccagacctggagaggccggctgccagcgacaggcctctgcattcaacctgactttgcatccgtcctggggctggctccttcccaccgcgggcctgggcgtttccatgtgctgccaccgaggtgtgtaggtgctaggggtgtgctcactgcacacagacgtgcataccgcgggcgtcctggggtgtcgggcatgccctgctgtgctgtgggagccggagtgtgttagcggaaagcggcattttcacagggctcagagttgaagacacacctgtcttcctgacgtgtggactcgggtccctagtgtgattactgcgttgagcagatgctgaagtagcaccctgcccggtgctgacctcctggtgacaacgccactacccccagtggacagcgaggaagcagggtcagccactggcccggctgtgcagcgattgtccgtaggccctggagttcagccctgcccttcattcacgccactgtgcagcctgcgtatcctggacacccggttcacatctgggcagcggcgttctcgggccgtgacggctcctgggaggaccgaggctgcccgaggtggtcggggatgcctgacactgacactgagcttcccctcagcacagatgtcactcccaggaatggctgaaatctggacgagtaaaagcttatgtgacaggagtttccggcctaagcagcgggacctgggtgccatgttcttggtgtgtaggggcagtgccggccgcccatgggtgccggtgcctcctgcagtcaggcctgctgctgtctgtgtgcgcaataaggaaaccgaacc

SEQ ID NO: 18774 - DNA, 1060 bp, Homo sapiens
cgccgccgccgccgccgccgaggctcgggtcccgctgcgggacccgcaacaagtttctttaagcggcggccccgcggccccgccccgcgcccggctacccattggcggagcgcgccccgatcccccggaggcggagcccggccgcccccgcccccccacccataaagaaagctccgcggctctcgccgcgcccccgcctgccccgcccggcgccgcaccacgtgggccaggcgccccacgcctggagctcccctctctggagccccgggaaaggaagcggggcagggaggccgggtgggagcaggggggtctccggcgcttcctctcctctgcgggcgccgcgcggctcctgagagtccgccccccgtcctgacgctcagctaggaagcgggtcctcgggcccctcccccgacacacacacacacacacacacacacacacacacacacacacactctctctctctctctctctctctctctctctctctctctctctcacacacacacacacacacacagcccgtctcgcgcctgaggtctcgcccgcaggccggtggcgcggggtcagctgctgcctgcggtccaggacagggtcggttccgccgcgcagcgcccaggcccagctcgtccagagtctgcggacagcgcacgtccaggtaacgcgcttcaaggggccgcggctcggagctgggggaccccgggccgccctgcccatacgagtgcgagcgtggagagcgcgggcgggggcgcggtcccgggggccggccagctggagggggcgggagcgctgggcggggcctgcgctgaccccggcgctgagtccctggggccgccgggcggatggcgtggccggacgcgggggccccgggccttccgggcgtgacctagggctcgggggcggggaggcccctccggcggggcggccctgggtggtccggcagaggcggaggccgctccgagcctgtgagccctgggcgcctgcggaggcggggagagggcggggtgtgccgccctggtggggaccgcggggtcggagaggggacattgccccccccgag

SEQ ID NO: 18775 - DNA, 1035 bp, Homo sapiens
gggctcggggggtgtgaccgccgagcgccaggcctcgggcgaggggccacccgccaccctgtggttgctcccatggtccccgtggcgctgactggtgccagctgcttccagggaggagaagcggaggcctgggcagaggggtgaggtgcaggccacgtgccccacagctgtgttcccgacaaatctcatgtgcggctagggcagcgttcttcttcagaagtcaccctcctgcctttcctgctgattatgctgaaaatgtctggaaaggccccagctgtcttccccggcagagtggggttttgtccctctgcggccccttggctgccgagtccttgtttctccagctgttttttgggatgccccctgtgtggtgaacctgctgtcaccctgacatggccaccaagtcctgacgagtcagccctgcctggctcagccagctccctgctgggtggggtgggttgtggggagtgaggctgcaggaggtctgcgagggcgggactcgatgtcgggtaggtggggcagtgaccgcctctttgcttctgctgggccccagcttgtctgaaccgagcaccaggcaggggctggccaggctgtggaggttcccggcgcgccgacccccacggtcgggtctgacaggtttccccggggtgcggttgcctggggccatggagggaccatcggtcccaggtgaggacaggaggaagggggtctagggcccttcagggacaggcaggggtggctttgcctgtctcagagcaggcctcagcagcacactgtccagtaccaggcatcagtgagggtccaagaacttgcagccagcagggacgacagggcagggccccccaggagagaccccacacagcgcacatgggagagtggatgccaaaggtgggcagcggggagggcgcctgcgcaacagtccctgtgtggtgtgccccacgctgctgaggtctctgtgcggtgttggccggcagtccctgtgtggtgtgccccacgctgctgaggtctctgtgcggtgttggccggcagtccctg

SEQ ID NO: 18776 - DNA, 1032 bp, Homo sapiens
tccctccgtggggggctgggtgcggccccctgccgtgtatttcctccccagggagtggggcctccccgggagctgacgccaccaccctgcttagccctcacagggccccaaggtgtccgagtgtgttgggtctgaacgcgaaataaagaaatcctctcagcccgcctttgccagcgtcgtccctcccaccccacccagaccacgtccaacagcctgggactttcgggaccctggggtcggggcaccgtgtggagtgagaaaggcgtgaaagacagcggctgcggccacccagggcaccagccacatcctcttcctcgtccccgcccctcagcctccctcctctggctcctggctggtgggtctgggggcaaggcagaggcgctccaggtggaggggggcgggccggggtgcccacgctggggtgacgcaagaagaaaactcccgggcctcagagtcggcgccggaaacctaggtctgggtttccctcgtggtggttgtgtactgaggacctggaagtgatcatattttggatatattcggttaaataaaatcagcggttaggattcacatcgctgcttcttgccttttaatggggctgctgagcaagatgggttcccgtggagcccggctgtgcccctcaccccgatggcgctgcccaggcctcgggctccgctcggacgtgggcctggctgtgtccggggtgtcctggggctctcggcctccctgctcccagcgtccctcccggcgtgcccaggcctcgtcagggcctccttcccctccctcggcagctgaagaagtcccctttgccagaggacacgtgtctgcgccctctcgggagtggggcccctcagatccatccagaagcaggcagttggggggccctgcgggagtgggagagctgagggctagagttccattggcagttgggctgtgaagccgtgaggttctggggagagaaggaaggttctggaacggccccgctgccccacacctgcctccctggggaccctgagaaggcagccagacgagggc

SEQ ID NO: 18777 - DNA, 1048 bp, Homo sapiens
cccggagaagagcgtggtgagcctcttccacgacccgccaggtgtgtgtgggcagtgccgctgggcaggccctgggatcagggcctgggtgatgccttctggctgagtgtcccctgtgggctgaggttgcagccctgggctggggggtcatccctagcatggatcatagcagggactcactcctgtaatcccagcacttggagagaccaaggcaggaggatcacttgagcctaggaggttaagaccagcctgggcaacttagcgagactctgtctttgcaaaaaagcaacattatctggctacggtagtacacccacagtcccaggtacttgggaggctgggccgggaggattgcttgagcccagaaggttgaggccacaatgagctgtgattacatcactgcataccagcctgggtgacacagcgagaccctctctcaaaaaacaaaagaaaacccagcctggtgactcccacaccaagaccacggcctggcctcgctcgaccacaagtgtttcacggaagcgcagaccgcgaccttggagtgccggcctttcacctctgcagttgtgtccctggcggtctcacccgccctgcacgcagtacagtgctgcctgctccaggaaaggaaccccaggctgtggggggcaccctcttcccggagccaggctgcgagctgcaccacggtgcacacccatggagtgtagacctggcgctgctagacccagctgggccgccccgctggacgcggctcctgcttctgctggcatcagggccccgcagagcctcttcccctgtggcctccccatgggatccttttagcctttctgcttcccagggaggctgagaacagggagccttctggggaccgctgggctcgggagctcaggttgctgggctcctggaaggtgactgtgaggcccgagactgggcagcggggcagggcagtcctgcggaggcgggagtcgtggaggccccgtcagcccctcttctctcctaggctcctacaaccccctgaccctcggcctgttcacgctggtctacttcttcc

SEQ ID NO: 18778 - DNA, 1049 bp, Homo sapiens
ggggcctggtgccggccgggcctggggctgctcttctgccggggtgaggtgacgcacctcctccctcctcctctgactccgcctctgaggcctgtggttcgtctggtttctagagacagtgggagggtcacggtcaccgtaaccaagaaggctgctcttacggccgccagatgcggtgcccagcataacaaccgctggctgtgaagttgttgggaattcacccacctccccgagtcaccctcgggccccgggtgcgcctcagatgttggccagaaactgtcctttgtgggactcagcgcaccgtgcacactgggcccttcataatcccggggcctgcaggcggtctgggcggtcctgctgctgccagagtgactgcgccagggccctgcctgaccctcgccctgaccgcgccctgcaggccttccggacggtggagatcaagcgctgggtcatctgcgccctcattgggatcctcacgggcctcgtggcctgcttcattgacatcgtggtggaaaacctggctggcctcaagtacagggtcatcaagggcagtatccttcccagtgcggccgctgcagcttgggaggggggcgtggcctgggccgagtcccgggcagaagtcctgagcccagcgtgttccagtgcaggtggaggcggcccggccaggctggctgtgtccctgtcatggttgggccgtgagacgtctctgggatgtccagtgaacatcatggctccacccagcagggtggcatctgccaggctggtctgtggggcagggctgaggtctgggctgggtggtcatgacggggaagcagccagccctccttgatgagccccagatatcgacaagttcacagagaagggcggactgtccttctccctgttgctgtgggccacgctgaacgccgccttcgtgctcgtgggctctgtgattgtggctttcatagaggtgggtggcaggatgccgcagctatggcggaccccatgaaggattgggggtcttggtgaatgggcgggaacccctgcagctcacccacccccaccatcac

SEQ ID NO: 18779 - DNA, 1048 bp, Homo sapiens
tatggcttcctggtggagcactacgtgcggaaggaggaataccagacggtgaggcctgagtgctgctcactagcagcatcccgccacacaaggctcctgaaacgaaggcttaacggctcaaactgaggctgtgtgtggcggctcactcctgtaatcccagcactttgggaggctgaggcaggagaatgacttgagcccaggagttcaagagcagcctgggcgacatggtgaaaccccatctctacaaaaaggggaaaaattagccaggcatggtggctcacacctggggtcccagctgcttgggaggctgaggtgggaggatcccttgagcccaggaggttgaggctgcagtgagatctgatggcgccactgcactccagcctgggtgacagagcgagaccctgtctcaaaagaaaaaaaaaatctgtcggtagcaaaaagtaacagtctcacgctgttactggctgttactagcagtgtcgcaggaaagcgacagacttactttatttgtgaagaaatgtctgcatgtacccgagtctgaataaccacgatttctttttcagggattttcacaaaaaaagaaaatggtgttccattttttagtcgcttattttttaattttagagacagcgtgtagtcactttaaagtgaccagctaatcacttattcagccgcagtgttctagcgttttcctcatccccaccaacatttgatcattctttcgaactgtagccatcctagggggtgaacagtaccttgctgaggtttaaattcacattttctggatgagtagtgatgtgcagctccttctcatgtgcttattatccatttacacaccttctgtgaaggcttcaagtctcttctcatcattttattgggttttcttattattgtactttttttttttttttttggagacggagtctcactctgttgcccaggctggagcgcagtggcgcgatctcggctcactgcaagctccgcctcctgggttcacgccattctcctgcctcagcctcccaagtagctgggactacaggtgtgcatc

SEQ ID NO: 18780 - DNA, 1050 bp, Homo sapiens
accgcaattggatgtggacggaaggaaccagttgttttcaggacaagggagaggaaaggagccacgcggggcaggtagaggcaggtcccagccctgtccagccccacacctgggcctcgggagagggtgtgcacaatcgggagattttttaaagattccagttgtgggccgggcgcagtggctcacacctgtaatccaagcactttgggagaccgaggcgagcagatcacaaggtcaagagatcgagaccatcctggccaacatgatgaaaccccatctctactacaaatacaaaaattagctgggtgtggtggcgcatgcctgtagtcccaactactcgggaggctgaggcaggagaatcactcgggaggcagaggttgcagtgagccaagatcgtgccaccacactccagcctggtgacagagtgagactctgtctcaaaaaaaaaaaaaaaaaaaaaaaagattcccgtcgtgaagtcttttgggacaggagagtaaaaaagactgcatgtcttacaacgtggtgtttacgaagcggccatcacgcctcacgcactgaggccccagtgctgccaccacccagatgttagagaagtgagacgtctgtgaggagccgtggcatcccttccatccgatctgtagaactgactggaagctgtgcagtgaggacacagtgtttcttttgagattcagatgtgacccctgcactgcactccacgtgcatcatttgctgacggatgaggcccagcagcgttctggggagccctggacccccagtcttgaggcgtgtctcagcacggggcagctgtgtctgagccgtttataaactagttttacacgcatgggtccttccacgtggatttttacccaggacctcagcataaaggagaaagacaagccttggttttctgctgttagaaagaagtttcattgtaaagatgtgacttcctgcctggagctctagaggaccgagggcagcacagcctgaggggctggtgggccgggtgctcaggcctctccctgtgctgagttggtggcaagagttccg

SEQ ID NO: 18781 - DNA, 1040 bp, Homo sapiens
aggcagacattacctgaacacggaatcagtcggagaaaaagatgcttctgaggctagaggaccagtccaaacctgggcctgtctcctggatgcaccgcattcagtaagactctttaatttggcaaaggacacacacagcctcaggggtgacaggacctcagaacacactgcattcttcactgtgctttctcctctgaaacacatggtgcatggagaggttggcagttgcttttggttcattcaacagaaattctccactacggggctgggcactgtggctcacacctataatcctagcactttgggaggctgaagctggaggaccacttgagcccaggagtttgagacctgcctgggcaacatggtgaaacactgtctctacaaaaatttaaaaaatgtgtcaggcgtggtggcacgtgcctgtagtcccaacgactcaggaggctgagctgggaggattgcttgagccagggaggtcaaggctgcagtgagccgtgatcacaccagtgcgttccagcctgggtgacagagctagaccctgactcaaaaaaaacaaaaacaaaaaaattctttggtttacccagcccatttctggaggtgaccattgttaacttgctggttgtcttaccagacgcttcttctgccagtacaaacgcatactctttgttcacatatatgtgtgttaaaaaacaaacaaacagaaaaaccctgatccttgaaggtaaaaatttctgcacttgctcagggaggccaggaacctgaaggtattcagaacagctcaggtgtttgtctgtctgcagcccaggtgatctgacatgcttgtgggctttgcaggcagagctacctgcccccatggcccctgacccccaccttggcagaccctgagggcagctgcctggcctgacgggcgcagtgaggctgggaggggtgggggtccctgtggggggtgatttcccagtcggtttcctgagatctccctcggaccagagcaggagtgtggctgcgcctccctgccccacttccagctaccacaggtcatg

SEQ ID NO: 18782 - DNA, 1026 bp, Homo sapiens
tgcagccccagaaggtgcgcatggctgtgcctggctctccctgccctggtcacccagctcggagtcctcacccccgatgggtttcctaaccgcagtgtccttgcaactttgcctaagctaaatggaaattagtctccggccactctgttaacagggctccaagaagggtggaggcgagaggcagtgacacagaaagcgctgtgcagtacaatcctgggcacttgagtcttcttgggggctttctgcccctgcatgctgcctctgggggtggtgccctcagagctggaggggcttggagcggtcgtaggtggttgcaagagtgtcaggctgagcaggaaggagaaggtgctttcactggctctcctggagcagggcaagctggcagggtcaggacgggccatgtcagcggcccctcatggcgtgtcctgggttctgctgggcaccctaccatataggccagcaagccaggcctaggagtgtgacaggcctttgtccttccccggggccactgcaggtcgtggacgcggcgagaaagcacggggtgaaactgaccacagtgctcaccacccaccaccactggtaagtgccgcgtctcacctgggggtgtgggacctggctcacttctcgccccggtgggtttagggacatcaaggcctgtctccccccacggctctgtctgctttgtgaggacaagcccccagcagacttctgagaaagacccgggactcaccgtagcccccaaggggcaagtctggtgctcagtgactctgaggccccgagggtgaggggagaaggttacagccttaccctcaggccccaccccccggctctctcctgggccatgcgggtttgtgccctggcacgttggcctcaatgttggggaggaaatgagtctacaggtgagtggtttttaaaaaaaaaaaaaacaaaaaaacaaaaaaaaacaagcagccagccgggcacggtggctcatgcctataatcccagcactttgggaggctgaggtagttgggtcacttgaggtca

SEQ ID NO: 18783 - DNA, 2092 bp, Homo sapiens
tgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggaggtaggtatcagccacgctcggggtcgggcccctgggcggcgccggagagcggtcctggtcactggcgccttttctccctttagtggatgcccgtcaccaagttgggccgcttggtcaaggacatgaagatcaagtccctggaggagatctatctcttctccctgcctattaaggtacgcgtcggtcgttggggcgttgagcaagtgcgaccccggagtcatttgggctggggttggaggattagcatctgccattgactcgcattaaagggcccagcgtctcgcgtgagaggttgaggttgtgttgcgggctggctgaggagaggattccacttagaggttggatggatacctgagcgaagccagagccacaaaaggcatttcagcgcatcttcccacattcgcagcgaattcatttcgaaagaactgaaagagaagcagcgcttggttcatgccatccgagaggatgatgaagttcaggttgtgggaggacactgtaagggttagcaaactgtcatagtccgcgtgtacgggacagctgtcatctgcatccagcgggtgcagtggggaaaggctaatggcatatttgtcatgtgagcgttcgccctagcaaggtacggtggtcatggctaggccaaagctggacaaagcaaaaggaaatctgagtggaaagccacatctcaccaaacaagagaaaaagggcaaataggaagaaacgattgagatgcagaaatagggtaaccttacatacaagcttccaaaaacgaaacgaaggggacagatcggggggaagccaggtgagggggttcatgacttcttcggttttttttgggcggggtgggcggttacacagtttcgccctatcgcctaggctggcgtgatctcggctcactgcaacctccacctcccaggttcaagcgattctcctgcctcagcctcctgaatagctggggttacaggcgcactccaccatgcccggctaattttttgtgtctttaatagaggtggggtttcaccatgtggccaggctggtatcggactcctgaccttgtgatccgcccacctcagtctcccaaagtgctgggattacaggcttgagccaccgcccccggccgtgactttggttcttgaatatcataatggtattaagtttttttttaatgctctccctacaattttcttgtttgtttcaggaatcagagatcattgatttcttcctgggggcctctctcaaggatgaggttttgaagattatgccagtgcagaagcagacccgtgccggccagcgcaccaggttcaaggtacccggctgtcctggagggggctgcgctgggcttgccgggactctctcggctctgcatagttgcacttggcttcacccgtgtgactttcgtaacggggagagagagaaaagatctcctcaggacctcggatgggccttactgtggcctctctttccttgaggggtgcaacaggccctgggcggtgggcagtgattgggtgtagggccaccagctgcctcacacacatcttttcgcaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtaggctggtggcaggtgatgggcctgccgtggggcaggctccctcgggcccccgtctcctgactccttccctcaccaggtgacaggccgctgcggctctgtgctggtacgcctcatccctgcacccaggggcactggcatcgtctccgcacctgtgcctaagaagctgctcatgatggctggtatcgatgactgctacacctcagcccg

SEQ ID NO: 18784 - DNA, 1070 bp, Homo sapiens
gccaccaccaccaccacaaaagcgtaagtgtgggtgagctgcctggtgtccaccgggggtggaggaacggtaccctccccttgggccactgtgaaggctgaagcctccacctcctctttaccttctgacccccagacccaggctgctgcctgccccacgggcgtacctagtccccgagaacttccgggagaggaaccttcagctcatccagtccatcagggacttcctgcagagcgacgaggcccgcttcagcgagttcaagagccactcaggggagttcagacaggtcaggcgggcccggggagtccagatgggtcaggcgggcccggggcggggtgccagcccgtcttcatccagggcccgggccagaggggatgactgagtccggctctccggtggcagggcctgatctccgcagcccagtattacaagagttgccgggacctgctgggggagaatttccagaaggtctttaatgagctgctggtcctgctgcccgacacggccaagcagcaggagctcctgtctgcacacacggacttctgcaaccgcgagaagcctctgagcaccaagtccaagaagaacaagaagagcgcgtggcaggccaccacccagcaggcgggcctggactgccgtgtgtgccccacctgccagcaggtgctcgcgcatggcgatgccagcagccaccaggcgctgcatgctgcccgggacgacgacttcccctccctgcaagccatcgccaggatcatcacgtagctcccgccagcgtggccagagctgtcgcaccgtgagcgtccttcctccttcctctccgggctgccaggcagccaggtaaggcctggtgaggccacttggcctcttggttggccaggcccaccaggaagtcaccaggacagtccacccgccctgttggcacactcaagcgggagtccacccctgcctcagtggtgggccagtctcggtttgcattcttgtgcttttgggaggtgccaggggagggaagggctgggatgctgggacctgttgttgctggcaaagccagaggtcacagtggcctgatctgggccctc

SEQ ID NO: 18785 - DNA, 1070 bp, Homo sapiens
ctgccagcgactatgcctacctgcgtgagcacttccgggagaagcactttctgtgtgaggaaggccgctgcagcacggagcagttcacccacgccttccgcaccgagatcgacctcaaggcccacaggacggcctgccacagtcgcagccgcgccgaggcacgccagaaccgccacatcgacctgcagttcagctacgcgccacggcactcgcgccggaacgagggtgagcaggcacctggcctggatgcccccaggtggggccgcatgaccatgccctgctctggagcctgagatgagaccgagctgtgggtgcaggagctgacctcccaccctccggccaggctggagcgcccgagcaccccttgtgtgccaggagctcttgctccctcagggtctcgggtctgctgccctgggtgcccggggcccttccctggaccaggaggcttttactgagcatctgctgtatgcagatcccacctggggctcggggaccctcctcctctcccttcccactgctcctgtggcttggcacccaggtcgtagaggcccgtggctggcgtggaccctgcgaggctcctgtgccactcccgggctcatgtgcactgtgggtaggaaagcctctgccatccaggcctgagcattggccgggtgtggccttgacggcaggcctgttcctcctattgtcgtcccggggtcccgggaagtgacgggctgtctgctggccgcaggggtcgttggtggcgaagactacgaggaggtggacaggtacagccgccagggccgagtggcccgggctggcactcgcggagcccagcagagccgccgaggaagctggaggtacaaaaggtgggggaccttgcgtgccgctgacattctcctgtggtgaccgtggccagtggccaagctgggagtggggatggggtcagggattgtggccagagttcctggggtcctgagtggcagtagggtctgttgagggtccttggtgggcacaagtttctctctcttttctccagttctagccacagccacagatcccagggttggggtgggtgaaaggggcctgtg

SEQ ID NO: 18786 - DNA, 1009 bp, Homo sapiens
ccagccaccaagtcccaccccaggcatctcccccaggcccccaagtcccctacccatagccatcttcccctggcctccatgtcccctacgtcccctactcccagcctggctgtgctggaaccatcaggcgggggagggtcttgctgtttggctccttagtggaccgtgcctgactccaccctggccactgtgctgcggggcgcagccttgtccagccccctcctcaccctcagggagggcgatgctggccatgccaggctgcactgctgtcccactgcccgctcctgaggtctgggcagccagtcctggtctccctgcctgtctgaggatgggcagcctcaggcccccactatcaggtggtatttctcactccggccccaaacctgcacgccctcctgctccagtgattgtggccttgggcccaccttgctcacagccattgttctttcacaagcctcttcctgttcctgagcccacccagtgtctcctttcccctgtctcgttgctccgcttaggtgccctgcctaggtgacccctcccagctgttcaggagggacgaatactctgggtcttgctacccctggtgctcggagtacctgccttagctgctgtgcagatggatgcccatctagactccatatggggcatgtagccctcccgtgctggcccaccctgggtccttcatctgggtgctgtcagtgcacctgggatccgcccggcctggccctgcctctgcccagctccccgcagctcctccacccccagctgctccctggcctcagagaggctgccttgaccgagtccgccagccccaccagtgccgtcccacataggtttcttgggacttgcgatgtgctagcatcgcatggagcatgggtgcccccaggcggcaaggacagaggagtgtatgtgctcctcagcggggcctggccctgtgcccgcacacgggtggcactcgggggacgcaccagtggaggttggctgcgtgttaggggtgcctgggatgccc

SEQ ID NO: 18787 - DNA, 1359 bp, Homo sapiens
gctgacggcggggcgttggggcttggaggccggaggcggccgagcgggttgcaggagggggcaagccctgtggggacagcctggggacttcccccgtgtcccgggggttcctgccgggcctcaggaagggtcctgatcagatggagaactcggtgacctgctcgtcttcaggagtttattttccagggtcctccattcgaggaaacaaggcaagggggactctgcggaggccatccgtcctggaagcagggcgtcaaactctgggcattctcagcccagctgtgtttctgggcccccattggatgaccctgagcaaactccttccgagactgacgttttcctctgtggagtggaggtgacactagcctcggaaggagacctgcccgtcggaggggaaggccccctcgcgcttcttggcgggaagggagaaaagtgttaggaagttgtcctcctcctcgccgccgccccccgcctttggcgctcatctccgcagtgaatgggagacgtttttgactgtacagacttggaagccgtggaggggtcagagggtaccatgcagcgttcctccaccctcactgcactgccagctgctggctgtgggcacctggctggagcccgttggtttgctgagcttagagatttgtttgcttccagcattgtgaaattcccccggtttgttcatagaaggcttcggctggtgacatctgccaggaatctaactttcttctccccagaagtgatgcagagcagtattgaggtgtaggttctttctttttttccttttctttctttaagtagacgtttacatcaaaggagttgaagagatgctgcaattctctgagcaatttgtgggcttatagtctgtgccctttttggaaaaagacatttggagattctatcagtctgtcatgtgacaggaggaggccgacccagaccccggggagatctggggtgcaggaacagtcacagaggaccttggcccgtggcttcctcagggcgcttcctggctttgccagggcctgccttgccagccagtcctgcatagcatgacctcactctccaacagctaggtttcccagcacacctgtagcttccttccggaaagaagacgctaaggagttcttggcacgtgaggtcccgacccaggctgcaggtctgatgcaagacatgagtgaacatctgcgtatgcttactgtggcagcctctgcccgctctcattccttgtaggccccacgccctccaggagctctgtggctgggggctgcggacatgagctgtcagccggggtgtggtttggcactgggtgcccccagccggcttcctctagggcctaccccgccttactgggctgaaggaggg

SEQ ID NO: 18788 - DNA, 1034 bp, Homo sapiens
aagcagacagatttctcgtccgcaggctgcccagcagctacgcttcgtgcgccagtggtccgtctttggcaagacattatgccgagctctgccagagctcctgggggtcaccttgggcctggtggtgctcggggtagcctacgcccagctggccatcctggtaggtgactgcgcggccggggagggcgtcttagctcagctcagctcagctgtacgccctcactggtgtcgccttccccgcagctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggaggtgggtacggcccagtgggggggagagggacacgccctgggctctgcccagggtgcagccggactgactgagcccctgtgccgcccccagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcgggg

SEQ ID NO: 18789 - DNA, 1089 bp, Homo sapiens
cttcctgcagccacacctgccgcagccatggctccagccgttgccaaagccctgctgtcactgtgggctggggccaggctgaccacagggcccccccgtccaccagagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtacgggcatccggtgcactggtctgtcttctgggctttagttttgcctttagtccagccagaccctaggggacatgtggacatgtgtagatacctttgtggctgctagaactggaggtaggtgctgctggcatcagtaggcagaggggagggacacaggtccgtgtcttgcagtgcacaggacgggcccatgacagacaactgtctgccccagaacatccccaggataaggctgagaagcccaggtctagccgtggccagcagggcagtgggagccatgttccctgggtctctggtggccgctcactcgaggcgggcatggggcagtaggggctggagcgtgtgactgatgctgtggcaggtctgaggagctctggccatggatggcccacgtgctgctgccctacgtccacgggaaccagtccagcccagagctggggcccccacggctgcggcaggtgcggctgcaggaaggtgagctggcagggcgtgccccaagacttaaatcgttcctcttgttgagagagcagcctttagcggagctctggcatcagccctgctccctagctgtgtgacctttgccctcttaacaccgccgtttccttctctgtatatgagagatggtaacgttgtctaattgatggctgctgggagggttccctggggtggcgccgaaccagagctcaggcgagctggccagcaggaaacactcctgttgggttttgatgaggccctggccccggcctggggctctgtgtgtttcagcactctacccagaccctcccggccccagggtccacacgtgctcggccgcaggaggcttcagcaccagcgattacgacg

SEQ ID NO: 18790 - DNA, 1038 bp, Homo sapiens
gcttcaagtacgagatcctcgtcaagacaggctggggccggggctcaggtgaggggcgcagcggggtggcagggcctcccctgctctcactggctgtgctggttgcaccctctgggagtgagtctcgtcgcaggcgtcagaacaaggcagtttttgcagtgctgtgtgaagggctcgtgtgttcatcctgggaatgacctcgtgagcactcactgtccctgaggactaggacagctcctagctggaagtaggtgccagtcagtcagggtgggcagcccacgttctgcacagtagcgtggccccacaagtgacgtgagcatcgctaccactgtgggagactgtgcatccacccgcgatcctgactgcatagctcgtctctcagacggaggcgccagcaccctccccgtggctgtttcttcagtacctccattttcctttcattggaattgcccttctggcattccctttttgttttcgtttttctttttttagagacggagtctcactctgttgcccaggctggagtgcaatggcatgatcttggctcacagcaacttccagctcccgggtttaagccattccccttaagcgattctcctgagtagctgggagtacaggtgcacaccaccacacccagttaatttttcaccatgtcagccaggcgaactcctgacctcaggtgatccgcctgcctcggcctgccagagtgctgggatgacaggtgtgagccaccacacctggctgtgttcccattttttatctctgtgctgctttcctcttcattgcccagttctttcttttgattacctacttttaaaaactgtcggccgggcgcggtggctcacacctgtaatccgagcactttgggaggccaggcaggcaaatcacggggtcaggagatcgagaccatcctggctaacggtgaaaccctgtctctaataaaaagtacaaaaaaattagcccggcgtagtggcaggcgcctgtagtcccagctccttgggagactgaggcaggagaatggcgtgaacccgggaggcg

SEQ ID NO: 18791 - DNA, 1099 bp, Homo sapiens
gtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcg

SEQ ID NO: 18792 - DNA, 1042 bp, Homo sapiens
ttcagaacgtgcctgcgtgagaaacggtagtttctttattagacgcggatgcaaactcgccaaacttgtggacaaaaatgtggacaagaagtcacacgctcactcctgtacgcgattgccggcaggggtgggggaagggatggggaggctttggttgtgtctgcagcagttgggaatgtggggcacccgagctcccactgcagaggcgactgtggagacagagagcacctgcaggtcatccatgcagtatcggcttgcatccagatcatacagggaacactatgattcaacaacagacagggaccccgtttaaacatggacaaggggtcactcacgcctggaatcccagcagtttgggaggccagggtgggtggatcgcttgagcccaggagtttgacaccagcctgggcaacagggtgagaccccggtctctaaaaaataaaagaacattggccgggcgtggtggtatgcatctgtggtcccagctattcaggagactgaggtgggacatcacttgagccgaggaggtcaaggctgcagtgagctgtgatcacaccactgcactccaggctgggtcacagagcaagaccctgtctcaaaaaaaaaaaaaaaaaaaaaaaaaaatcacaggatctgaacagagatttctccaaagaagacgcacagatggccaacagcgtgtgagaagatggtcggcctcattagtcatgagggaaacgtaaatcaaaaccactgtccagccgggcgcggtgcctcacgcctgtaatcccagcactttaggagagcagatggcttgaggccaggagtttgaggccagcctgggcaacatagcgagaccaataaatagatattagtggtggcgcctgtagtcccagctagttgggaggctgaggggggaggattccctgagtctatgaggttgagactgcagttagctgtgatggtgccactgcactccagcctgggcgactaggaaacggtctttaaaaaaaaaaaaaaaaaacagggtgggcgcggtggttcacgcctgtaatctcagcac

SEQ ID NO: 18793 - DNA, 1083 bp, Homo sapiens
gaagtctgattggctttgttcatccgtcactcaccgttaggcttcacggactctgcataagggaggagcttcgggtctgggtctgagagaccgtctccaaaagaaatgccacggtacgattggtggaaacaacgcggcagggagcggagcgtaccagcggcgggggaaggcgggcacttccgccaggatagcccaatgacagaggtgggacagtttctataaaagcttgagcctcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagtaaacctcaatccggagggcctagcggtaaggtgggcgctgtgtctattgaagtgcttagcaataaagaaaggtagtgagttgattcggttttctctcaagtgtctttattttcctattctggcaccccagaggtctggctgatccacaggcaatcttggaaaagggtacagacatgaaaacggaagctcgttaccagtgacttttcatctcttgggattgccttctccatttctgcccgtgattttttttttttttttttgagacggagttttgctcgtttcccaggcgggagtgcgatggcacaacctccacctcaagcgattttcctgcctgagcctcccaaatggctggaattacaggc

SEQ ID NO: 18794 - DNA, 1097 bp, Homo sapiens
ggcatggccggtggggtgccatttactgatgggagagcagaggcccaaggtcgcccagcccagggcaggctggactccaggcagggccggcctgggcgcaagggcttggggccctgctcaggcaggctccagcagagccgggtctccagcttccctgctgggaaaggaggccatgagggagtgggggaccaccactggccatccccagcttgccctatggccggccccaggaaagggctgggagcttggagccctggtcccagcactcatcctggctcagcgcgtagcctccctgggggccgccggagatggatggatgggcgtgtggaccagccgcgtgtgcggctgcgcacgtatagccgtgtcagtgtgtcagggcacctgtgcgggcacggacagggctctgcaggtcggcacgtggggtctgggcgtcctccctcctccctccacccccacagactgtaagccagagagtccccctccccttcctccagggggatgccgagaactgggactggcttctgggagattgttgggggcacctaggagtcccaggaggaccccctcccccgtacttcaccagcagcccatgactggctagctcctgtccactctgtgcagtaagagagagggggcaccggtgccttgcaggctggccccgagctgatttcaggtccgggggctcagaaagggagagcttgtgggcagaggcagcctcagctgagcctggagagcaggtgtagggattgagggaaggcaaggtaaaggtttccacctagtggccgcatgaccttggacacagacaactccagctcagtggacctcagtctcctcgtctgtaggatgggatgtcagcctcacggtggggtcctaagaccagtgagcctgggcacttgcagcccaggcattcagtaagtgctcagtaaatgccagcaatgaccgcagtcttggacggcccagggccaggggctggggaagtgggggcttcagctctggggaggttcctcctcccttctattgtggccattctggggaggtgtgggggcttccactctcacctgggtctctgcctgtcttgcctggcctctgggacagga

SEQ ID NO: 18795 - DNA, 1404 bp, Homo sapiens
gacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtccgtgcgccctggggcgggaggctggggggcgggcggcgggccccctccctgccctttgacccggtcccctgtgccccgcaggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagcc

SEQ ID NO: 18796 - DNA, 1077 bp, Homo sapiens
tactaaaaatacaaaaattagccgggcatggtaatgctcctgtaatcccagctactcaggaggctgaggcaggagaagtgcttgaacttgggaggcggaggttgcagtgagccaaggtcacgccactgtagtccagcctgggtggcagagacagactccatctcaaaaataaataaataaataatacaaaattagccaggatgtgtgtgcacgcctgtagtcccagctactcaggaggctgaggtgagaggatcacctgagcccagggattcaaggctgcagtgagtcgtgatcactagtgcactccagtatgggcgacagagaatatcctgtctctttaaaaacaaaacaaaacaaaaaaaaattagggccgggcgtgctggctcatgcctggaatcccagcacttggggaggccgagatgggtggatcacctgaggtcaggagttcgggaccagcctggccaacatgaggaaatcccatctctactaaaaatacaaaattagccgggtgtggtggcacacggttgtaatcccagctactcaagaggctgaggcaggagaatcacttgaactcgggaggcggaggttgcagtgagccaagatcccaccattgcactccagcctgggcgacagagcaagactccgtctcaaaaaataaaaataaaaaataagttgggaatcaccccactgcccctgaaagtgggatttcagtggcacgtcccattctctttagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaagtactgccagcgtttcattttgctgatgttacgtagaagttcctgttcctcatagcccagtggcccaaggcccagccacacacaaacacacat

SEQ ID NO: 18797 - DNA, 1054 bp, Homo sapiens
cttcattattatagagtcagtgctgtgaaatccctaatttgggctaacttaggctgagtttactgaagttaaacctcttaagtatgttctgaatacatagccacatgccggagttagtccccatgtgccttaaaggtagttgagaaaacaaaagagccctttaccccttagggcacagaaggggctgcgcttgggctcccagtatccccagctaccagacaattcttgaggtcggggtgcatgctcccctggggttcctgggtttgcacctctatttcctttcctctctccctggagcccacatcccacactgcctctcctcgcttcatgcacatggcgtgtgtttcagtgccatctacatgcagagccacctctctgagactgcttgtttccaaacacaaagtctttggcatctcctaaaatttccttcatgcagcttcccaccgcagccccacctctccgtcagtggaagttcacacctcaccacccccatcccatccatcaccaagctctggcaattttacttcccagctgtcccctgaatccttccgtttccctgccaaatcatttgatgttgattcaggcccctctcagtgctgcagagccctcctaagagaacttctcccacttctcttagccccagacccagcttcccttggttggaggagaaggaagcgcaaacgcggatactgcctgcatggtcctgcgaggaagccccaccctggccctggggccttctgtttgcctgtcactcgctctcgatgctaccttctctcaccagtgctttgggtccttcccagcacagggcccagcatagcccttctcttccacctagcagattccagcacattctttacttttcttttttttttcttgagacggagtctcagttgttgcccaggctagagtgccgtggcatgatgtcagctcactgcaacctcctcctcctgggttcaagagattgttttgcctcagcctcccgagtagctgcgattacaggcacacgccaccacgcccggctaatttttgtatttttagtagagatggggtttca

SEQ ID NO: 18798 - DNA, 1050 bp, Homo sapiens
acaattgtttatggatgacaaaaaggttttagggcagccatagttaaagacacaattgacgaaatttgttagctctgtggcacacaataatttaacataacaattataattattactgatcatgtacactaggatatattgcaattgtaggagttttacgtgattttgggacacatatcaataacatttatacaaatacagcccaaacaaagccaaacccaattttatatttggtagtgcttcctgtataatttttggtaccaaataagccaaatttcacttttacatcagtgtgctgttaatgttaaaacccaatcctttttttttttttttttgagacttttttctgctcttgttgcccaggctggagtacaatggtgcaatcttggctcactgcaacctccgcctcctgggttcaagcagttctcctgccttagcctcccgagtagctgggattacaggcaacctccactatatccagctaatttttgtatttttagtagagacatggtttcaccatgttggccaggttggtcttgaactccagacctcaggtgatccacccgccttggcctcccaaagcagctgggattacaggtgtgagccactgcgcccggcctaaacgtaattttaatgcttaatttacagaaaaactagatgatacccctttaactttagccagcatgtttacatacagaattttctttacaatcaacctcccacacctttttttgagacagagtcttgctctgtcgcccacgctggtgtgcagtggcatgattttggctcactgcaacttccacctcctgggttcaagcaattcttctgcttcagcctccccaagtagctgggattacaggctcccgccaccacacctggctaatttttgtgtttttagtagagatggggtttcaccatgttggccaggcctgtctcaaactgctgacttcaggtgatcctctcgcctcaacctcccaaagtgctgggattacaggcgtgagccaacgcgcccggcatggattccagttcttagtgggtgtgtgattaccg

SEQ ID NO: 18799 - DNA, 1041 bp, Homo sapiens
acctgcctcagtgtctgggcatctgtaacaaggaaccacagaccagcgcttagcacgaggagtgaatcccccatggctcaggggaggacccttcctgcttctcccatctcctggaggctccaggcatcctgagctcctggctgcacctactccccaccaccgcctccatcctcgcatggcagctcctgtctcctgtctcaaatctccttctgcatttctcttataaggacacttgctgttgggtttaaggcccacactaatccagtgtctcaccttaagatccttactaatcacatattcaaagaccctgtttctaagcaagatcacaaccccaggtccagggggacagaacttggacctgtcctgtggggcctcctcagcctcccacacacccctcggtgcttgtaacggtctctgtcctggtcaggaggcagcccaggattcacgcagagcctgtgcctctcaggcgggctgttgctgccctgggtctgccatgtcgctcatgggactgcattggattgttacgtgcctggcccctctctgagctgtggtgcctcgagaggcagctgtgacctactggccttcacatctccccatggaggggacattgttacaggcgccttgagcagcctggggaggggagtgggggccgggaacctggaaggggaggagggtgccccaggcctcggggcacagtgactccctcgccccacagacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactggtgagtggctccgggagcccaggacactggcgagatgctccccacgtctctgcttgggcccagcacaacctggggcagctccacctccttctccaccaggcagctcctgcaccagatggtctcccactgtacggcctcagcaccagccggcac

SEQ ID NO: 18800 - DNA, 1935 bp, Homo sapiens
acaggcacacgtcaccacacctggctaatttttgtgtttttagtagagacagggttttgccatgttggctgggttggtcttaaactcctgacctcaggtgatccgcccagctcagtcttccaaagtgctggaattgttcaggcatgagccaccgtgcccggccaggtgtttattttctaaatccaaaattttttatcagatctgctcagttttaagtaacatcctcaaaatctattttgctcttctgttttctaacttggtaagaggtgttttataattattttccaaattacactcaaacaccttccatctgtccaaaggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccaggtgagttccctggtactgccctgcagcctgtgtgggaaggggggtggtctatctttctgaccttctctcccagccctgggactggagaggacaagattaagcatggggatctttcctttcttggccagacttccagtaagggaggttgtctgttcctctaaccagaagacttctttgaactgtgacggttttatattcctcacttggtagaggcagaacgttcatctcagccaaccccacgcccatctggagtgtacttccccgggatgatggccccaaatggaggcaccggcctcttctttttgcctaaaccacttctagaaaccttttataaaccacaggccttaatgtgtatctttaagtcactgctgttttattcatcatcagcaactgactttgagacaggtcttctaccttattaattttaaaagaattgggataatttattaagttgccccttaatagcacttcatactattttagctttaatttcttcactttttaacaatatgattcattaaaagtcatattttaaattaatttttaactgtttgcagttgtatttcatgtaaatatttattgactaccctttaaagcataaattttgaatattattagatatcaacagccacatcttaaaaaaaaaaaaaagcaagagttttaatttaaaaagagccttgatataaatgattttcaatggactgaaaccaaaccaaaagtaaaatgggtcatttaaaaaaaaaaaaaaacccttccccgtgcgctggagtctcccgggtcattgtcggggagcgctagctcatggtgatctaggaatgactcgctaattgtttgcctttctatcccgtgcatcttaacctggctgatggatgatgttgggtttggatcagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcaggttagcagctcatgaactcttgaagttcatgagatgaacttaactctgggttcagtgtctgtgttcctttttcttactttatttgtatagagatagggtcttgctatgttgcccaggctggtctcgaactcctgggcttaagggatcctcctgcctcggcctcccaaagtgctgggtttacaagcatgagccaccacacccagcctctgtttc

SEQ ID NO: 18801 - DNA, 1031 bp, Homo sapiens
acagattttatctcatcaaacagaaaaattcttaacagaaaaaggaatcccaaaaatgactggtaatataattctggctgcctttatggtagtcagtgcagcggtaagtataccaccggtcggggcaactcaaaattatacttattgggcatatgttccttttccccttctaattcggtctgtctcctggagggactctccagtagaagtttacactaataatagtgcattcatgccgatccctaatgatgatcggtttccagctcaaccggaagaagaaggtatgcactttaatctgtcaattggctataaatatccaccattatgtattgggaagtcgcctggttgtttagcttattcttaacagaattggatgtggactgtaccgtcctttacaaatgattcttatcaagtatataatgtgttcagtactaactcttttcaacttctcactgtcaaacgtaccccacatgaggcatggagagttcctctcactaccaaaactaataaaacaaaaggactgccggactgtccaaagaaacctacaaatgggccttttatagtgacttcaattttatgggataattgtaatgctcccaaggctgttgtactccaaactctagccatgggtattgttattgattgggctccaaaaggacattattggcaagattgctccagcaaaaataccttatgctcggagtttatttattccttagattatatagagcatgggtggcagtcttacacgatgagacaacgggtgtctccttacccatttaaatggatggacacaggtattgctcctcctagaccaaaaattattcatcccttttttaccccagaacatcctgaactatggaaattagctgcagctttgtcgggaataaagatatggaacactacctatcagctccttcgtactaaaaccaaaacacccacattcaacatcacccttatttctgaatgggtgatacccattaggagctgtgtcaaacccccttacatgctgttggttggaaatataatta

SEQ ID NO: 18802 - DNA, 1033 bp, Homo sapiens
aagtacttctttaaaaaaaaacacataaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacctgggaggcggagcttgcagtgagccgagatcccgccactgcactccatcctgggcgacagagcgagactccgtctcaaaaaaaaaaaaaaaaaaaaaaaaaaaaaaaaaaaaacacataaaagatgcatcagacaaacacatcacttaataattataaagtaatgaatatataaagacacacttcctcaagtgcctgacgtctcagcccactctgcagagcgcccggagccgtaacaggagcccctccagtgcagcctctgcagagtgtccctgcaggactggagccactcagagacgtccgtgttcaggcactattggcacaacttcatcagattttaaaaatgcaggctgggcacggtggctcacgcctgtaatcccagtactttgggaggccaaggcgggcggatcacctacggttgggggttcgataccagcctgaccaacatggagaaaccccatctctactaaaaatacaaaattagcttggcatggtggcgcatgcctataatcccagctactcaggaggctgaggcaggagaatcgcttgaacccgggaggttgcagtgagtcgaaatcatgccattacactccagtctgggcaacaagagcaaaactccgtcttaaaaaaaaaaaaaaatgcagcctggccaacatggcaaaaccctgtctctgctaaaaatacaaaagttactcgagcatggtggtatgcacctgtagtcccagctactcgggaggctgaggcaggaggatcacctgcgccttggggggttgaggctacagtgagccgtgatcgtgctgc

SEQ ID NO: 18803 - DNA, 1041 bp, Homo sapiens
tctccccagggagcctctgcgcaagcagtttctgtctgaggagaacatggccacccacttctctcaactcagcctgcacaatgaccacccctactgcagcccccccatgaccttctccccagccctgcccccactcaggtaggttcctccactggccaggccttctgcagaatcacaggcggtcctcacagctgacctcaggccctgcctcatcgtgccatttttagctctagctgacctctgggttgtttcccatcttggctctttggaaagtgctgggaacccaggagcccctggggacctggacctggtgggaggtgctcagctaggccagcctcagctccatgccctgacagtcatttcctcttctaggagcccttgctctgagctgcttctctggcgctatcctggcagcctcatccctgaggccctccgtctgctgaggctgggggacacccccagtcccccctaccctgcaaccccagctggggacataatggagctctgagtgctggtggacagtgcccctcccaccttccttcttccccacaacagaagagaccagcgactcccgcaaagggacaaggttcctccctctcctgcagagtaggcatctgggcaccaagaccttccctcaacagaggacactgagcccaacggagttctgggatgggaggggtgggagcatgggaagggaggcatcccacccccaagaagaactgaataaagattgctgagcaaaggaaggcttcagtctggaacctggggcttttggggatggtggagagggcagaggcgcgggatgctggggtttctcctcaagatcttccctggaaaactgttagggccagccaggtccttgccggctgagttccaggcattgagaatgtgtgagtcagagcctcacccccgcccccgcggctggctgactcactccctccctccagctcaggggagtcagtcggggatcactgcctctccaaaccatttaaagttaaagattcttttattaataaattctccctcccctccaaactctcc

SEQ ID NO: 18804 - DNA, 1044 bp, Homo sapiens
gattacagacgttagccagagcgcccagtctaagccctttatagcttaattctatatattaaattttcccagttcaaattactgtgtgcttcccttctcctgattggaccttgcttgatacaaaattagtacaaggagtggtctcaagagatagatgcacaaagaagggatatggggacggatttgggtatttgggcttgagtgcagactgagctccttgacaatgagaaataggatatgtattagggttctccagaaacagaataacagaatctatatatacatgtgtatgtgtgtgtatatatatatatatagagagagagagagagagcttttatgtgtgtgtatatgtatatatataaacacacacacactaaggtattgcctcacatgattatggcagtcgagaagccccacaatctgctatctgcaagctggagacccaaggtcagtggtgcagcatttttttttcagatggggtctccctctgttgcccaggctggactgcagtggcacaatcacagctcactgcagccttgacttccccagctcaagcaagcttcccatctcagcctcctgaacagctgggactacaggtggacaccaccatacccagctaatttgttctatatatatatttttatatagagatggcctctccctgtatgtcctaggctgatctcgaactcccctgggctcaagctatccgcctgcctccgcctcctaacagttttgtaattttaaggcctgagagccaaaggccaatggtgtagattccaattcaagactcaaggcctgagaatcaggagcacaagaccaggagatcaatgtcccagtacccaggtctcaagtactcaggcacagagagaattcagccttcctctgccttgctgttctgtttaattccatacggatggatgatgcccacccgtggtgagggccgtctgctttactcactcagccaattcaaacgttaatctcttcttgagaagccctcacagacacacccagaaagaatgtttaagcagctgtctgggcatgcct

SEQ ID NO: 18805 - DNA, 1035 bp, Homo sapiens
agtaaaaaggagggaaacttggaaacacgaaagagcccttcccctttcaattcaaggtggagactggacctcagaagagggagtgggtgccccgagaactcacagctagcggacagtggaaagggcaggagccggaccaaggtgaggacagtggaactgaaggccgctggttacctctcctgccctccgctggccacagtggagaagacagcccctccctcctgctctgacctgacagtgttcatccatcgccctgtattagcgaagaacaacatcaagctggctagcaaggaactgtatacagggtccagctgggtatcacactggatctcacccaaagcttagatgtgatccagctcagtatcacaaagcagaacgaaaaggatgtgtttgggctgagaggccatacattggtaagtggcacatgaactgtattttctattgagcattgctggtatatggcaaatttgcataaaattatattgaaattgactaccggattgcactttcttgttccttctgataatttttcacgtgttctttttctttcttactttagatggagtcttgctctgtcgcccaggctggagtccagtggcgcgatctcggttcactgcaagctctgcctcccgagttcatgccattctcctgcctcagcctcctgagtagctgggactacaggcacctgccaccacggctggctaatttttttttttttttttttgaaatggagtcttgctctgttgcccaggctggagtgcagtggcgcgatctcagctcactgcaaactccgcctcccgagttcatgccattctcttgcctcagcctcccgagtagctgggactacaggagcccaccaccatgcccggctaattttttgtatttttagtagagacggggtttcaccatgttagccagcatggtctctatctcctgacctcgtgatccacctgcctcggcctcttttttatatttttagtagagatttcactgtgttaaccaggatggcctcgctctcctgacctcatgatctgc

SEQ ID NO: 18806 - DNA, 1064 bp, Homo sapiens
ggaggggactccctctggctgttgggttgaaagtagaccgtagaaggtccagagtggaagcaagaagaccagataggctatggcagtgatccaggcatgaggtgatggtggctcagtgtggagaagagggggtgacaagaagaggctggtgcgcttcagagcatcatgaccagatgttggaatgcacttgctgggacagctctagtcaaatcggtcctcatgaactggcccagatgggcagcaggtgtgtgtggtgagggttatttagtagccagccatcctgaactgctcttctcagatgtttactacttattcttaccttggtgtgttaactgctgtcatttagtttcctgtatctacaaggatgacaggagatataaacagatagagatgggctggctgaggaggtattcctgtatcagggagggaacaggcagatatatcgttacaaccagctcctctgtcccctgaatctttgctttccttgagtatcacctgttcactgtgtcctcttatgtggccaccctcaggaagtcccacaactgtcaaggcaggcaagccactacccttattgccagccacctctccaggaggaatgagtaggattgaggataattaacgagaaattaaataggcagctttagtaaataaccctataagtcattatcagtggagggaatgtcttttgtattatactaaaagttttcatgttttagacaaaaagccacagtgagatttcttcctagaaataacaatagccagttgtggcacggtttgagaaaccaggatgtaactttttttttttttttttttatactttaagctttaaggtacatgtgcacaaagtgcaggttagttacatatgtatacatgtgccatgttggtgtgctgcacccatgaactcgtcatttaacattaggtatatctccaaatgctatccctcccctctctccccaccccacaacaggcctccgtgtgtgatgttcccctacctgtgtccatgtgttctcactgttcagttacaacctatgagtgacaacatgtggtatttggttttttgtcct

SEQ ID NO: 18807 - DNA, 1021 bp, Homo sapiens
cttgctcttttgtccagactggtcttgaactcctggcttcaggcaatcctccggcgtagccaggaccacaggtgcatgctaccatgctcagtttttttttttttttttttttttttttttttttttgaggcggaatcttgctctgctgcccagcctggagtgcagtaatactatctcggctcactgcaacctctgcttcctgggttcaagcaattcttctgcctcagcctcccgagtagctgggattacaggcacgcaccaccacacccggctaatttttgtatttttagtagagacagggtttcaccatgttggtcacactggtctcaaactcgtgaccttgtgatccgcctgcctcggcctcccaaagtgctgggattacaggcgtgagccatcgcacccagcctattttttaagtttctcacagacacaaggtctccaagtcctgagcccaagcaatcttcccgcaaatgctgggattacaagtgtgagccaccgcaccccgccactcatttcttggaatctttgactttccattcgtattcatttcctgagactggtgaaactaccacaagtttggttgcttaaaataacagaaatggatcctctcaaaattccggagactggacgtctgaagtcagggagtcagtaggaccttgcgcctcctggaggctccgggcggttgggggatgctccttgccctccagtttctgcaggctgccagcaatccttggctttccttagttgtggctgcatcaccccagtctctgcctcttcttcttaagatctgtgcacctgcatttggggtcctcccagagagcagggaggatgtccttatctcaacagcctttactcacatctgcaagtccttttttgctacaaaaatcaacattcagaggttccagggctagggcacagctatcttttgagccacccctgggtcttgcccacttggaaggggctgtgctggccctccaaggacagccctgcacgtagcatctgtggtccccctgggggagga

SEQ ID NO: 18808 - DNA, 1064 bp, Homo sapiens
aggtgggaggattgcttgggtccaggaggttaaagctgcaataagccgtgattgcagcctccagcctgagtgacagagtgagactctcaaagaaatcctgaaaggaaagtcagcaccttcagtcactttgtgaccggcccagaggaactgcctttgactaaagcagaaactctttatgctttgagaattgactattctcctctaccttttaacagttattggaagtgcagctgaccagatagatcctgcaggatgagtgtccttcattgtctgtgcctcccatttctattcctgtaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggtacctccctcagtgtccaggcgtgtggcaggcccggccatgcagcaaggacaggatccgccttctagtgatgtctcgggtcccagggacgtactggccgtccgtaccaccaggataactctggctataatttagtgttacagtagcactcattcattatagaaaattttggaaaagcaggtaagcagaaaagaagaaaatttgaaatcaccccatcatccagcaataactactggtaacatcttagcatatggccacacagggttttggtatatgcaggtattaacatatctaaacatatcttatttttaatgtactcttttcatatttttaactgcgttttcccctcaaaatgccgacgaagcagtgctgtggctgctgctgtagccttgtggaaattttaaggctgaaaagttaggccaaagaggatcaggtaggggccctgagagacattgcatccaaagacagctgcctcaggacctgtcatcccagggtcacggcgtcattgcgggggtgtctgtctctgtggagaggtggacagactggcctcggtgggatctgagtattcccttttagggtgctggcttgctctgaaggtcatgccacataaatgaatgcaggcacgc

SEQ ID NO: 18809 - DNA, 1063 bp, Homo sapiens
actccagtattcctggtatccgtataagaagagggaaatctggacacagccaggactcacatagagaagagcttgccatgtgacaagagacagagcctggagggtctgcaaagcatgaaacaccaaggatgccggctactgccagaagctggggagaggtgcgggatggactctccctcggcacctccagtgggaagcaccgctgcccagaacctgggacctttttttttttttttttgagacagagtctcgctgtctcacccagcctgaagtgcagaagtgcggtagtgtgatcttggctcactacagcctcaacatcctgggctcaagtgatcttcccacctcagcctcacaagtagctgggactacaggtgcacaccactacacctggctagtttttgtgttttttgcagagatggagtctcactttcttgcccaggctggtcttaaacccctgggctcaagcgattctcctgccttggcctcccaaagtgctgggattacaggtgtgaggttgtgtgcctggctcagaactgtggacctttttgaaactgcctagtttgtggtgctgtgtttcagtagtcctaggaaacaaaatacacagtcacatcagtttctggtttatcctttttgtgtttcttttacacaaatggtgagaaacactgatatgctctgtgggcaggtgttggcacttggacacttccctcctgtgcccccagggctggctgtgctttggaaggaggcacagagacttcagcaccctggtttgatgtagactgttcgcgaactcctctaatgccaaataccatttaattccagaagaaatgtcccgggattttttttttttttttaactgtacgaataaagtgaacaatgcaattacatgggcccaaataactggatgtttacatggtttggaatttgaatactttctgaattgtggtagatgtttttaaggtatctgcatagagataaagacaggctagggttggccgggcatggtggctcacgcctgtaatcccagcactttgggaggcctaggtgggtggatcacctgaggtca

SEQ ID NO: 18810 - DNA, 1023 bp, Homo sapiens
gcttcttccagcagtgtaggcacttacgctctaccattttctttgttcaaatgcagaaaaaacctaacttgtaagacaaacaaaccaaagtgactgaaattctacattttcaatttatttcccttgtcatcctaattctctttagtctagttgtgtgattaataattggattgttgcctgagcaacatagtgagaccccatctctacaaaaaattaaaaaaacttaacagggcgtggtggtttgtacctgtagtcccagctactcagaaccggggtgagtttgagttcagccttggcaacataatgagaccctcatctccacaaaaaatcaaaaaattagccagtcctggtggtgcatgcctatagtcccagctacccaggaggatcacttgagcctaggaggttaaggctgcagtgagccatggtcacgccactgcactccagcctgggcaacagagcaagaccttgtctctgaaaaaacagaaggaaaagaaatgatagtggaatatgtagaaaaagacattgtagtgttctacgaaattaaattttctgttcattccgttattacatgtacttgagattttaaggggccatcatgtctttttgtttgaagaactagttacaaaataacattccagagaccctatagtttatactcaacagataaattttagttaataaaacatgttttcttattttaaaacaaggacaatttcaaaggatcagtttgaaaagaagaaaaatgataccttagaccccgaaccgtaagtatatagctatttcttttttactttcagttttggtttgaaatcggtaaagttactccttatggagtgggttgtgggtaaaaacattggaaatatgttgccgtaagtggaatttctggtgtgaggttatcttttagatatagatttcttttaaacttaaacaaaatatgtatgtctctgtaacatgtactctagttactggattttaacaatgataagattaaatggatgttttagttctatgagaacctctcta

SEQ ID NO: 18811 - DNA, 1020 bp, Homo sapiens
caattaactgaatgattaacatgaaaaaaaaaaaaacaggaaaaaattaaaatcagttctgggtgctcagcattttcatacatttaaagatctggcttaataccggaaataaaatctctgaattgctgtcaagcataaattttccattttgaaaaataaagctatttcagtttaaattgcttttttaaggccttttgtcagactgttttgttcaagtaaatttttccatctcaaaccctggagttatatttgactttctctgagtaagaacaaaattcagattcctaaatttgggctccatgcaattctagtattaacaactccttgaaaacatttgcctcttggagccggaccgagcctgtcgttgttagtgatgatggcctgtgatgtgtgcaatgagaccgaatgctaatcaatgctttgccttggctttctgctctgtgttgtcttggtgtctgcgtcttacctctgtgtctgtgctatttgttcccttccctgttctctaatcctgcctttccccacctgccccctgttcctttcattgtcctcactgacccatcaatcaaccaacaacgcccccccttcgtcgtggtgctctgccctgctctgattggtggcttcgttgcttgggtggctgtgtgttatgatggaccagttcacccaagtatggccttcttgctgacaggtatcatttctgtgagaagtgtttcacagagatccagggcgagaatgtgaccctgggtgacgacccttcacagccccagacgtaagtaccgtcctgtcattttctctggggtgagggagggtgaccttaaattgttttttcctcttaccaatgactataaggaaggtaccggtgccattttgacttccttgcaatgttttttggttttttgtttttgagacaggttctcattctgtcacctgggtggtgtgcagtggcactatctcgactcactgcagccttgaccacttgggttcaagcgatcctcctttctcagcctctcaagtagctgggat

SEQ ID NO: 18812 - DNA, 1722 bp, Homo sapiens
attgttaagggtacttatggatgtatatatttatggtcaataacttttattcttatttttatttatttattttatagtccccagggaagaagcaacttaaaaaaaaaatacctttttctaagctaagcttagaaaatgttaaagaacattgggtacatgttatagaacatgaagcttataggctgggtcaatgtacagtagctcccccaatctgtcatttcactttctgaggtttcagttacctggggtcaactgtggtccaaaaatattaaatgggaaattctgggaataaacaattcataaattttaaattaattagctaggcatggtattgcacgcctgtaatcccagctactgaggaggctgaggcaggagaatcactggaacccgggagatggaggttgcagtgagccaagatcatgccattgcactccagactgggtgacagagcgagactctgtctttttttttttaaaaaaaaaaaaaaaaagttttaaattgagtgccattccaagttgcatgatgaattctgtcaccatcccactctgtgcccccagggatgtgaatcatttatttgtccagcatttccacactgtagacactacccacctcttagtcactgagtgtccaccttggttgtcagatccaaaaatcttggtaaatattgggttcagtactatccgcagtttcaggcgttccaagactgggggtcttggaatgtatccgagtggatatgaggggactgctgtagatgtgtgtgtttaagccataagtttcaatggttgttttaattatataaatcagactataagaaacgtgtgtagttttaccgttattgaggagtgcccattacaagtgtatagctcgatgaattttcacaagcagaacactcccaagaaaatgtgattaaattcccatacatttggctgggcgcggtggctcacgcctgtaatcccagcactttggaaggccgaggcgggaggatcacttgaggtcaggagtttgagaccagcctggacaacatggcaaaacccgatctctactaaaaacagaaaaattagctgggcgtggtgacgggcacctgtaatccctgctactcgagaagctgagacaggagaattgcttgaacccaggaggcggaggctgcagtgagccgagatcgcaccattgcattgcagcctgggcgacaagagtgaaactgtctcaaaaaaaaaaatttttttttcatacatttaatttttcaaatgtttcatcacattttcaaacgggggaaataattttaccatactctgtccatttctggtagggacaggtgcctggtgctgctcttcctaaccctctcaacatgctggggcctcaggccagccagctaccttgccctccagtgacacagtcaccactgcacccaacaccgcctcctgcttccacggctgctggcatgccatctctccagcacacgacaccacctgggatgactcctccccagccagcagctcccactcagccatcaactcctgtgtcgtcttccgggcagactcccaccccgactcctggctcagtgcccagtgctacccaaacccagagcacccctacagtccaggcagcagcccaggcccaggtgaccccgcagcctcaaaccccagttcagcccccgtctgtggctacccctcagtcatcgcagcaacagccgacgcctgtgcacgcccagcctcctggcacacc

SEQ ID NO: 18813 - DNA, 1067 bp, Homo sapiens
attatagactccctggaaagtcttcctggtctgcatcggcactccgttatttgagggtaccatttctaggtagccattgaaggtagtgctccgtgagtcatcctttgagccttctcatgactacagcagcgctaaggcagcaccttccagaaattctctaaagggttctgtcagattctagtgttggtcctaagactaatttgaactggtgcttctttagaactcagagtttacagagtattattggaaattggaaggaactagacaccgcagtctggagacacttactggctgtgaagtgtctttcagtgatgtggtgttcctgtaaactacaggaggctaaggttgaggacggctgacccttgggcacttcttaatgcttaaggtgcttgcaaaattaaaagaacatttggagacttagcacagattctaacaatgaatgtaaacccagcaaggagctgggaatcctcggatgatgggcgtcagctgctccagaggcattaggtatgggtgtgcacagaagcttgccctggtctctggaaacatctcttctgtagcttgtgagggtgctgtcctttcagggcacctcctcaccctctttgttgctatgacactttggtactgtgccctctggctcagctctaccacagcctcgtttaatgtctcacttgttcctgtcttacccaaccttatgccttcatgtcctcgtccttccctggtacccctcaccatgccaccgtcaccacccccacattgatgccgttttctctggatatggagaagtctgttccttcatcatcttcattgattaattgggtgatttcttttcagttttctgttgcctgtgcgttccatcttattttacttaagagtttatttagcaagttgtaattctgttttcctgtgggtgcttttcctaatgaaccgttgtgggtacatttacagggatgaattcatttaaccccatgtccttggggaacgtccagttgccacaagcacccatgggacctcgtgcagcctccccaatgaaccactctgtccagatgaacagcatgggctcagtgcca

SEQ ID NO: 18814 - DNA, 1027 bp, Homo sapiens
cattccagcaggaggaataacaacagatcagcagcccccaaacttgatttcagaatcagctcttccgacttccctgggggccacaaagtaagaccctgtttcagatctgagtgacagtccaacaggagcatggactgagaaccacacaaaactgattctttctaaatgtgtggcagagaaaatagtttaaatggggtggtgaggggtgaatgctgttttcctttttttctttaattataaatgtagagcagataatagattaaaacatagtttaagttttatttatttacatcacttggctctcctgacttaaacttttaaaagtcacatgtggtggcagaagaaccttactagacaaagtgtgtttgagtcacttcagtagatggatgaagtgtctttatttcctccttagcccactgatgaacgatggctccaactctggtaacattggaaccctcagcactataccaacagcagctcctccttctagcaccggtgtaaggaaaggctggcacgaacatgtcactcaggacctgcggagccatctagtgcataaactgtacgtaacagttttgcagtttcatagatgtttgattttattcctgtgttgcccattggctaccagatgacagtaccctaggagcctatacaagtcacgtgcttatttagggagccactctcactgctggtagagttctggcagccctaggcaggccagagattcccacactctatgtcctcggtgagcgggggtgacaaagagagcattggtggctctgtactgccgaggggcactgacttgcagcccctatcaccgaggcaaagaccctcagtgcagcccggccttaatgtgcttctgcactttaggctgcgtgagggggctggggttagctcaagagcctcaccttattttgtagttccagattctagttgtggagacccctcagaattggaaaagtttagagtatagatggcatgtcattatcaccttacagttagttaacataacggaaagttaacagttaac

SEQ ID NO: 18815 - DNA, 1090 bp, Homo sapiens
gaaaaataaactatcctaccactgttaactttgatttctataccatagtgcttcttaaaaatgtaggatgtcggtttcagaagtatggtggacacatgtttaaagttttggggagtagtaagtattagaatacttttaaaggtattgtgcgtgacttacttcagctacacacttgtcataaagtgcaccttgggagttgcttttcatttatgttaatgagtgcttggtgtatgtagttgtgtctgatgagtgttaatgagttgatctgaatatcattattagaaaagttaatagtatggaaagtataattaccaggaattttttttcacacattttagtttaattaagttgctctggtaggtattgggtttattataggtgtgctgatggttgaatgtgagaatattactgttacacatagtggttgggatttgaaagaaaggctttgtggtcgtgttttatgtatcaaaaatggtgtgttatagcaacaacactataagatgctatttttaacatgactctaaaatttgtggaagttagaaaggaactcaaaaataggaataaatggtatcatatagaacttctgccatatgataaattttcacacaacagcatttgggttgttgcgacagatgagggggcaggcaaacaggtaacaggtgggtaggtaggtgggtagatgaattgaccttgaaatgtccaagttgatgcaagtttggagttgtctctccattaccttggaagccctttgggatggagctccttatgttgacaccagtttttcctttagtctcctggggttagctagctggatggggcagcttccctgccagccagcagtgggcctcagtagcagaagctgactttggccacgtgaggcagagccacctcctgaatatcagaggtgctgaggtagcccctggataataagacccatgcagaattgcgaagcctcactccaaccttaatttcaaacagctcagtcagtcaatcaatcaagtacagtatttcttgaacagcttcatgtagccggagagctcagcatggtgctctgctgcataggaatcccatcagaaggatatgtccatgc

SEQ ID NO: 18816 - DNA, 1034 bp, Homo sapiens
agtgtcacttggcttctgaagaaagccttttgcttgagggcttgtggccgtgcctgataggaggctgagtctccagcctggcagtgcctgggttcccctcagtgcttctcttcactgtggtgccccacgcagtgcataggaaggtgccaggtaggaagtaggtcctggcccacacaatgcccgcaaggtacggtggtgccaccagcaactttgtagagatggctgcaggtctgaataaattcttttttttttttttttgagacgaagtctcactctgtcgcccaggctagagtgcagtggcgcgatcttagttcaccgcaacctccgtctccctagttcaagtgattcctgcctcagcctcccgagtagctgggattacaggcacatgccaccatgcctggctactttatgtatttttagcagagatggggtttcaccatgttgtccaggctggtcttgaactcctgacctcaggtgatctccccaccctcatactcccaaagtgctgggattacaggcgtgagccacctgaataaattctagcattgcttttttagtagaaatctaagtgtcttggtatccttgggaatttggttccaggacaccccaggtataccaaaaccaggtggactcaagccctacagctggccttccccatacacaagtttcgcctcccgcaagcactgtgtttctggcctgcgttgggtgaccccgtggctcactctcgtgctggtgaagcatcagctgtagcaactactgctctgcttcatggtctgtctccccctaccctcacaaagtttggagatttgattcatgtccgttttcactgaatttccaaatggagttcagttttattgaggatgattaggggcttaagttgtctgagtaactgagttctttgcatcagcaacatagactgtacagaaaacctcttagtggaacattccttttttcttttgttttttgagacagagtctctctgttgcccaggctggagtgtagtggcgcgatctcagctcactgcaacttctacc

SEQ ID NO: 18817 - DNA, 2130 bp, Homo sapiens
gtgccccgtatttgttcttttcctccttcctctgtcacggaagacattggtcacttcttgagcactgtctttgttgtgaatgtctagattgtggttttcttttggggcaatgaacatagcacaggcacgtgcaggcacacgcccttcctgcatcccaacatctgtcttggtggcctgcggccttgctcctctgtcctgtgtcttgaggcaagtgcggatgacagcgaagttgtcctgggtgactggcagtgacatggggaactatgcactgtatcatcccagggggggtggtgaactaggcacttcacgtgccctctgtctccccttttaccgcagacacctcatttctaccgaaggaagtgtttcttattaacagctgtactttcctttaatctttattctctttccttctctgcttatgctcataaacttaggggaatctccccctggtctccccgtctcccgttgtgacatttgtgagtccccagagtaaccctgttgtaacagagaagcagagaagggtaaggttagacctttagaagatgaagacggaataaccagggtcagttagcctctcgagtacttcttcaccaagtgcccagagtccctttcagaatctctacagacttctcatttgcttctctatctgtatttcttcactgtagtatttaggtggtttcatcttgaaacataattgaacatttttattttaaatagtgacatcacagaactattatttgttctacctttcattgcagttgttcgctattccaggttgaatagtttttgttttgttttgtgggctgccctttatcacccatccttcataacattgcttctaggggaagttttgtttggatttctcaacagtcaacttacaaactttttggaaaacagcctgtttgtaagttgaggactgcctatactgtgttatggttacacttgttaccattttcttatggaatctggcattataatttaggtataattgaaagtgtgacgatttggatagaaaaataacatctcgttgtttttctggtcatagttgcccattgtgcatcttcacgacaaatcatctctcattggaagaactgcacacgacatgactgtcctgtttgcctccctttgaaaaatgccagtgacaagcgaaaccaacaaagtaagtgagcacgggggcagagaagcttggagatgagaatagaagttgtttctaaagaaaattcagagagtaggtagggagtgggcaggggttatgagccatggagtgcagggtgaggtagggcggacagcagcccaaggtacagccaagctcagagggcaggcgggctctccgtgtcaggaacggctgtgataatgttggaccctgactcactcactgcctctccctctccctgccccctgcatacatgcacttgaagcagcatggaacagcagagtcactttgttcactgagccaacacgaagacatggtatttcctgacagttactccatacgtgagaatttaaattccatgtcgctataatggcagtgacgtcttagggagggggatagaggggatacttcttttggaattggaaagcccttatcctgaagtaaattttgaaggctctgtcagtcagtctgggtcagtataaaatcccacacagacatttatgaaggtttccctctacgtggagctatggtccccagaactctttgtataactaaacgttcactctgcttcacagtgagagcctctgccctagggctgctgcatcctgatcaccccagtcgttttgccgttgtctaggttgtctgtagccctcggcacggctggttacgcagcgatccctgcttgttgggaggtccgcctggggctctggggctccctgccatttgtaggcttcaggcagtaagaaggatgaacctccctcccgtttttcaaccatcttcctgtcattttagaggtaaaactgtggtctttgggtgtgtcattcagtttcggacagctaggaagtgcccttcagtctcctgtcccctctggctggagctgtacccttagcgacccttccagcacagcacagtcttcctcatcttcctccatctcgtctgtgccatcttgccaccctcccctgttttgtgtattacgt

SEQ ID NO: 18818 - DNA, 1030 bp, Homo sapiens
cctggcctcaagcaatcctcgtgcctgggaggatcttaacccaagaagacaaggaatgcttcttgaaagacattatccaaatgaaatacagtgagagttgctaaatactttgttactagtcttccagttaggacttatccttccagggcaaatgttcagacctgggggccgcacattttcctgaatgcattccaggttggcagcacataagacttcaattgagggggaaggtgggctgttcacctgcccaggtgctttagcccaactctcctgccccaggtgcaccctggacagccaagtgctgtctgtggcactgtaatcagtggcgtatttctccttactctatatttaccaagttgatatactggaaggattccaagagcaagcgagtgatagcagacaactgaatgcagtcatgtctttccatgaaaactgcttttcttggctttcttccaacaatggtaggttgccaagagaaaatgcttttggctttacaaatgatctggccgtagtctggggtggttctggttctttatgtcattgaaaatgataaatatttctggctattcaattatttagcaaacttttgctcttgatgtactgaactgtgttgtttttttacaccttatatgaatttgtggttttacatgtataccaacttgtggagaaagatgctaaaaaaactccagcttgaaaaatatgtcaggttaggctgaagccacatcaaatggaagtttgttgctgtgtcgtggctggcttatgagtggtagttgcatccatttcttttttcgtgggagtgttctttcatgttcagttcttctatgttttggtttaaattttaacccaagaatgttaggctagggtattttaatcatatgtcattattgcttatgatttaagtttgaaataaacaccctgagtttattgttcttaaagctaaaaaacaatgtagaatgaaaactggaaacgcttatgatttaccaggacaattagaaaataatggccttttcagagtatttctacaaatagc

SEQ ID NO: 18819 - DNA, 1033 bp, Homo sapiens
cctaagctgcagtccagtggcgcagtctgggctccctgcaacctctgccccccaccccgggtgaggtgatcctcccacctcagcctcctgagtagctggaaccacaggcacacactaccacgtctggctatttttttgtatttttagtagagacagggtttcaccatgtttcccaggctggtctcaaactcctgagctcaagcgatctgcccacctcgacctcccaaagtgctgggattacaggcatgagtcaccacacccagcccactcttaactttgtctcttaagtatgtctcttgtaagcagcgtagcattagatcttatttaatttattctgataaccttagtcttttaattgtagtgtttagtttatttatatttaatgttgataattgttgggtttaggtttctcatcttatttgttttctgtttgctgcttctgtgttttgttcctttttttctcccttcctgctcttcttgtagaggcaaattccaacatctctgtcatctctgtatctgtttcatttacagtcttgtttgtttaaatatagaattcctggttatgggtcacatcttcctgctccttggcatgtccagtacttttagactgtgtagtggaaatggtggatgataatgttgttgaatatgggttttattgtcctttattagtttgttttgttctggcaggctcttaattactcagatcagtttgattctctcaaagcttgtttttaaacttaacttagggcaggtcttgaagccctgttccttagacatggccttggggtctcagtttaattcctgggatgttcagcaagatcttgaaactccgactgatcagaacttctatgtctctagcactgtgccacctctggaatctgttcaattcacaattccttcgtagtcctgcacacttagttacagctccagtaagccctaggaggtgttggtgatgtgattgttgtgtgtggtcgcactgggagatactctccattttaatggtgtgaacgtaacattatgatatataatggtt

SEQ ID NO: 18820 - DNA, 1022 bp, Homo sapiens
actgcaacctccacctctggggctcaagcgattctcgtgcctcagcctcctgagtaactgggactacaggcttgcgccaccacacccagctaattttgtatttttagtagatacggggtttcaccatgttggtcaggctggtctcgaactcctcacctcaggtggtccgcccatctcagcctcccaaagtgctgggattataggtgtgagccaccgtgcctggccagcacaatgtttaataaaaccaatgacagtgttcttcccttgtcttattcatgatctgtgggaaaaaagcattcagcctttcgttaagtataatgttagttgtaggctttaggtatcattcattaggatgaggaattctgtttctagtttgctgagtcttttgatcataagcgattactgaattttgccacatcttttttcatttattgagatgaatcatagggtgttttttttttctttgaatgtgaattacgtctttctgagtgttgaaccagccttgcattcctgtgagataaccccacttgattgtggagtgttatcttttttatatgttactggatcagatttattaaaatattgttcaggatttatgcttccacagtaatgtgctacataacgaattttggtcagcagcagactacatatacaacagtggccccttaagactataatatatttttactgtgccttttctatgtttagatacacaaatacttacaattttgttacagttgcctccagtattcagcacagtaacaagctgtacaggtttgtagcctggaagcagtgggctataccatacagcctaggtgtgtagtaggctacaccatctaggtttgtttaagtacacccaaagtgtaagttcccacagtgaccagaatcacctaatgacacttttctcagaagatgtccttgtctttgggcgaagcatgattggtatattcatgagtgatatgggtctataactttctgtttttttggagtgttcttatttgtttttgataacaataatatac

SEQ ID NO: 18821 - DNA, 1026 bp, Homo sapiens
gatgggggtgaaatgcatcattaagtgattatgttatgctaggaacatcatagagtagttatgcaaacctagatggcatagcctgttacacacctaggctatatagtgtaccctgttgctcctggactataaatctgtacatcatgttactgtaatgcatacttgggcagttgtaacacggtgccacaatgctaagtgtttataaacctaaacatttctatacatagaaatggtatagtagaaaatactgtataaaagatttaaaatagtacacctgaccagacactcagtcccatgcctgcaatcccagcactttaggagggtgaggccggaggatcacttgagcctgtgagttggagaacagcctgggcagcatagatcctggtgtgtgtggcaggggtgggcgggtgtgtgtgtaaaacacacctgtataaggcatttactatgaatggtgtttgcaggactggaagttgctgtggatgagtgaatgagtggtgagtgaatgtgacagctgagaacgttgctgtacactgctatagactttataaacactatatacttaggccatgctaaatttatttatttttaaatttcagtaataaattagcttactgtaacttttcactttataaacttcagttttttaaaaacttttttattcttttgtattaacacttagcttaaaacactaaacacattgtacaggtgtacaaacgtatttgtacttattctataagctttttctattttaaaattttttattatttatttatttattattattattattttttttgagacagtcttgctgtgtatcccaggctggagtgcagtggtgcaatctctgctcactgcaacctccgcctcccgggttcaagcaattctcctgcctcagcctcccgagtagctgggactacaggtgcatgccgccacgcccacctgattttctgtatttcagtagagacgaggttttaccatgttgcccaggctggtcgtaaactcttgagctcaggcagtctgcccgcc

SEQ ID NO: 18822 - DNA, 1426 bp, Homo sapiens
cgacagagcaagcctgcctaccgtagtgaggcccttcccaccgtatggaacttgtacctaccctggggctcctgccatcttggagcttttcccttgaagttccccacagcagagcagccatctctgcctgcctgtcttgctgtcttctgtccctgcctctttggagttgtcagtgtccttttcctctaaacttctgctcagagcctcttatttgaagcctttcctacttttgttcactgccttattccacttggctgtaaaatatgacatacgtgttaatttaagtttgtggcttggtgtccattggctgtcttcctcaattagagtacagtcctctggggaggccgacttctattctatctcaaacccagccggtcctgcaccgagtgagggcccctgagcagtgactcgcttccttctcctggggaggagagggtgggggctgccggccgagctctctggctcttcagcagatcagtgattctgaggaggggcaagacttactcaagataagatcactgttcagaatgaagtacaacctcattgttctgttctaattagggattggtgtgtctgcataaaagaagcctgaattacggaagattttagaaggaggttgctttaattatttcctaatagtcattgtaaaaaaaaaaaaaaaagttagatgtcttttgggaacttgtttaaatgcctagataaaaattacttacgatggcataaatattaataaaacagcttttctctttcttttttttttttttttttggtatagagagttgttccattatatttatttgcataatccccaagaactttcaaagcaaagtaacctttaattctactagaattgccacagatcagcagggatgagtttattagcaagtcactaccattgataagtggcggctgttgagcgcctgctctgtaccaaccctggagtgccaggttcttaaaggctttggctggttcagccctcataggtgccttgggagatgggattgggacagtgatagtaatgactaatattttttgagtccttactgcatgccaagctcagtgctaaatgctgtatggtttaattctttcatcaacgatcctgcgaagcaggtgctactgtcctttattttattttatttatttatttttttgggacagagttttgcccttgttgcccaggctggagtgcaatggcgcgatctcggctcactgcaacctcccagtgattctcctgcctcagcttcccgagtagctggggttataggcacctgccaccacgcccagctaattttttgtaattttcagtatttttagtagagacagggtttcaccatgttggctaggctggtttcgaactcctgaccataggtgacccacctgtctgcctcccaaagtgctgggattacaggcatgagccactgcaccc

SEQ ID NO: 18823 - DNA, 1330 bp, Homo sapiens
taatcccagctattcaggaggctgtggcaggaggatcgcttgagcccaggaggtcgaggctgcagtgagctgtgatcatgccactgcactctggcctgggtgacagagtgagaccctgtctctgggggaaaaaggaaaagaaaaactacattctgaagattgaacatagctgtgtttcatcctgtgctgtataagtggctctaagcagttgtgattacattttatgacgtgaatccttttaaatgcaatagggaagcttatttaaagaaagctggtggcgaatatggttgtcaaccaaatggtctgttatgtatgtctggtactttatgtatcagagtgcttttctccacgtcacctcagtttgatccttacagcgtcctgtgaggaagggaagatgctgttactgctattttctaggtgaggaactggacttgagaggtgatacagggtcaaaaccagatccaaactagattgttaaagtccgtagctctatatatttattttctaagtctctatctgtaaacaatgcatttacttgaatcgacccaggaacctgccaagcttagtgagtttcagtagcggccttcccgcacatgaatgagatcactaagggggaggtttgtaaccacctgtggtgggggcagccaggagtgtattcttcctcctgggttagggcgtcccccttttccctctggttctggtgttatcctcagcgtgacgtgtgtgggctcgtgttcctgtttacctcagggagaatgagaaacggttatgttaccccatcagtgagttctggctaagtaggaataaaagttgtcatagagacttttaggactaggacatttcatgaccgtgcttcgtttttgaataactgagaggggtgagagcggtggccccattcaaaggtcgtcagggatgaaggtaggcaaggacaagtcatgtgcagggcgccttagagggccttcagaagatggaaagtcgctcctggctgaacattcagatttgattctgtaaacagaattgaacataacttacaaagagactgagtcctgcagttggaagttgatgcttagattagtcgcctgtgttttcacagcttctaagtagtgtgttgtaattgtgtggcaaagtatgtgattacctggggggtccataattgctgacttgtgtttttacttgatgtatttgaaaacagttaggaaaatgattttgccaaagtgtgtcttaccttagttaagatgaaatgtaccttattgtgagtttctgaagattgcaaaagcttgtcagtttagtttttggggtcccattagtgagggcacccctctttacctta

SEQ ID NO: 18824 - DNA, 1072 bp, Homo sapiens
caatctcagctcactgcaacgtctgcctctgggttcaagcagttctcctgcctcagcttcctgagtagctgggatcacagacacccgtcaccacgcctggctaatttttgtatgtttagtagagatgtggtttcaccatgttggccaggctggtctcgaactcctgatctcaagtgatccacttgcctcagccgcccaaattgctgggattacaggcatgagccactgctcctggccttctctgttcttttatctcatttttggctttgtttagtttggttgcatttttacattttcattttgttcctgtgttagtttgagagctattctggttttttaccatttttagcaattattctaaaaattacaataagcggctgggcgtggtggctcacacctataattctagcactttaggaggccgagacgggcagatcacttgaggtcaggagttcaagaccagcccggccaacatggtgaagccctgtctctactaaaaatataaaaattagtcgggcatggtggcacatgcttgtaatcccagctacttgggaggctgaggtgggaggatcatttgaacccaggaggcagaatttgaagtgagccaagatcgtgccactgtgggcaacagagtgagacatttttatcccttttcattccttcctctatccccaacctcctctctgggacaatttttccttctgcctgaagaacaccctagacttctctttactgaagaacttttccactgagtaaaattctagtttggcaagtttgctgttgttgtgttgtttagttttctttccaacagattgaagagattattctactacttctagcttccattgttgctgttgaaaagtgagcaaaagttgcacttttttttcttttttcttttttctttttttttttttttttgagacagagtcttgctctgtcccccaggctggagtgcggtggcacaatctgggctcacaccacctcctgggttcaggtgattctcctgccccagcctcctgagcactaggattacaggcacgcgccaccatgcctggctaattttttttttttt

SEQ ID NO: 18825 - DNA, 1050 bp, Homo sapiens
gtggggattgtggtcacatgaagctctttctgcatcagtattaaggtgtatatttgaatgtcctcccctcccctttcccctccaggctgtgtagctttgaggggctgggcgtttgctcacgaccttgctgtctcgctcagaacatgctccgcaaagttctccgcacacacttcttccccatcaagcccatttccttccccaaccacaaaggtgtttgtgattcctcaccccgggaaaccaaggagctgcaaagtggagtctggttcagccccgtgcagactcacccagagcttaacgttgtctttcaaacaccctgagccttcctaaacagccagtgcagacgttctctctgggccacgaagcccctcgggtcctccccgtcccctgctccgatgcatacctcagtgcagaaccacagaatctctgcagcggaaacgccgtgcatctcttgtctgttggcagcgagcacatcgtgctggagacacgagtttctaagcagctggcacgagggctgctgacggcatgggtcgtgcttcagggtggcaatacctcttaggaacttagggcaggaagcaatacttcagcattgaatgtgtgtaaatagttgctttgagttgcaattgctattttcttctcagtcccagctcagatcgaattatatatccatatatatatatatatatatatatatatatatatatatatatatatggtaaacaagcacacacaattttatccaatgcaaacaaatgtagagcatcagttacaaaaccctcgaatagcttgagagccccacaggctctgccacacccgtgacttcatccacactgacgtcacccgcgggggctccccctgcacatttgcacacgatccggagagccgaaggccgcgtgcttcctgtcacatgggctgtaatcatttgtagtttccaaagacacgtctgcatttgaatttctagattttcgaggtaaggagttttttttaattggttgtttggaaaatcacatcatgcctagaatctgaaattgaattagcaagaaccgactgttt

SEQ ID NO: 18826 - DNA, 1034 bp, Homo sapiens
tttatctacttgttttctatgtgtcaagtcattatgagtaggctcagttggcccaatttgaggaagtaaggggcttttcattcgttatagaaattgaaaaaatgatttcatattttatagacacatacatatataaatatatatagcttagaaattaaataggtatttattataagtggtagtctgaattgatagtggtgatgcttgcacatccctgtgaatatgctataaaccctggagttatatactttaaatgggtgcattatatgctttgcaaatgacatcttaagaaagctgttgtaaaactaaagggtagtctccgccaggtgaggtggtcacacctgtaattccagcactttgggaggccaaggcagatggatcacctgaggtcaagagttcgagaccagcctggccaacatggtgaaaccccatgtctactaaaaatttaaaaattagccgggtgtggtggctggtgcctgtagtcccagctacttgggagactgaggcaggagaatctcttgaacctggaggcggaggttgcagtgagctgagatcatgtcactgccctctagcctgggcaacagagtgagattccatctcaaaaaaaaaaaacaataaaaaaaaaaaaccatctctacaaaaactataaaagttagccaggcatgttggtatccacctgtaatcccagctacctgggaggctgaggtgggaggatcgcttgagtctgggaggcagaggctgcagtgagccaagattgcaccattgcactctagcctgggcactagaatgagaccccatctcaaaaaagaaaggtggggggcggggtaggaataggaacttcacagtggacaaaccgggcagatgccaccttcaccaaatgatccaggtgagcctccctgctcactgccatccggtaccctagtgtggtgtgctgagaagggcatgtcacctctgcggcattctttccgcaaaccccaaacctcagtctgctctgagaaagcaccaggcaggtccagatctggacatttgacaaa

SEQ ID NO: 18827 - DNA, 1047 bp, Homo sapiens
tcacgggaagttcatagaaagttctttttctttttctttttctttttttgagatggagtctgctgtgttgcccaggctggagtgcagtggcgcgatctcagctcactgcagccttcacccactgggttcaagtgattcttatgcctcagcctcccgagtagctgggattacaggctcccgccaccacgcccggttaatttttgtatttttagtggagacagggtttcaccatgttggccaggctggtctcaaactcttgacctcacgtgatccttccaccttggcctcccaaagtgctgggattataggcatgagctaccatgcctggcatgtatctcttcttctctaagtactcagctgtcttgtttgaggctagtacctccactagtctggaaccctccttcctgggctttctgcccacttccatctctcctttgacaacagtggtttttccagggtctgtgcagagctcagctttctgccataagacaggggagtttctgaagactcctcaccccttttgggagtgagggctgctgactgaagctccaggtcactgttttatgagctagctctccgtttgttgatggccggggacccagcctttgtcccctcctctcgtgcttgggcactcactactcactgcctcggttttgctttcagttttgattgtgcattgagtccacaacttcaatgggattttcttaaggcataaatgacagttgcatggtgtgcagtgggagaacaaatcgcccagcctgggacatccctgggtggcagagtggacctgctctcaacttatggaatgtgcagcaacaccttgaggttattaataaatacctgagtctgggcatggtggttcatgcctgtaattccagcactttggcaggctgaggccggaggatcacttcaggccaggagttcaagcccagcctgggcaacatagtgagattccatctttaaaaaaaaatttttttttaaaagaaggtgggcttggtggtgcacacctgtcatcccagctacttgggaagatgaggtgggaggatc

SEQ ID NO: 18828 - DNA, 1050 bp, Homo sapiens
tggatctctggccctgagctcccttctgatttcatggtatggccacctccttgtccctatcgcttgagcgtgtcaccagcatcttcagcttgggaggtccagaactgagctcctgattttgccccctaaacttttacttcttctggtctcactcatccgtccacgtactgaaggcagaacccaggaacccaggaagtgtccttgttccctttgttcacatcctgtcggttctgcctagaccttaaatcatgaacctgacctaaggccactccagcttttgcctggaccacagcaaaaggccaggagtgagcccccgcttctactcctgacacctccggagccattcgccacccagagctgtgtaggctttaaaaagagccagccagccgcgtgggatcctggatgggatcctggaacataaatcaggtgaaaaattggtgaaactcaaatcaagttcatcgtctagttaatttcctgttcttgattatcaagctgtgcttgacgtcgtacaataagacattcacgttaggagaagtggagcgagggatatatgagaactccctgtaccgtatatgtaactttcctatatgattaacattagtttgaattaaaaagttttaaaaaattggatgggtgcagtggcttatgcctataatcccggcactttgggaggctgaggtggccggatcatgaggtcaggactttgagacgagcctgaccaacatggtgaaaccccgtctctactaaaaatacaaaaattagccaggcatggtggttggtgcctgtaatcccagctactcaggaggctgaggcaggagaatcactcgaacccaggaggcggaggttgcagtgagccgagattgtgtcattgcactccagcctgggcaacagagcaagactcagtctcaagagaaaaaaaaaaagttaaaaaattaaaatgcaaaataagaaagaatcgaactgtgtgctgtcttacttaaaacactgcagagctcttgtgtgtgcctagcatgtaagtcagatgcctcttgtcgttttgagacagagtct

SEQ ID NO: 18829 - DNA, 1065 bp, Homo sapiens
cacgtggtggggcgggtgagggacggcagcagagccttggcagagcggagctgtgtggccgacggcttcctctttcttcctccagcgtgcgattataacttgttgctcatgcaccggcatgcagctctgtttgctcagtctgtttttctgtaaagtctctttttaaaaaagtatatgatacaggctgggcacggtggctcatgcctgtaatccgagcactttgggaagccaaggcaggtggatcacttgaggtcaggagttcaagaccagcctggccaacatggtgaaacctcacctgtactaaaaatacaaaaaattagccgggcatggtggtgggcacctgtaatcccagctacatgggaggctgaggcacgagaatctcttgaaccagggaggcagaggttgcagtgagccgagatctcaccattgcactccagcctgggcaacaagagcaaaactccatctcaaaaaaaaaaaaaaattgtgtgatatagatggaagaccacgtaaaataaatgtacaatctgattgttataaggtgaccgcctttgcatatctaccaggcaggttgcaggagagcacagccagccacccagcagccgtcctgccctccacctgccgcagggggccagatcttgccattcctggtggtcccgtctctgctcttcttggttttctttctttcgttctttctttttttttttgagatggagtcttgctctgttgcccaggctggagtgcagtggtgccatctctgctcaccacaacctccacctgctgggttcaagcaattctattgcctcagcctcccgagtagctgggattacaggcacgggccaccatgcctggctaatttttgtatttttagtagagatggggtttcaccatgttggccaggctggtctcgaactcctgaccctgtgatctgcccggctcggcctcccaaagtgctggggaggtgtgagccactgcgcccggactttttggttttcttatccaactgtgagtccttcaacacttggcgtcgggtgtttggcttgtctgttttttggcttgcttttgctt

SEQ ID NO: 18830 - DNA, 1032 bp, Homo sapiens
agtgtcttctccttctctacctggtagtaaagatgaccagaagggtcttgcttccagccggcaaggtccacagcccgccttcatagttacacttcaggggtctgtcagctaccagccttatgttatcacttcagtctccttcttcattccatggggtgccaacggataaccactcagatagaatgtaaaaggactttgggccaggtgcagtggctcatgcctgtaatcccagcgctttgggaggctgaggtaggcagatcacttgaggtcaggagtttgacaccagcctggccaatatggtgaaaccccatctaataaacccctactaataatacaaaaattagctgggcctggtggcaggtgcctgtaatcccagctactcaggaggctgaggcaggagaaactcttgaacctgggaggcggaggttgcagtgagccgaaatcgtaccagtgcactccagcctgggtgacagagtgagaccttgtctcaaaaaaagttcataaaaggactttggctcctcttctggggagagggttagcatggttttggttgtaagacggatagtagcattatatggcatggaagcctagttgctatttacttgatttggaagttaagtacggttgaaaagaggagtagatatggacaccaagttgacaaggggtacgtgtagtgagttcgttttgcgtcaccttggctaagttggagctctgtatgtaacttgagccacaagagaccatttgtgtaagaccgagaaggcagaggggacacagcagccacatgcactgtggctcatgcacgtggtctctgatctgcaggctcaccttgttggcgcacggcagccatcaggcctgtacctcttctgaaacccaccaaatctttcgttgttcccctcatctgcgtatgtggcagacagtttttctatgttttcaggcaattgttgagcaaataataatagaatttttgaacaggccagcatcggtgctaatatgtgccaggcacagatctgagccctttagagtatttactca

SEQ ID NO: 18831 - DNA, 1042 bp, Homo sapiens
actccttcagagtaatgtttcagacagaggagagagctttgtgggggccctctggcgtgctcacagaagctttggtattcgtcaaccactgtaggagccaagcatttcctacagaatgcagggagcagggctggcggggagatagtgcgtgaaaagagaggctggtgttgggaaagaaacagagacagaacggtggccggcggacaaacgacaataagccaggatgatggtgtcactgcagccgggtgcggagtttctttctggggtgatgaaagtgttctaggttgatggtggtgatggttgcacagccctgtgtgaatatgctagacaccactgaattgtaccctggaaacagatgaattgtacggtatgtgaattatatctcaataaagctgttattaaaaaaaagatggacagtcccagctactcaggaagctgaggcaggagtattgcttgaggccaggggttggaggctgcagtgagccgagattgcaccacggcactccagcctaggcaacagaaccagacgcttctctttaaacaaaaacctaaacaattgtagatttttttaaaatgaggctttttgttttttttatgccaaaacccttcatagacatgaaataacagaagagtaagattggcggggggggggggggcggtttcatcagtacaggttacctgaaagaactgagttgttggtctgacctctgctaggactcgccatgtgtcatggcaggcctggcacctgaaggagagctttagcaatttgcactcacatcatcctggacctcagcctgggtgatggtcactgtcttgagacagcttcagaacaggcaacctgggtgtggccgccttgtcaaccagagataataaaaacacaggtaaacctctgcacctccatcgtcatgccgaattataacaacagcacatatttgttgaagtcttactatgcactaggcacagtgctgagtgcccatgatgcagaggggaatttgagagtgtcagtcatttctgccccttcggatcacgcactgctttccag

SEQ ID NO: 18832 - DNA, 1093 bp, Homo sapiens
gttagaacttctaaaaaatttaatctgacagtcttcaccttttattggagtgtttaatccatttacatttaatgcaattattgatatgcttggattacatctaacattttgctatgttttctctgtctcacatctttttgttctgtttctccttactgttttcttttgtgttaaatagatattttctagtgttctgttttcatctgtttggtgaggtttttaatattttttggttatatttttagtggttactctaaggattgcaatatgcatctcatcacagtctactttttaaagatctatatatagcttttaaaaagtagagatggggttttgccatgttgcccaggctggtttcaaactcctggattcaagtgatccttccatctcagcctcccaaagtgctgggattacaggcatgagccactgtgcctagagctcacagtctactgtagattaatgctaattcattttcaataaaatatagaaactttgttccattaaatgtctatgtctatctacctcctctgtggtattatgtcatgtatatgatatctttgtatgtcataagcccagtagtaaaagtctgtagttattgttatatgtacttgtcttttaaatcagttaagtgtaaaaaagagactatttataaatctgctgtatatttgcctatgtaattagtattactagcattctttatttcttcatgtggattcaggatataatctggtgtttttttctttcatcttgaagggcttcctttagtatttcttgtaagtagggtctgccagtaacaaattttctgtctttgtttatctaggaatatctttatttctacttgttagttttggggtatggttttgatggatatggaattcttgattggaagtttttctttcagtgctttgaatatgtcattttactgttttctggtctctgttaatttctaacgtgaagtcagctgttaatcttatggtagtgctccttttcatgaagaaccattttgtcttcatgcagtcaagattttctctttgtttttggcttccagcagtttggctatgatgtgtcatggtggctcactttattgagttgg

SEQ ID NO: 18833 - DNA, 1030 bp, Homo sapiens
tcgacaatttggacatgatgttgttttggtatttctcttttttggagtcctctaaacttcttggatctgtgctttgatgtcttttattatgtttaaaaaattattggccattatctcttcaaatatttccttctatcctttctttcttcttcaagcattttcttttttcttagaaacatttaataggggcttatgcacagaagctatgtctgttctcaagcttctgttcattagtctgtgaactggggctgcagcgagaagagacagtggatccctgcaccattatcccctggtcccagggcttgtataccgtagggaaggggtgattcagagggatgtgtaggtcagtgtgagtacaataacatcaaagttgtttgacctaaggtcaggctttatggtaagttcttggtcttacacgaggaacagcgcataagctggaaatctcagagggtttcctggaactggggttaatcagaagccacatggcggagtagcatccacgatggagctacttcagcctccacagtccactcttgtaatccagctcttgtaatctcacatgccctcttcttccttcatggtccctgagcctttaaggagggtgcttgatactgtatagctttagcagcagtgccttggtcatggaaaacagatcgggcccagtgggattccaaacaagggagattcacaggcttttaaatcgtcttcagtcttcagaatgcagtggctttggttctgtcagaataggcaaaacaatgtgagatatataacatcgatcactcggatagtagaattctgtgcacacagagattgcaatagaaagagaatcgcctgtaatcccagctactcaggaggctgaggcgcgagaatcgcttgaacccgggaggtggaggttgcagggagccgagaccgcaccaccgcactcccgcctggatgacagtgagactctgtctcaaaaaccaaacaaaaaaacccagaattcgtgggccagaacaacaatgaaaaaagaacgtattctgttaagaagcca

SEQ ID NO: 18834 - DNA, 1124 bp, Homo sapiens
cgggaggatcactcttgaggccaagagtttgagactagcctggccaacgtggcaaaaccccatttctatcaaaaaatgtatatatatatacaaaaattaatcgggtgtggtggcgcacgcctgtagtctcagctactcgggaggctaaggcaggagaatcacttgagcctgggagatggaggttgcagtgaaccaagagcatgccactgcactagagcctgggcaacagagcaagactgtctcaaaaaaaaagtaaagaaaagaaaaattacctctgttaacttctttaaattcttaggtacaggtggtaatttttttctttgttaaaattgatgttggtcattttgtgtttgagttttctgttgctatttcatggggattttcctgtgcatctacataatatagtatttctttgaattaatatgccatagtttaatcatttcctgtttgagctttttagattgcttgaaggtttttctttcctttgtaaatactgcagctttaaggaatgtgtgacttttgaagctctctgttttggcagatggcaaagggggtgaccatcttatttttattaattttttattataaaagtaaaacatgtttttggtgttttagaaaagacagataagcaaaaagaagattaaaaaaacatttaccaactagagatagccattttgaatgtttcaacatgaggtttttagactttttcagtgcatatacgatatatatcaaatatttattcaaaatcaaatatatatcaatgcatataaatatatatagatataatggtgtcatatgaaacaccattaacaccattaaacaccattaacaccattaaacaccattaacaccattaaacaccattcatggatcatgaatacctttccacttaaatctgtatgtacatctttgtttattttattttattttatttttttgagacagagtcttgctctgtcatccaggctgaagtgcaggggcatgatctcggctcactgcaacctctgcctcccgggttcaagagattctcctgcctcagactccccagtagctgggactacaggcgtccgccaccacacccagctaatttttgtatttttagtagagacggggtttcaacatgt

SEQ ID NO: 18835 - DNA, 1027 bp, Homo sapiens
ccagctgagatggtttcttaacgtcctccaaaggtgatttttttcaagaatcaatataaactcttggattttagcttatttgatgtatttcattccattacagatacatgatttttgatgctcagattgtcccatttggggcccatgggagcccctttaagttggctgctgagtcctcttcatgcaaccccagtggtctttgataactttcatacccttttagtaacctttttaaagagttgagaaattataggtattaaaatctcattaattctgtttgtctgatatgtttattcagagagactgagctaaagtttaccctcatcttttttgaaaagaaaatgaatagtatatgcatgtttctatgaggaaataatgccacccaagaaacggtttgtgcatcttcgagttccttggaagctttaatttgcattcctacaattgagagcaatgtagaatttctttctgtatcttcccactaatgcctgttgaggggcaggtgtctgtgaatgtaggtaaatcgtgataaaaaaacaataaaaaggccgggcgtggtggttcacgtctgtaatcccagcactttgggaagctgaggcgggtggatcacttgaggtcaggagtttgagaccagcctggccaacatggggaaaccctgtctgtactggaaatacaaaaattagccgggtgtcgtggcgcacacctgtaatcccagctactcgggaaactgaggcaggagaattgtttcaacctgggaggcagaggttgcagtgagctgagatcacaccactgcactccagcctgggtgacacggtgagaactctgtctccaaaaacaaaacaaagcaaaacaaaacaaaaccaaaacaataaaaaaaaatcccaaaccaaaatgtagatgacctgtttgcagactgaggagtcctgcagcaaactccatcccccaggacagctgcggaatgttctagaaggcccaactctaggaaatcccttagtaggagccttgctctcaacagtgcctcctggaacga

SEQ ID NO: 18836 - DNA, 1050 bp, Homo sapiens
tagtgaaaccccgtctctactaaaaatacaaaaattagcctggtgtggtggtgtgcgcctgtaatcccaggtgctcgggaggctgaggcagaagaatcgcttgaacccaggaggtggaggttgcagtgagctgtgatcatgtccactgcactccagcctgggcgacagcctaggcgagactgcgtctcaaaaaaaaaaaaaaaaaaaaaaaaaagtaggtataagtatgattgcaaaactgccctgagctgctactttccgcctttgggaaagcccagctctgcaggagcagtcatggagccgtataacactgcctgcctcttcaataaaggtgttttctttcctgccaccggctcacccttgaattatttcctgggcaaagccaagaaccctcttgggctcggccccactttggggcgcgtctgacctgcgttaatagttcccaacctccgtgagctcacagttaaaaatgttgtggagtatgttcgggagtggggagcgctttagagggggctcctgctggagctgggtcctgagatcaggctgtggctctccaggtggacagaagagcaccagggcagagcggagaggtgggtatggctgggccctgtgcttctctgtgggggcggacgattgttagttgttcatcaggacaaggaaggccatgggtagcgtgggaaggagtttgcatttgaccccataggtgtcagggaaccactcaacagggggcttaggtgatctgacttgcagttttagaaagttcactctttcagagctagtgagtgtgggttggaaagagattaatgaggtgtcgagtaaatcccaggtaggggtgatggtggcccaatccaaagttacagtagcagtgatggaggtgatgggatctgagtggcattaggaagagcagcttgatgggactgcaagccagatttaaacaaacgactggcaggaggggaagggcttgaccatgtgaatgggaaatggcattttaagtttctggaagtgacttggcgacaatgtggagtcaggaatgggtgaggggcctttgaa

SEQ ID NO: 18837 - DNA, 1050 bp, Homo sapiens
tatgttttactaaaatcttcaggattgaggggaacatctgttgtggaagtatgtagagaaaataacactgattttttttaaaagcctgcttttgtgaagctgtattgtattttgtggtccccacacactgcatacttaaacagttaaaagcctcaggaaagggaatcctcggaagaagtaattaatagttccaatcagagatggcagaagtaatagtttcaatcagagacggcagaagtaatagtgtcagtcagagacgtccagtggttgaggtagggcctgcataggtcgttggtgtgagatcatcctatgtgtccagttggcattctctttctctggcttgtgatctgagctcctgtatcttttatgtatttgttctctggcaagggaacatcatctttcttctgatttttctttattttactaactttgctgttgaagattttatggatgtagacgaaaactattttcacccgagaattcccctaacctagagcactttaaggactatgttaacaaggtcagaaactacactttctgttcacttgaaagatgctgccgtgatgagtgtctttccgtttagggcggtggcactcgctcttgagtctgaaggtgtcagtggacggggctgtgggtgtaaccccctgcttgccaccttggcatttttagggcccaggtgttgtgagctctgtccttggagactgtgggacggtggagctgggcggcagtacgttaaattaaatatgttggcccagaggacaatgagaacgttttgtaagctgtactttgtatgctgtattactcgaatttcaaaaatgaagagggtgtaattattaaatatgtttggaaattgccaagtcattgaatacctattttgtgaatttatgagtagttttatttttaagtttgtagatcaggggtctcagacacagagccaaaaaaaaaaaatgctagagtgagtttgtgtttttttttttttaaacctcaaatagtgtaaatttggtaaattaacttttcttgacatttgtgtacattgtatatttataaaag

SEQ ID NO: 18838 - DNA, 1023 bp, Homo sapiens
aggggggcgcgagtccggggggcgtggcctggctcggacgccccgcccctacccccacgcggggcctccttccggccggcgcgccccggacgtgacctcgcgggcgcgcgccgggagccgccagactgggcgccgacagcatcctccgggggtaggcgcccacagtcattctttccatcgctgcggacacgggagtcagaagtgaaacagtcctgtcctcgtggggcttacgttccaggcgcaagagccacaggtagtcgaattgggaaaccgcctcggatgtcacataagcgcccagggaggacagggcaggacagggcctccctggggaggtgacttgagtcaagactcaaaagagggaagcgagggaacaagccatgcgaggaactaacgaaggaacattccagaaagatttcacatcccaagcctaaggtccaggggcagcaggcattgaggcggatgtggctggagtggagagaaagaggaattaaaaggatggagtaatgacaataatggctcacattttttagcaagaggtgggttcactacctatctgtcgttatctggggggaaattaggctctgggaggtcaaataacttgcccaaggtcacacagcttgtaagtggccagaccagcattggaacccaaggggacggatgtctgaaacacacccaggagtcccaaggtgggatgaccttgaccaagacaggccctttaccccttgcctcagtttcatcccaaagagctgcccaaacacagcttaaaatcagggcacagagcaagggtgtagctgagtgtgcgtaacatctgttctcctgggagatgcttttgttgtctgggaagcacttgtcacctctccaggctctggagcaggtacaagtggcttcggggagaaagggtgggagccgggaagaggctgcttctggtggcaggaggagagagggagtgggtgaggggccccgggctggctgagtgctctggagcatgacaaaggcagtgtcagccaggcagctgtgtccgcc

SEQ ID NO: 18839 - DNA, 1023 bp, Homo sapiens; identical to SEQ ID NO: 18838

SEQ ID NO: 18840 - DNA, 1028 bp, Homo sapiens
tccgctgcagaactgactgcttgcttgttattggggagaaacccccacatgttttgccacagaagtcttttctgttgattgttatggtgtgaaagcagaggagaaacaggttttttctccacaccttcacatgccacagaacccagagggtgtggaggggtagactttgcagaggcctctggtcttccataggagtgacttactattaagtttgtgattgacttgtaaagattttcaaacaggcacctattttgtttgcaattaataaatccaagatttaaagcaagaaggccaagaagcctctcttggatttgtcagggctgcaagttgacttcagtgggctccccagaccccgcaagtctccccttcctcctctgttgggaactgggcagatccccaggtctcctagccccctccctcaccagcaccttcccacagcagaggtgctggggctgcattttcagatcagacattttccattttgtagcttaatttgaacagtactcgttttattggaaaactattttgcttctgatcgtgtgattgaaagattattcttgtagtttttattacaccctacacaacatggttttgtgggaatgcatgtttgattttgtattggaaggcactgggagaatgggtgtttgaattcgggaaatcttcatgagctgttttccagatcctctccttggtagagaaggacctgccctgcagtctctgctggggttcaggaaggcagcaggaggacgcatgtggatatggaggggtgagggggagcagtgagtagcaggcatggccctaggtggggaagacacggaggagcaacagggccctgcggcccccggtgaggggcaaagagaaggtgggctctggtgtggccatcgagctggaggggaagccagccctgtgcaggtccagacccttccctgtggcctgcattttctgtacccaggttgggtgaacaccaaaggagggctatgccctgtgggcttacaccctatcatcatgggcaaggctgtatgtggaat

SEQ ID NO: 18841 - DNA, 1046 bp, Homo sapiens
ctttaggacaaagaccagccctggggacagacaccagaagagtaaatggagctgatgtgttatattcactgttctcatgtcacctgttaattctggaaagggacagtgttctacgcttagggatcggtgactcgtgcactgctcagggtttatcttcagcagggagtttttgcctggcggaacttgtctcttccaatcatctgactgtggcccacatcttgcagggagccgatatgtggatttactcccttgatggaagcagctgctgctggccatgagataatcgtgcagtattttctgaatcacgtaagtgaccctgattattagcatgtaatgtagtcacggcaaatgaggaatcatattactgaagtataagctattacagaattttcctttgcacagaaataactttcattcatttattcaacacattttcattatctattgacgcccggtgttgagtggtgcttaggcattaaggatacagtggtgagtagaaatagacacctattcctgtaataattttgaaaatactatctgaaaattatggaaaaatattttaaaagtaaatagcactcataatcctgtcacttagaaaaattatatagaataagaaggcagagatcctcctctctttttcaacctccctgatgcccacttggtttgagaaagagctgccctaggacttttcctctgctgtggaaagatgtgtctgtaggcaagtgtgtgcacattgctttgtgttttgaacaaagtgggattctacgtatagtctgtaacttagagacatcttatagacatcttatctttgtacagtattccgtgtacaatctgcctcagttaatttaatgagtttcttattagtagaaacttagtttttaacattttgcaattataaacagtgttccgggaatatccttttacacatagctttaatacatttgcagttatttctgtatgttgtatttctgttttattttattaatttatttttttgagacatggtgttgccctgtatcccaggctggagttcagtggcgagatcg

SEQ ID NO: 18842 - DNA, 1255 bp, Homo sapiens
cccatctctactaaaaatacaaaaaaattagccgggtgtggtggcatgcacctatagtcccagctactcagaggctgaggcaggagaatcgcttgaacccaggaggcagaggttgcagtgagctgagatcgcgccattacacaccagcctgggcgacaaaaattttttgatagagatggagtctcactgtgttacccgggctcaaaaacatttttttttcttaattgagatggagtttcactctgtcacccaggttggattgcagtggcatgatctcggctcactgcaacctccatctcctgggttcaagcaattctcgtgccttagcctcccaagcagctgggattacaggtgtgcatcaccacacctggctaatttttgtatttttagtagagacagcattttaccatgttggtcaggctggtcttgaactcctgatcttgtgatctgcccgcctcggcctcccaatattttttctatttttagtagagacagtgttttgccatgttggcgagaactcctgacgtcaaatgatcagcccgcatcggcatttcagagtgctggtattacaggcgtgagctatcaggcctggccctcaaaaacattctttatcatgctaaatggaaacctcgtacccaacaagcagtttctccccatttcccctcccctagcctctggcagccacctgtctgctctgtctctgggtgtgcctattctggttgtcttctgtaaagggaatcgtgcagggactgtcccttggtgactggcttcttttgctcagtgtcatgtgttcctgggtcatccgtggtatagcatgtgtcagtgcttccttttcatggctgaatagtattccactgtatggatagaccacgttttgttgatccattttcgttgatggacatttgggtgatttccattttttggctactgtgaagagtgctgtcgtgaacatttatgtacacatttctgtttgaggacatgttttcagttttcttgggtgtgtacctaggagtaaagtcattggctcatataatgactcttgtttaccttttgatgagctgccagactcagtctcttttaaaaatatttgtacggccaggcatggtggctcacccctgtgatctcagcactttgggaggccaaggcggttgggtcacctgaggtcaggagttcgagaccagcctggccaacatggtgaaactctttctctactaaaaatacaaaaattggctgggtgtggtggctcactcctgta

SEQ ID NO: 18843 - DNA, 1078 bp, Homo sapiens
cgcggcctcgggtaccgctcaccctccacctgagggatgagacgggaaagcagcccggcctgggggtcccagctctcccaggaccctggaattggggggctgtcgtgaccacccacgcgggggtgcctgacggggccgcgtaggggcttcagggttcgccagacctggacaccggggatcaagttgaggcagagtctgcagaaaggccctacttttcatcagatttccaaaggaaccccttccatataggacccactctaatcatggaaaataacgattctcgagctctgaccgcaaacatcccttttagattgtttttgtttgagtctctctctgtcgcccaggctggagtgcagtggcgctatctcagttcactgcaacctccatctcccgggttcaagcgattctcctgtctcagcctcccgagttgctgggattacagatgtgctaccaccatgtcgggctaatttttgtattttttgtagagacagggttccaccacgttgaccaggtggtcaactcctgaactcacgtgatctgccctcctctgcctcccaaagtgcggggattacaggcgtcagctactgcccccagccatcccttttagttctgtcagcaacctgtgtgtgtaggtcctgttatcatctctgtttgcccagtgaggaagcaaagcccagagcccttcagtaaattacccgggaattaacagggggttaataacaaagatgacattcatccacttccttttccttttccatggtggggtgagctggccttggaaccagggcaggggcttcccaggccaaagggcttatccagccccagggctgcccttcagatggttttatcgtctctccacagggccctgaaaaaaactctcttcctgtgtctggccagaggtatagagagagacaggttcaactctaaggcctgaaaaggaacaaggcccaccggaagcaatggccactgtccctggcctccagcccctgccaaccttggagcaggacctggaacaggaagagatcctgattgtgaaggtggaggaggacttctgcttggaagaggagccctccgtgga

SEQ ID NO: 18844 - DNA, 1048 bp, Homo sapiens
taaaaatacaaaaaattagctgggcatggtggcaggcacctttaatctcagctactcaggaggctgaggcagagaattgcttgaacctgggaggcgggaggttgcagtgagcctagatcgcaccactgcactccagcctgggcaacagagtgagactccatcgcaaaaaaaaaaaaaaaaaaacgaaagctgctacagccttctcaggcttattgttttcatggtatgtatatttttccatccatttcctctcttatttatgtctaaattatggctttgatagacagtatgtaattggggtttggatttttatccattttgacagtatctgccttttaattagcatgtctattagcatttttcaaatgatgttttaagcacttaacacgtgcactttttttatatttgagacacagtctcactctcttgcccaggtaaagtgcagtggcacaattatagctcactgcagccttgacttcctaggctcaagcaatcctcccacctcagcctcccgagtagctgggactataggcgtgcacaactgtatccaacttcacatacactttcgaaaagctttttagggtagaagttccgctttcttagctcatcttcatagaatttgaatctaaaaaaaaaacaactgaaaaacatttgtctttaccatattattataataaaaatgacactttgtgaaacagcagctgtatttttaaagtactatcagctgatacacttttattttatgttattttattttattttattttattttagagaccgagtttcacccttgttgcccaagctggagtgcaatggtgtaatctcggctcactgcaacctctgcctcctgggttcaagtgattctcctgcctcagcctccacagtagctgggattacaggtgcctgccagtactcctggctaactttttgtatttttagtagagatacggtttcaccatgttggccaggttggtctcaaactcctgacctcaggtgatccacccacctcagcctacctaagtgctgggattacaggcgtgagccatgg

SEQ ID NO: 18845 - DNA, 1049 bp, Homo sapiens
aggcagcagcaagaccctgtctcagaaaagaaaaaggacaaaaaaatggctcacaaaagaggaaacaaaggcataaaaaatattcggtaatcaggagtaattaaaatatatcaaacaaggccgggtgcggtggctcatgcctataatcccagcactttggaaggcagagactgggggataacgaggtcaggagatcgagacctcggtgaaaccccgtctctactaaaaatacgaaaaattagccgggcacagtggcgggcgcctgtagtcccagctactcgggaggctgaggcaggagaatggcgtgaacctgggaggcagagcttgcagtgagctgagatcgtgccactgcactccatcctgggcgacagcgagactctgtctcaaaaaaaaaaaatgaaacagttgccttttttgactggttaaatgatcaggtaggaagaattttacatgtatttatgggcacttatttgtagtttttaaattacatacttggtactggcataataggagagcttgctggtgatctttatgaagtgacatagtctcattgggaagtcatctgtctacatttgttgagagccttaaaacttttagaacctgttttattctatttgtggagacctgaatttaaaacatagagaagttttgtacgtaaagatgtttggtgatgtgattttacaattgaaagtgggctaagtgtcaaactacaggtcagccattaggtaaatcacagtatatctctcagtgaagttttccatagtcaaccactataaaccataattatgccagaattatgaaagacaacaatatagataaatgtgaatcataaacaacattaaaagtctgatagaaaatagtaggcccatccagcctgggcaacatggtgaaaccctgtctctacagaaaaaaaaaaaaatcacacatggggcatgcacctatagtcccagctattcaggaggctgaggcaggaggatcacttgagtccaggaggttgaggctgcagtgagccatgattgcaccactgtgctccagcctgggtgacagag

SEQ ID NO: 18846 - DNA, 1048 bp, Homo sapiens
gaggtggaaggatcacttgagcccaggagtttgaggctgcggtgagctatgatcacccccctgcactccagcctgggagacagcataatgctgtcactaaaaaaagaaaaaaggctgggtgcagtggctcacgcccataatcctaacactttgggaggctgaggtgagaggattgcctgataccaaaagttcgagaccagcctagccaacatagcaagacccccccatctctctttttaaataaataaataaataaaaattaaaaactataaaaacaagaacatgatatgatcagaaatgaggaaaggcattcttttgcaccattgtcacttgcaaagagaggtgaagaagtacaagaatcaagaaaagacactttggcaagctaaaagtcatccgtaaaagcatgttgaaatagcagcagtggcatccagcccccagctctcagggttgcaggaaggagcaggcggagtatgtgaatgtgtgtggaggagactggccaatgagtgcttctgtcacaaggattgggaaggacctgtggaaggaagggctgggggaacagtgagaggtttgggggaaggcaggcatggggagaaggatttgtggactgggaaagattgggttccaagctcaggtgaaggacttagctttggagaggagaggcaaggcccattctgttgataacgggaagacgggaaaggtagggtgtgggtagagaattgaagttgggaaagagaggtgaaaattgccgtcctggttcatgcagtcaaggaagttgcctggctctaaacacagtgcttcagtgacttgtggtggattctgttgggctttaaagtagtatccagagccgggtgcagtggttcacacctgcaaccccagcactttgggaggctgaggtgggcggatcccttaagcccaggagtccaagaccagcctgggtaacatggcaaaagcccatctccacaaaaaattaggtgtgctgacagatgcctgtagtctcagctacccaggaggctgagggggaaggattacttgagcccaggaggtcgag

SEQ ID NO: 18847 - DNA, 1653 bp, Homo sapiens
tttggagttcactaaagtataaaacaaatagttgatgttaacttcccactttgggtctaacctttgaggggattattatgaagactggttaagcctgcagtagcacaagtagtctctttcctcctccttcattagccagctgtctgttaccaggcaatcacgaagaagttgaaaatatgtgaagaggtatgtaggctccatgcctccccattttaattttcacctggggccttaaactgcaggcagactgacttgatgatgtgtgcttcctgtccgtaggaaactggctccacctccatccaggcagctgacagcacagccgtgaatggcagcatcacacccacagacaaaaagtaggacctttgatgaaaaggcctccagtggctctggttctgctgagggtggggagaaggtgaccccaggggggttctttaagggttgtgtcccagccattgctggcattgaatggaaaaggtggggggatgttgtaactcttatcgataaagacaggagtcaaaagctgtgtaaatctgtggtcgggtctcccttgggcataagctgagggatttttttggctccagaactcaagagcaaggagcacttggctcagtggttctcagactttcctgtgcctgacagtcacctggaaggtggcttctcagtcaatatgtccgggtggggcccaagaatttgtatttttaaccagttcccaggtatactgctgctgctggtcagagctacgctgtgagaaccactggctgagtagaatcatgatgaggccccaaaattggccatggtggggcaggtgggggaagggagatgaaagtgcttggggatcctcactgagcacttgctggctgtcctgcaccctgcccggtgtgggtggggcgatcctggacatgctcccagacccaacttgcgcccagccttgcctctgtgcctgctctgtaggcatgtctcctccgcagagtcttgttggcaaaaagataccttttctaggaaaacacgttctctggagcaagttagctaaagtcagtttccagtttgtacctttcacatggtcttccccagactaaaaacagtgcatcttttacatgatatttttgtactgtttaaatcactaatgctaccagttatttttggtgaacttgtctctgtagagtggaggagataagggcatattaggtgcaaacaaaggggaggaggattgtgttaaaaaaataaaaataaaaaaatgatcaggatagggtgaggacagagtcctgatgtttttacccaacacatttattggcccattagtcaaacttttaataaaagagtatgaagccagcatcaaaaccaaccagttttgttgttgcccaacccaccttaatccacatttccattttgtctgagacacagtgtgaaggactctcagttgccatattaaaaatccagaaccttgacctgggcatggtggctcatggctgttatcccagcactttgggaggccaaggtgggcggattacctgaggtcaggagttcaagaccagcctggccaacatggtgaaaccctgtctctacaaaaattagccaggcatgatggtgggtgcctttaatcccagctacttgggaggctgaggtgggagaatcgcttgaacccgggaggtggag

SEQ ID NO: 18848 - DNA, 1065 bp, Homo sapiens
agcattttcggaggctgaggtgagcagattgcttgagcttaggagttgaagactagctctacaaaaactaaaaaattggccaggcatggtagctcacacctgtaatcctagcactttgggaggccagtgcaggaggatcccctgagcccaggagttctagaccagcctgggcaacatagggaaaccccatctctattaaaattttttttgctgggtgcagtggctcacacctgtaatcccagcactttgggaggccgaggcaggtggttcacctcaggtcgggagttcgagaccagcctgaccaacatggagaaaccccgtctctactaaaaatacaaaaattacccgagtgtggtggcacgctcctgtaattccaactactcgggaggatgaggcaggagaatcacgtgaacccaggaggcagaggttgcagtgagccgagattgcgccactgcactccagcctgggcgacagagtgagactccgtctcaaagaaaaaaaaaaatttaatataaatgaattaaaaattagctggggttggtggtgtgtgcctgtagtcccccctactcagaaagctgagatgagaagatcacttgaacccaggaggtggaggttacagtgagccaagattatgccactgcactttagtctgggtgacacagcgagaccctgtctcaaaaaaaacaacaaaaaaagaaacaaaaagtactagttgggcatagtggtacacacctgtagtcccacctacttgggaagctggggtgggaggatcacttgagcccaggaggtcaaggctgtagtgacctacaattccaccactgcactccagcctgggcaacagtgtgagaccctatctccaaaaaaagagagaagctggaaatacaggtttttatgtgaaatatcccaattttaaatgtgcttagttcaaaaatatgtcttggggccatagaaacatctctgtgggctgccagtgtgaggcctctggtgagagacagcccttctcactgttagatgacctcaggctgagggagtggtgagagcaagggtggcagtgctgtccctgca

SEQ ID NO: 18849 - DNA, 1032 bp, Homo sapiens
ccagggggcgcccacaaccccttcaaggactgaagcctcaagctgcccggggtggcacgtcgcgaaagcttgtttccccacggtctggcttctgcaggggaaatttcaaggccactggcgtggaccatctgggtgtcctcagcccctgtggggcagccaagttcctgatagcacttgtgcctcagcccctcacctggccacctgccagggcacctgcaaccctagcaataccatgctcgctggagaggctcagctgcctgcttctggcctgcctgtgtctgctgccgagaagcccgtgcccccgggagggctgccgcactgccaaagagtctccctcctcctggggaaggggctgccaacgaaccagactcagtgaccacgtcatgacagaacagcacatcctggccagcacccctggctggagtgggttaaagggacgagtctgccttcctggctgtgacacgggaccccttttctacagacctcatcactggatttgccaactagaattcgatttcctgtcataggaagctccttggaagaagggatggggggatgagatcatgtttacagacctgttttgtcatcctgctgccaagaagttttttaatcacttgaataaattgatataataaaaggagccaccaggtggtgtgtggattctgaatcatggacttaggtcactgctagggcttagcaggtgtggcttatcctgaaacagaagtcacaacggcatcctggagccaagtcctgttccctgcttgtttaatccagtgcttatcaaactttaatatgccacaggtcacgaggagatcttgttaaaatgcagatttgggcctggggtgaggccagcaattctgcgtttccaacaagctctctgacgatgctgatgcttcaggtccccagaccacacttcttgtctttcttagaaacagggtctcgctctgttgccctggctggagtgcaatggcacgatctcggctcactgcaattttgacctcctgggctcaagtgattctcccacctcagtct

SEQ ID NO: 18850 - DNA, 1033 bp, Homo sapiens
ccaggagtttaagaccagcctgggcaacatattgaaaccctgtctctacaaaaaatgagctggttgtggtggcacgtggccgtagtcccacaacccaggaggctggggtgggcggatcacctgagcccaggaggttgagaggcttcagtgagccatgatcgcgccactgcattccagcctaggtgaccaagtgagatcctatctgaaaaaaaaaaaaaaaaaaaaaaaaagccatccttgtggccattcctggaccgtctggagaccctgctctgtgccagtgcctgtgctgggcccttgggacacagaggggccctgtgctgccctcagactcctcacccctacaggccatgagcttccagtggcatctctgaaggattgggtgcacttggggtgttgagggggcttgggtggagaaagaagggggcccccattttgggtctgtgccattcacccaggggaaaatgggtgtgacaaatggaagatgcaaggaggacgacgatggtgacaatgacagtgatgatgatgatgacgcggcatgattcctgagcgggccctaccctttccaccgcctttcctgcctcccattcctagtcccccacccatcacatggtttccccactggcctcagtcccacccgggccctcagggcctttgcacaggctgttccctatacctggaacagcctccctccgttttgcaaatggctacccctttcttgctgttcagggtcctgcaggcaccctgattagcgtgtgtattcccacccttctccccctatccccttctgtctgtttctttacagcccttttgggatctgtaatgatctggtttatgtttatttaactgtttattctctggcttcaagttcagccctttgtctctggggccttgaacagggctcggtattgggcacgtgtctgttgagtgcctttatgatgacaattataacaacagtcgtagctgacaattactgctcactggacctgggcggacagtgtgcccagtgcttagtgtgtattattttgttttc

SEQ ID NO: 18851 - DNA, 1128 bp, Homo sapiens
aactgtcagcgcaatgggggagaagaggttagtggatcgggggtccctggctcaaggtctctgggctgtccctagtgggcacgagtggctcggctgccttcctggggtcccgtgcaccagccctgcagctagcaagtcttgtgtttaggctcgtctgacctatttccttcagttatactttcaatgaccttttgtgcatctgttaaggcaaaacagagaaactcacaacctaataaatagcgctcttcccttcattgtgtgcattgtcggcccttcctcgggttctcctcctccagctgcctgggggctttttaataaacttgtctcacctcgtcagccactactgtctgcagcccctttgcaaagtggatgcactgaatacagtccggacagacattgtgggggtctttttattaaatcaagaacattgttaaattcaattaaggtttactctgctgccttggcagacttacgatctcaacagttcatacgagcaggtgaaaggattataaatagaatttcgttaaagtggaacagacgacaagaaagccttttagcaagagggcatgctcactagtggttagtaagctgtcgactttgtaaaaaagttaaaaatgaaaaaaaaaggaaaaatgaattgtatatttaatgaatgaacatgtacaatttgccactgggaggaggttcctttttgttgggtgagtctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctttttgctggaaaatgttgtatgttgaataaaattttctataaaaattataattcagtgagttacgtggaagtggaggaagatttctactctccctggaaacaggcctgggaaaccttggcatttgtaacaaggtttcactgagatgtacttttccttctaattccgttttgcgggggcagggtctcttgtttctttttttttttt

SEQ ID NO: 18852 - DNA, 1130 bp, Homo sapiens
cctctgggaccccttgggtcactgcacagcagggcagctgcccagagagaagctgctccacgtgctctcctgagcttggtcacagtcccagagtagttcctgatacacaaaccgggactgttgtgccttgagctgccctgggcagctgcctgagtatttgtaacacctggccctgttggtggcgggcagagccagttcaggagtaaagacttggttgtcagaagtcaggccaccagacagagaagtgattaagtgcacgtcaggttgcttcaaaaagtactgagggggttggagaaagggaggaggtcatctcaccgttggctgtctagctaggtccaatttataggtgagttaagttattgcagtgaaacacagtctccttttcttttttcttttcctttttttttttttttgagacagagtttcactcttgttgcccaggcttgagtgcagtggcgcgatctctgctcacctcaacctctgcctcctggattcaagtgattctcctgcctcagccttcctagtagctgggattacaggcatgtgccaccacacccagctaattttgtatttttagtagagacagggtttctccgtgttggtcaggctggtctcggaactcctgacctcaggtgatccgcccgcctcggcctcccaaagtgcatgagccaccgtgccctgcccacagcctccttttctaaataaatacctgatttaggttttggtcattttatgcggtttttcttcattggtcttctgaagaagtttctttggaacaaaaaatgagttttcagcgttttagtgtttaaatgtgttcagtgtggactcattttttgtcagttgtcaagtcttttctgtgctttcatacatattttcagatagtcgcagaggaccagttttgtggccaccaagggaatgacatgtacgatgaagaaaaagtgaaatacactgtgttcaaagtattgaagaactcctcgcttgctgagtttgttcagagcctctctcagaccatggtgcgtaccggtcccgtggatataccccaccgtggctcccaacgtccaccttccttccgtgtcactagaaaatactgattgcctttgggggtaggtgctgtgtccagccactgccta

SEQ ID NO: 18853 - DNA, 1011 bp, Homo sapiens
gagggagagggggatgttgggagatggagtgcagctggtttatcctgtagaagcacatccagcagtccggagggtcttgtggggttttaggcatcttgtcctttccccgttcctcaccttactggtgtcactgctccagttttccctcagtttctcctggtcacaagtgggatttcttagtaagttggactgtgtttaggttgtgtttctttatttttaaatgtatttttaatgaatttagttttctgaggatcacgactttagaatgagtagtgtgttctctagggttgtgtcccccaggtttctgggcatctgagagagcagtgagcatggtgggcgaccaggtggccagcccccgcttggatgaagggaaatgggctgtttctggctgctggtctggctggtctgttggatctgcagtgtcctcatggatccagtgatccagggtctgttttgtaatcttataaccttgactcattgactcaactaatttataattaaaaatgtcagtctggcctgtgcttacaaagcctgccagtgtatatagttcatggtgcctgtgtacccattttgtagtcagctgtcagctccaaatgtactcttctgctaggtcagtccagttggactgagggactgaggtatagatcagaaagttgcttttttttctgagacggagactcggtctgttccccaggctagagtgcagtggcgcgatctcgactcactgcaacctctgcctcctgggttcaagtgattcttctacctcagcctcccaagtagctgggactacaggcgcccgccactatgcccaactaatttttgtatttttagtagagatggggtttcaccatattggccaggcaggtctcaaacccctgaccttgtgatccgcctgcctcggcctcccaaagtgctgggattacaggcatgagccacttgctcatccagaaagttgctttttaatgagaacttggtgtgatgaagaaatattctggtctgttgacgagaatt

SEQ ID NO: 18854 - DNA, 1094 bp, Homo sapiens
cttgatatttgggttggtctccatttgaggtggttaggcataaggcagatcgaccattcttaatgcctgtttgcatttggaggaagaggattactggcctgtagggtgtgcgtatgtccagcttgatggatcaagttagcgagattcccaaagtggtttatcaattgcacagtcatcaggaaggtggcagagttgcagttgctccacacccacactggagctgtcagttgccagactttgaaagattttggtgggagtatagtgctatctgcattttagtttgtatttccttgaagatcagtgaggttgttcttaccttttcaaatgcttattggcaatttggatgtcttcctttataaaatgcttgtttaaatactttaacaattttagtattggcttcttttctttttccttaactgatttatagtcattcctttaaagaaatatttaaaataagggggaggatgggtgtggtcgctcatgcctgtaatttcagcactttgggaggctgagtcgggaggattgcttgaacccaggagtttgaggccagcctgggcaacatagtgagactccatctctacaaattagctgggcgtggtggcatgcacctgtagtcccagctacttgaggctgaggtgggaggatagcttgagccctggagtttaagtctgcagcgagccatgattgtgccactgcactgcagcctgggcaacagagcaagtatctctctcaagaaagtaaaataaaataaaaagagtgaggaggggaagtgctttatgttgacccacatatttacagcttgcaatgctcctccgtttttaatttggatatggattctcgttaggaatcatttagtgcgggtcggctgagatgagttttttcaccttgcatgcctagaaagattttatttcatctgcagttgtgaaagacattttaactcggtgtagacttctaggttggcaggttccttccttcggtctgttagacgttctaccgtcttcttgctcgcctcatttctgagaagtgggctgtagtgtccttactctttctgttcatctgtttctctgccccaagcccccatattcttcgcttcg

SEQ ID NO: 18855 - DNA, 1030 bp, Homo sapiens
gtttcaacttctaaggaattaaaaaatgaaaccatgagtgaaatcactacagaatacactgggggagccccaaacacccatttctctattaaaggtaaaaatgcctccatcctacctttaaccccaacccgaaaggagagagcaatgaaatcataaatgggaattttggtgtgctatgtttactgtctttaaaaatgtataacatctggtaaataatgtcaactaaggctcagattattcttttaaacaggtcatggtcttgccatgcacaagcagtgctgaagataataaattacagagatgatgaaaagtcgttcagtcgtcgtattagtcatttgttcttccataaagaaaatgattggggattttccaattttatggcctggagtgtaagtaacagtgtatttagtctgaacaattggtgcattactgcttgttgttcccttaactttttgatttttcaagtcctttattgattttagagtcagatttttactttctaaattggacaagtgtctttgaaaacatgttttctccagtttcgtatcttacgtttttagcagctttctggattcacgtctcactttttagtcagacattcaaagggagttcccagtgggctaaatttcctttaaaagacataatgctgtttgaggtcctttcatgattcaggcatagtactgagtggttccatgtgactccagtaatcattcagttcactttggctgctttttgcagaggtggtaaccagtggaacaatcttaggaatgttacttcttactatgctaagtcacttatcattgcattctccagcccctcccctgcttagaggggcacagatttctcctgtccatgctgtggcactgagcccctgggtacctctgggatacctctgaggtgccaagcatttgctgtatttgttgtgagaccactgttaaaagaaaattgaaacagtctaaaattagcaaaaaagttgggatgtatttaaaaaaaaagtattttcatctctattaagtacagggcactaatg

SEQ ID NO: 18856 - DNA, 1053 bp, Homo sapiens
tgaaggatgggaggatgttcttaggcactctttacccaagcctacaagtctcattttgtgccttaggagcctggtggtcagggatgtcaaaatagcacctgattctaagccgggaacagccttccaggcactgcctgtagagcttggcccttggtgtggccctgggactcctgccagtcagtgagctgtgtgcagactataatgagataggtacagaaagtgaaaggaagcgtttagaagcttgtgtagcatgttgactttgctgtggcaatttcatgatgctttataaaagtattggtcaataacagattggtgtgggtgtgggaggactgtgccttcgcaggagtcgtttgggaagcagtaagatgctgcagggtttgtcaaaggtgattgaccgatggccacatgcaaatgaatagtcactgtcatcagtgaaagattgaattttaaatggagaccttcagttggacctctgctaagaggcactgtgttgtcagaaacttaaatatcttaaatcagcctttggtcttgttatcatttaacaatttatactactcatgtgggaaaaaataccagttcttaaaaaaaaaattattccccctagggtgtccaggctagtatttttgcaaaaatcgtgaaccaatgaggttagcatttattatcaggctactgttgtagcccttgtcttgcctctgagcagtgctgagcttccaggggaatggctgtttccctggctctcaagtcctgcctgtgtgttccgtgctctgtaaagtcagcccaagtcccatgtcgtggtctttacccccagaagtcccgtccttgaacagatatgagccatgtcgttccttctctccaaggtctctccactcacttggtgcctggggtccttgggaattcagctttagtaaagtagacattgttctcatgtggaactcagtctgacagggatggcaagtgtatggttagcactctgagttttggacttcataaggaagaattaatccattcagaaactgtatgttatctcagtcttcgggttttaataaattggaa

SEQ ID NO: 18857 - DNA, 1048 bp, Homo sapiens
caataaaccagcacatggtaatgttgtataaaaaataattattttccaagtaatgttgtataaaaaataattattttccaaaagtgtattgagaggaatggcattgctttacatttttgtaaatttctttattgtctgttgtaatagaagacttcatacctgcttgtgcattcagtcagctgcagtgtaattttaattaaaatatgaaaaaaccaatcttacagagatatactgaaaaaaacaggaggaatgctttagtagcctttttgaatgattgactattctctgataactacagcaaagcaaaacaagtggtaacttaatgaaggttaattcaccccgccccattaccttaagttcgtcatgcactttcagtggattttttccagttgcatttattggccgtttggaaaatatggattcatcaagttttacaggtctgctaaatgttgatacattttattatacagttatattaaaaagttgagtttatatgcccagacattggcgttgttggaaacgcctgctgctgtttgctctgtaggtggagccttctgcgtgctggcagatggctgagtggttgagcgtgagtggctgtgtggaggccgcctttgcatctgctggtgtgtggggctggggtataggccagtgaccagattattggaggtgtgcctttgccatgcctgtatgctcttcagagtgtcagttcagctattctgactttttagttgagttttgtccagctgttgagttttgtgaactgttgtttatatatttgagatttgagtctttgtaagatacgcgatttgcagatattttctgctggtctgtagctcgtgtgtattcacttaacagcttctttctggagcataagtctttctggagcaaagttgatcaacagtttttttctttatttagagatgcggtttcaccatattggccaggctggtcttgaactcctggccacaagtgatcctcctgcctcagcctctcaaagtgctgggattaccggcttaagccaccgccgcctgccatttttttgttgttg

SEQ ID NO: 18858 - DNA, 1016 bp, Homo sapiens
gctctaggacccggaagcggcagggaaacatttccccctagaacctccagaaggaatgtggccctgctggcaccttggttttagcccggtgagacccatttcagacttctgaccttcagagctgtgaaagaacaaggtgtgtcaacttacctgggtcacccagagcaagtggcagagctgggattggaacacatgtggtccggcttcaccatagccagtaagtgctattggtcataaagtagtggttactgaattttaattaatatttttttggagacaggctctccctcgtgcccaggctggaattcagtggcgcaatcaccgttaactatagcctcaaactcctggggctcaggagtcctcccacctcagcctccctagtgactgggactacaggcacaccacacctggccattttttttcttttttgtatagacgggggggtctacttttttatttaaacaccctcctgctttcatccattttcctacctcaccacccaaaagtcgtgaactgcagttgggcttcccagtctgaacgttgtggtgtggttccccacatgctttgaatatagaaagtagcccactgcctgaatagtccagggccactgatacactgcaggtggcatttggtggcataaaaagagatgaagcaaaataacgcacgttggtagattgcttcctttgtgaatcaggtgttcagtaacaagttttaatgagatcctgagctgaatgaatcattcctaaagcaaaccatgctgggctgtatgtatctgagtgtatggagagatttaaatgtgaaaaggcctgagtcttgtctgcgagggctcagggtgcaggtgcacagcgtctcagcatacccaggtctctagatgtacagagttagatattacagcattttagacctaagtatagcctcatgcgctcaggtcctcagtcatcctcatgcccacaagccctctgcatttacagatgagcaaataggatatccaggggctctctccaagcctgcagagc

SEQ ID NO: 18859 - DNA, 1053 bp, Homo sapiens
aggaaatacggtgattggcaaccatgatggtggggctacttgggggctgttggaaattgccagcgaaggtggttggcctagagtagctcacacccatttggaaggaaagccaatgacagtctcccccaccagggcccttgttgtctctctgaacacacaggagaacagcacgggatgttccccatcccaaagctgaaacggcacatttgctcaatatttgtcatcagctaaaacaaacagaccagaggaaccaggaagaaacggcttctctgtgtttgtagaaggacaatagttaatttcaccagggtcttgaacacatgtaagagaagagaggtgttacttcaccttggcacagggttactttaaagcacagattttttatgcttattttttatttttttggccaggaagggaagttcaattgctgtggtctgccattgtcctatccagaaagaaatgatggcaagccagatgtggtggcttatgcttgtaagcctggcactttgcgggactgaggtaggaggattacctgagctcaggagttcaagaccagcttgggcaatgtagtgtgaccttgtctctacaaaaaattttaaaaattagctaggtgaggtggcacacttgtcgccccaactactcagcaggctgaggtgggaggatcgcttgagcccaggagattgaggctgaagtgagctgtgactgtgccactgcactccagcaagagaggaagacactgtctcagaaaggaaaggaggctgggtgcggtggcctgcaatcccagcactttgggagccaaggcaggcagatcacttgaggtcaggagtatgagaccagcctaactgacatggtaaaaccctgtctctactaaaaatacaaaaaaattagccaggcatggtggcgtgtgcctatagtcccagctacttggaggctgaggcaggggaatcattttaacccgggaggcggaggttgcagtgagctgagatcatggcattacactccagcttgggtgacagagtgagactccatctgaaaaaaacaaaaaaaaaaaggggg

SEQ ID NO: 18860 - DNA, 1035 bp, Homo sapiens
atgcatttgggaagttggaaagaaatgacaaaatcagggagaaaacatccaagcttcttacctgtagatagaatcagccctcacttggtgcttattaccagttattcaagaacaataacaacaacaaaattagtagacatccaagaagcacatattaggaccaaagatagcatcaactgtatttgaaggaactgtagtttgcgcattttatgacatttttataaagtactgtaattctttcattgaggggctatgtgatggagacagactaactcattttgttatttgcattaaaattattttgggtctctgttcaaatgagtttggagaatgcttgacttgttggtctgtgtgaatgtgtatatatatatacctgaatacaggaacatcggagacctattcactcccacacactctgctatagtttgcgtgcttttgtggacacccctcatgaacaggctggcgctctaggacgctctgtgttcactgatgatgaagaaacctagaactccaagcctgtttgtaaacacactaaacacagtggcctagatagaaactgtatcgtagtttaaaatctgcctcgcgggatgttactaaactcgctaatagtttaaaggttacttacaatagagcaagttggacaattttgtggtgttggggaaatgttagggcaaggcctagaggttcattttgaatcttggtttgtgactttagggtagttagaaactttctacttaatgtacctttaaaatagtccattttctatgttttgtataatctgaaactgtacatggaaaataaagtttaaaaccagattgcccagagcaagactctaatgttcccaacggtgatgacatctagggcagaatgctgccattttgaggggcagggggtcagctgatttctcatcaagataataatgtatggtttttacactaagcaactgataaatggacaatttatcactggacaatctccctctgcttctttaatggggccagctttgcagccctgcagcctgggtagtcgcacaca

SEQ ID NO: 18861 - DNA, 1051 bp, Homo sapiens
tggcaaaatcttgtctctacaacaaaataataataaacaaagaataaaagctgaagtttgtcttcaactctggccgtatgcccctgggctacccagggtgcactgtggtccatgatttattgaaaattcacctttcttcctgacaggtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaacgtattgtttcctttaaaagccaaaaaaaaaaaaaaaaaaaaaaaaaaaagaaaaaagaaaaaaaaaatccaaaagagagaagagtttttgcattcttgagatcagagaatagactatgaaggctggtattcagaactgctgcccactcaaaagtctcaacaagacacaagcaaaaatccagcaatgctcaaatccaaaagcactcggcaggacatttcttaaccatggggctgtgatgggaggagaggagaggctgggaaagccgggtctctggggacgtgcttcctatgggtttcagctggcccaagcccctcccgaatctctctgctagtggtgggtggaagagggtgaggtggggtataggagaagaatgacagcttcctgagaggtttcacccaagttccaagtgagaagcaggtgtagtccctggcattctgtctgtatccaaaccagagcccagccatccctccggtatcggggtgggtcagaaaaagtctcacctcaatttgccgacagtgtcacctgcttgccttaggaatggtcatccttaacctgcgtgccagatttagactcgtctttaggcaaaacctacagcgccccccccctcaccccagacctac

SEQ ID NO: 18862 - DNA, 1075 bp, Homo sapiens
ctcacgcctgtaatcccagcactttgggaggccgaggcaggcggatcacctgaggtcaggagttcgagaccagcctggccaacatagtgaaaccctgtctgtactaaaaatacaaaaattagctgggcgtggtgacacgtgcctgtagtcccagctactcaggaggctgaggcaggagaatcacttgaacctgggaggcagaggatgcagtgggctgagatcgcaccactgtactccagcctgggcaacagagtgagactctgtctcaaaaaaaaaaaaaaaaaaaagaaaaagaaaaaaaaagaaaagaaaagaaaagaaagaaaatgtccttggtttttcagaaatacacactaaagcacttagttgtatggtttaggcaacttactctcaagtggttcagaaaaagagagacagtgtatgtgtgtgtgtgtgtgtgtgagtgtgtgtgtgtgcgtgcattaatccatttaaaactggggctacaatttcatcccagtgaacagaaggtctgattcgcactgtacttcaaaacatgaaactacaaattaatttttttccaaaaaaatgtagtaactatctcgtcacaaattattggaataaaagaagaatgaaccaagtgttgatattaggaggctgcatcttccaaccagatcatttgatgtgacatcttcccttgacatttgagttttgttgaccaagatgatggttataaaatactcaaagattttatcaatttttcccagtgtgacttttaattgtttgatagttaaagcattcttttgaatgctttttcctcatttattgggaacttctccagctcagacaagtcctcatgtattcatgccctcagtggcttttcatctgatctcccatgacatttttatcaactttggacaactgtagttctgttgtaagacttccaatttcactttgcaattgcttcctcttgtatgtcactcaaactgtcctgccaaagtaaagcattaccctgaaatctcagtggtttaacatccagaggtttattaattccccaatcataatatctgtccaaggtgtgaggcttcaacctact

SEQ ID NO: 18863 - DNA, 1026 bp, Homo sapiens
aaagccaccattttttcagggacactttctagccctaagttaagtcaggttttctcctctgccattagttctgatggtatttgtttaagcccagcaagagctggcaggcacagggaccatcgcttcctatctgatagttcaccagggcaccccggtaaccatcgcgatgtatccccagtgtctcagcagacccaggggaggagtgggagaagggaggcttgggtgagcattgaaggggaggctgcaagggcagggggtttggaagccctgagaagtcactagggtcagggcggctgctccctctccctcctgcagttggctctgtctggagccacatcaggcccgagtggcatgatcagcatccgtttataccagtgtgacatggggtcacattcttcccagaccagagcctgagagaggcttaatcatcgacacacccagagtggggtctgcatgcacgcaggcatttggaaatgactcctgtagcatacaggcgatgttaaagactgtattatgctcgtgttcatttcagtgtattacttaaatgtcccttggcaagtgatgctgattttccatttacagcgtaatgcatgtttaaaaatgaatcgggctgggtgtggtggctcatgcctgtaaactcagcactttgggaggttgaggtgagaggatcacttgagcccaggagttcaagactagttcaaggaacatagggagacccccatctgtacaaaaaataaaaaaattacccaggtatggtggcatgcacctgtaggaggctgaggcaaaaggatcacctgagcccaggaggtcaaggctgcagcaagctgtgatcatgccactgcattccagcctgggcagcagagcgagaccctgttttaaaaacaaaaaacaaaacagaataaatattttaaaaatgaatcaatttaagcttaatgtgttttaaggaaaactgttgaatagtgagtagaacaggtggtgcacccacagaaatgatcacagtggtgtgattgacactgagggcctacc

SEQ ID NO: 18864 - DNA, 1076 bp, Homo sapiens
cgaggcgatcaacacatttctgctgaatgagtgggagaatcactcctcaaaaggaagaaaattgtgtcaagaaagtagctggcagagccaggatgtaagtccgaagactccccgacttcgaagcttatcccgtttttctctgcggtctgttattgtcactcaaacctctggccccgaccctcttaattaatgtccctttcgactccgcgccggtcagtctccaccctccatccgcgccaggtccttcgcgctcgccttctaaaggcctcgttcctgtcagtcattccaagctccgccctcaccctgcccactttccacgccccgccccttctgggccccacccctctccgaatacaataccttctagcctgccgctgtcagtcattctgcagatcccgccccctccctcccacgccccgccttttccgggcctgcgcctctaagttcctgttgaggccttgcccttttctcacccgtgtccggagtggcccccgctccagaagcgcacagccgctggttggggcatccctgacatgaagcccctctgcccgcctgggcgctgtcggcccctggacagtctgcgcagagacaagaccacagttagagcagctcccgacactttcgccccgcgacccacgccccctccgcgagcttaccgtgaggcacctcctccattccgtcgcctttgccgccttcgtggtcaccggaacccgctgtcgtacatttccgccttgtgggcacaatctgattctccgaccgcgcgaaataagtctcggaaagggggctgtgcgcacgcgcgaaccttgggccgaaagactgggactcaacgtctgttccttttcagagatttcctatcataaatacttctgcagtgcatctcctaagaacaaagccattcttcatgacatcagtgccattttcatacccaagagatttaatatcgatgcagtactagccaatgcagtattagccaatagacagtttatatttcaatttcagttgttagaccccctcccctgctggattcactcactgcctggagttatttctcttcggtctcctttaattcagatcag

SEQ ID NO: 18865 - DNA, 1067 bp, Homo sapiens
gtgaccagcactgggggcaggaagagaaaaagccagtcactggaccagctccagtttctgcagcatattcacaaccagcattagtagcagtgaaaatagcatgatgagtgtcactgatgccaacttcagctgtttactcgacaccaagcagccttttaacaggtcaggtgctgctgcgggtatgatttcagggccatgactttgccatgattcagcctcagaactcccttgcagggctgcatataaaagcagcaggtgcagtggctcacgcctgtaatcctaacactttggaggccgaggcgggtggatcacctaaggtcgggagtttgagaccagcctgaccaacatggagaaaccccgtctctactaaaaatacaaaattagccgggtgtgatggcacatgcctatactcccagctacttgagaggctgaggcaggagaattgcttgaactcgggaggcggagttgcagtgaactgagactgcactccagccttggcaacaagagcgaaactctgtctcgaaaaaaaaagaaaaaaataaataaatgcagcaggtttacactgctgccaagtggattcaggctaaatcaactcacatcacgggtcggccggtaccagtgcagaaactagatgggggttttgcaatctctgaaccctggagacccttcctccaccccacagggagagtaatctgaccatatttcatcgatgccaagacatatatgtcaccatttgaatatcattgagatcaggatgtgtcttataaccaatagcgtgtcacagtttgcattttggcctcatattggggtcttacaatggatggcatcttagattccatgaaatatgatgtttcttaaagggtaaatcaggctgggcatggtggctcacacccgtaatcccagcactttggaaggctgaggtgggtggatcgcttgggcccaggatttcaagaccagtctgggccacatggcgaagccctgtctctactgaaaacacaaaaatagcctggtgtggtggcgggcatctgtaatcccagctacttgggaggctgaggcatgagaatcac

SEQ ID NO: 18866 - DNA, 1077 bp, Homo sapiens
gggtgggtggatggatggataggagagggagtgggtgagtgggtagatggataggagggggaatgggtgagtaggtggatggatggataggagagggtagtgggtgggtggatggatggattggggggttggggggtggatggacggatgggggggtgggtggatggataggaggtggaagtgatgcgtggatggatggataggaggggggctgggggtgggtggatggatgggagggggagtgggtgaatggatgcgtaggaggggggttgggggtgggtgtataggaggggtgtggggagtgggcagatagatggataggagaggggagcgggtgggtggatggataggggaattgggggtgggtggataggagtgggggtgggggtggttggatggatgaatggatggataggagcagggagcaggtgggtggatggatgggagtggggatgggtagatggattgatggatgggaggaatggagacctgtatttgttgatggaattggcagagcttgctgacatattggactcaggtagtgatgagggatgtggaagcacgaatgattggcagcttgagctatcagggatgatggtgccagtacccaagatgaacaagagcaaattggacaaagggtagggcaatcacttccagtctttgtggccctccctcccctgaggacattttgcaaagtctggggagagctggcattatcatttctcatcttcttcccagagtaaggtcagtggcccatagcgtggggctatcttatgcctctttctggcctcaccctggttccatctgatttgcgatttcagaaattccagattcgcaggtggggcaggtggcctcctgcatgactgcgtgcacaggtgagtgattctctcaggacgcctgatcacacctctggtgaccaggagcctgagcccagtacagggcccaatgggagtgaagctgtaagatgggattagagacagccccagagggccctgactatgctcccaaagataccagttgggaggaccaaggccagttctggaaaggtcacccacagagttagagaaatgaatagca

SEQ ID NO: 18867 - DNA, 1028 bp, Homo sapiens
gagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctaggtactgcaggcagtttatttccccaagcattgtacattttgcttgacttcatatgggtaaattttattgatggctctcattacatttagttgtggggtgatgtcaccttcgtagctcattttaagtctttagaccaccatcagtcataattttcaaagaagctaattttgtctattaaatggaacagaaacttcctcactctgaattttggataagtttgtcatttagcccatggtgggggtaagagtcccactttctaaattggcgatttctgtcacatgtctaaggtagaaccagctgcaggcagtggggacttggggactagaacaggcagggaggtggagagctattctggtgggatgtcctaggggctgatgaaagtgagccttgacagcagctttgttctaaaggagcttaaagagaaagcagtggccgggcgcagtggctcacgcctgtaatcccagcactttgggaggccgaggcgggtggatc

SEQ ID NO: 18868 - DNA, 1035 bp, Homo sapiens
ggccatagccagtaagctactaagccctgatgttcttattacgtgatcagaatgaaaaggtctgttgaagtttttttattattttagatctgtccacctcaacttctagagagggaacaccgcttaacaacagtaattcttcccttttacttgtaagtgccacttcctcttttgtaaatacatcgcttgaattgaaaatagttacttaagtaaccgagttatttgaatgaacatgacagtctcccttaaattttgtgtgtgctgcaggaaattgtgttaaagtaagacttctggaacatctagtaataacggctctgtgtttaagacttgatctgtcatagcaaattaatcggtattgcagacaatgtaagaggctttagcacagcataaacaaatcaaggaaatataagatcggggcatgtaaagcgtgtgtacttttgcagtagaacttattacttataatatggaggatcaaaaaagtcggggggtgactagaaaccaaaagagagaaaaatgtagaaagagacagtttttaagatagaagagcattaaggatggagtagtactgacctcagtttatgaagattatcttatttttcagatgaattcagttcctttcttcagtgataatgcaatatttgttggctgttttttttttttttcttcttatttttcttgcagatgaatggaccaggtagtttgtttgcttcagagaatttcctgggaatttcaagtcagcctagaaatgactttggaaacttttttggaagtgcagttaccaaaccatcttcatcagtgactccaagacatcccctcgaaggaacccatgaattgagacaagcttgccagatctgttttgtaaaatcaggtcaggaccaaacaaacacgcagagagtattaaactacttgctcataaccttgaaagttcttaggaatttgtaaatacatgttaacaacatcagttattatggttcttcaatccctattttgaattcttcctaaacaagtagcagttactgatttagtgcctttgga

SEQ ID NO: 18869 - DNA, 1048 bp, Homo sapiens
ctgacatttaacgatatctggagacacttttggttgtgagtggggttggggtgaggggctacaggcatagtgggtagaggcagaaatactgccaatgtcctgcaatcacaagacaaggaattagctagcccagaatgccaagcctgaggaactctagtttgggccactgggagatgatgttttatctcagatctcttctctgtggctctccttgaacttggggaactgctcggtgaacgttgattagtggaggtggggcccaaaagaatgatatgtgttgacatttgcaagtgttatattgaggataacattttaatatccagaaaattccaatggaagtaactttatatcattattttatctgttgtatcaacaataatcattttggaagtttgtgggacaaaatatgtataaggtttaaacttggcttacaaggaagtcagactccctcggaggcaagcggatgtgaaacctttttatttctggagagcttccagaagcaaaacaaggctggaactgttctagggacagcttatgcgtgcgtgtagacagggaaaaacaaaacctgaagccaaaggagggaagaggaaaggaaggggagacatgactttttcctggagactgctcaggaggggtatacaaagtctgcatagccattcagccttaaagaatgtgaaaactggccaggcgctgtggctcacacctataatcccacactttgggaggccgaggtaggtggatcacttgaggtcacgagttcgagaccagcttgaccagtaaggtgaaaccctgtctctcctaaaaatacaaaaattagccaggcgtggtcgcaggcatctgagtcccagccactcaggaggctgagacaggagaattgcttgaaccctggaggtgaagtttgcagtgagccgagatcgcgagatcgcgccactgcactccagcctgggcaatggagcgagactccgtctcaaaaaaaaaaaaaaaaaaaaaaaagaatatgaaaacggtgtgcttatggtgtgccggaccacaggggagccacaaagat

SEQ ID NO: 18870 - DNA, 1138 bp, Homo sapiens
ttgtgtcaaaaacaaaacaaaacaaaaacacacacacaaaggggtgtgtgttggggggagattatttcacaggtaaaactaatcaatggtgaggaaaaaagaaattacagtagtggtttggggaaggggcatgaaggaactttgtagagtgacagttaatggtctatatcttttctttatttaagagacaagatcttgttctgttgcccaggttgggttgtagtggcgcggtcagcagctcactgcagcctccaactcctgggcttaatcagtcctcttgccttagcctcctgagtagctaggactacaggcacgtaccaccacacctggcttaattttttgtagagatggggtctctccatcttgcccaggctggtttcatactcctgggctcaaatgatcctcctgccttggcctcccaaggtgctgatctatatcctgatagggctctgggtcacatgagtttgtcaaaactcacattaagatttgcgtgttttaccttaaaaaacaaaactgtaaacaaatattgatctctacttaattgtgtgtgtgctgagatgtttaggtatctgcagctgactttgaaatttattaaaacagtaagacggactgatgaatgaacagaaggatgagcagatagataaagatgggcagatgtgatctcacaaaatattaattgtgggtttgggcatacagtattataattgtttttaactttactgtgtgtttgagaactttcaaaataaaagtttttggggaaacttaaaaaactactgaacatgaaatactctgtcatattatattcaaatattgcctgatattgtgatcctagatctataaacagctaaaggggtgtattttgtgcattaaaaacgtctgtatccattttccgtttcctttcaatcacttacttgtggtgtcagctctttgccacacgccttttgtgtataaggttgaggttcaaggttctctaacactttctggggaaaatagctttaaggctataaacttggcagatatcactacccaggagtccattcttagccagcagattaactttttgagtcaacctcaaaccaattccctaccttggctagatagaggctgagagaaaggtacatcattcactgaactgtgt

SEQ ID NO: 18871 - DNA, 1030 bp, Homo sapiens
tggaactacaggcacgtatcaccatgcccagctaatttttgtggttttaatagagatggggtttcaccatgtttaccaggctgatctcgaagtcctgacctcaagtgatcctcctgcctcagcctccctgagtgctgtgattacaggcgtgagccaccgcgcccagctgagtattattctttacactctaaaccatactgtgtttcacaaaagtctcttaactgtatactttagatagtcagattctgaaatgccggtatataatttactgcataaaatgcatgtttggctgtgagtcaaaaactgcggttgaggttccagtgctggttagggagtttgttctctgtatagatcgaggtccatttaggggcttatggataatcaaaactgcacgtggtacatctatgccgtttgttaaccaacagaactgttcctgctaaaatgtttgtatggtgttttttggtaggaggcaaggagaaaacgaagagaaagaaattttgaaaaacaaaaggagaggaagaagaagaggcagcaggctaggaagactgcatcagttcttagtaaagatgatgtggcacctgaaagtggtgatactacagtgaagaaacctgaatcaaagaaggaacagaccccagagcatgggaagaaaaaacgtggcagaggaaaagcccaagttaaagcaacaaatgaatccgaagacgaaatcccacagctggtaccaataggaaagaagactccagctaatgaaaaagtagaggtattgttttaatatttactgttcataatggattggttcagtggctactgtgtcaggcaggtactgtgctgagcaataaatgatgaaaaatactagagtgaacccaaagaactgtgaaggtggttatcatatcatgatttattgtaccttttttttttttttttttttagatgggatcttgctatattgcccagaccggtcttacactccgggggtcaaaacagtcttcccaccttggcctcccaaagtgctgggattacaagtgtgagccac

SEQ ID NO: 18872 - DNA, 1892 bp, Homo sapiens
cttaacatcaggcaactttcaactttaaaaccctttgtgaaaaatgtggttatagcactatagctctgattttaggatggttaaatgttatattcattgttggcttaccttatcaaactgtgccattaatcctttcacagacataggtaaggaagagaacaaccagtggattcaggggacaattatctatctccaaataataggcttttatttcttgcagctaactttttcagtgattctagcagatgccatctagtacatccttgatcttgtttctttcgtgagagatctcgccatggcagcatcttgttaagtaagtgtaattgcacatgcacaaaagacttaactagctttacatttagcagtcagttggttagattaggtttcatagtaaatgaataggaatagaaagaataggaagtgtttttattttccagtagtaattccgtggattccatttgacccagtttactatcagttcagttcaggtagatttggttcaacttttggtggtttttggctctaggatattcttgactttaatatcctagaacttactgagtcttcccttcaataaatacacttctcacatacctctaatcctatgcttccttgaaacaataatgctagctgagttgtttactaaggattattataagggcctgaaggtgtgggagtggagattaattaaaacctttatgttctccaatataagggaaaagcaggttggtactacttctgattaggcagaaaacaccaggattccttaagtgatccttgaaatggttattgttttctgccttgtcacatttgccactgtgccctttaaaacgatgtggaaacctcaggtttgtggacagcacaggtggaatgacatcttgtgcttcctgaggctcccctctaccaggcacattagcttagtgcttcagatgtcagcccaagtccttgttacctccttttcctgctgcccagggaagagtgtgtgtgctggagctggagcgcttgcactcttcaggtgactattctcacctccatttcctccacatgcattaggtgaaactgaggtctaagcctcctgcaaggtctacattttaaggactcacacatcaggctctcagaaatgtacacaggtattagttctgtttgttctaaaggaaatgtgggtatctctcaggccaggacttagtgactagttttcgctagacagcaggttaatacctagatctcatttaaaaaaaaaaaaaaaaaacaggattaaagggaactgatcaggtttgttgagttttttagcctaattccaaagcatggaagagtgctctaggtaggaaagaaagctttttcttacgatttgtagctacctactgtgcctgacttggtgcctgtgtgaggattaagcccttagtctgctcttgcaattattcaaatgacaaattaaatttgcttttgtaataacaataaaagttgtcatcttcccttttgaaggatttgtcgtttgtaattacctgtgttgtaacaagcaaaaaccatgcccttttttgtacaatccttttatttttgtatcaggtactggaaccatctaccaaaaggtttgttggatggatctaataagctctgtcacataagggattcacaaacgtcatctgcttgcatatggcatgcaagtcttttgtataatgtatacgacaaccttaggaaacaaaaataagaaccctataggaagttagggatgctgaataataaataactagatcacagttatgtggttttatgtgaacagtagagttgggggaaacgtcaattattattagaactatgaacctctacattcaggatttttaataaagatcaagagaccaaatagtgcttgcccttttcattcaatgtgcaagggc

SEQ ID NO: 18873 - DNA, 1054 bp, Homo sapiens
ttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttactaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagag

SEQ ID NO: 18874 - DNA, 1021 bp, Homo sapiens
aaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaaggaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcctatccccagaattgtgagaaaaaaaatacagaattatgtgtctttcatttcagctatctctgccttccccccagatatgaaacactgtaccccttcttttagtagcaagaactcttttgaaagtgtaaaggagcggctgggcactgtggctggcgcctgtaatcccagcactttgggaggccaaggcgggcacatcacgaggtcaggagttcaagaccagcctggccaacatggtgaaaccccgtctctactaaaaatacaaaaattagccaggtgtggtggcatgagcctgtaatcccagctactccggaggctgaggcaggagaattgcttgaacccagaaggtggaggttgcagtgaggtgagatcgcaccactgcactccagctctgggcaacggagcaagattccgtctcgtggggaaaaaaaggtgtaaaggagcacata

SEQ ID NO: 18875 - DNA, 1081 bp, Homo sapiens
ttttctgtcgtggagattctttaaagcaggggcacgttcatattggagtataatttaggtttgtctgtatctgacaaactaaaatccaaaaagcagacttagatatttggttattagtatgtatttctcctacatctcttccagtaatgtcataagtaaatttgcagtgtggcaactggaaactggattgttgcttggttttagagttctagtataggaaaaaactggcatcattggaatcaccttttctgcagatatttttaatggcttatatatgtttcaggactttatacacatgtcatttatcttataggtatctaatttattcagggattttgataacatgagtatggaatattaaaaagggctaatcacaggctggatgcggtggctcaagcctgtaatcccagcactttgggaggccgaggtgggcagaacacctgaggtcgtagttcaaaaccagcctgaccaacgtggcgaaaccccatctctactaaaaatacaaaattagccgggcatggtggcatgcacctgtgatcccaggtactcaggaggctgaggcaggagaatcgcttgaaccggggagatggaggttgcggtaagccaagatcgtgccattgcactccaactccagcctgggcaacaagagtgaaactcagtctcaaaaaaaaaaaaaaaaaaaaagggctaatcacagctttcttgggctgggttacctagagagaatcacgggaagtagatgtgtatttgttgagcacatctctaatttgatctgtgctgagctgcaaattactttgacagtatctgtgaagaaaaggtttataaagcaaatcaaaagaataagcatgtttttatgaatacattgaaactactgaaaatgtttcaaaattggctgtaattagtagaattttgaaaagtaggttaagcagagacttctaacttgaaggcctgagttagctgccattgatctggggttattgattgaggcttgtgtcgtgttattgaacttctgtttttactgcatattaaaagataagtgaaatggatggataagtatcaatttttaatagaacttctttct

SEQ ID NO: 18876 - DNA, 1375 bp, Homo sapiens
ttttggtacaggtggggttttgccatgttgcccaggctggtctcaaactcttgccatcctcccaccttggactcccagaggtttaggactacaggtgtgagccaccatgcccaacccatttgcaacttacaatccattgtaagttgaggagccatctgtattgtaaatctaatagttggtgccaggaactaagtggtcaggtgtaagtactgttttgttttgaaaagctgttacagttagtgatacacttgagagtggtgaggaagcccaccacacccgtcattttcctgccttaagatacgcagtacatcataactgtgtgtccgtcagagcttagtttacttgtacactgattttcagcagggactatctgaggaaggggaagatggcacttgcataacttggaaatgcctgcagttgattctgatgtgcctgtatgttagatggtagtgattacaggatctgtttcctaaggcttttggtgggaatgagctagcagtcggcacttagggctcaataaaaattagttaaagcaaattgctaccccctccatcccccactccctacacaatatggatttgtgagtacttttatccttgtctggcccataatagatactcaatacatatatatatgtattcatttttattaatttttttttttttgagacggagtttcattcttgtccaagctggagtgcagtgacgtgatcttggctcactgcaacctccacctcccgggttcaagcgattctcctgccttggcctcccgagtagctgggattacaggtgtatgccacacccagctaattgttttgtattttcagtagagacagggttttgccatgttggccgggttggtcttgaactcccgaactcaaatgatccccccgcttccgcctcccaaagtgttgggattacaggtgtgagccaccgtgcctggctgatactcaatacatattgataggattgagttggagtagttacatagcagatggagacacatttgttgaatacgccaggagttctttaactgacactaaacaaattattctcccatttcctcccataaactcctcaacaatcctctcaggtagatggtatatcatttccacaatttcagtggaataagtgcaggcacagcttgtaataagccaggagttaaacctaggagtcagctcagttccaggctctgagaagtaccccatgcagtcacctccttcttagggtggcctgtgaacttgatactctcagtactacctggcttcctctgaaaactgagtaatttttccttaccttatccttaaacttttcttgaaaatggaaaagcaaaaaaaagttaatctgtattgtgttgaagtacagtttctgcctcc

SEQ ID NO: 18877 - DNA, 1027 bp, Homo sapiens
tttttacctgccatgatgtctgtggccttgactgacgtatgctgtgaggatatgctggccaagtaggattctccatattcaagtcctttgacccatgatcatagctttaaaaaaaaattgtacactcttttaaaaaattgaagcaaaatccacataacataaaactggctgggcgcagtggctcacgcttgtaatcccagcactttaggaggccaaggcgggcggatcacaaggtcaggagatcgagaccatcctggccaacatggtgaaaccccatctctactaaaaatacaaaaaattacccaggcgtggtggcgcgcgcctgtagtcccagctactcgggaggctgaggcaggggaatcgcttgaacccaggagtcggaggttgcagtaagccgagattgcaccactgcactccagcctggcaacagagcaagactcaaaataaataaataaaataaaataaaataaaatgagtcaggaatgatgttggtgttgaggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgaaccaagaaagaaggcatatgcagatttctgcagaaattatgagattttgagcagatgaggaaggctggtatctttcagtttaaagtaatcttggaatataaagaatttcttcaggttgaattacctagaagtttgtcactgactcgtgttcctgaactacgacacatgaatatgtgggctaatagttcgtcttgataaacaattaacaaacaaataaataaagccattttaaagtgaacaattcagtggcatttagtacattcacactgtgttgtacaaccagcaattctatgtagttctaaaacatttccttttttttggagacagggtctcacaccgtggtccaggttggagtgcagtggtgcgatct

SEQ ID NO: 18878 - DNA, 1021 bp, Homo sapiens
gtaaatgcctaaggtcactcacagagttaatgacaccattgagtctagaatgcagatttgctacctgctagtttagtgcttgatctgccacatcatgctgtttaataacagggggcgggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacaggagaaaaaaagaaaaacctcagcttgcaaatttttgttcagagatgggatcgttctttgttgttggagggatttacattaaaaaaattcaagaaatattgtctcatgtgatcttaccagataagtgcctattattaagacttgttggctgctggatttattatcttagcctaattttctttctgagttaaatgaatcttgcttttttatcgttaccaccctgg

SEQ ID NO: 18879 - DNA, 1034 bp, Homo sapiens
aagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttaccagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagttgcagccaaagcctgatcaccaaggttgtgtgtattttaaaaaactttttacttattattttttagagacgggatcttactttgtcacccaagctggagtataattgtgtgattatagctcatcgtaacttcaaatccctgggctcaagtgatctttcacctcagcttcctgagtagctaggactataggcacccaccatgacgcctggctaagtttttttgtttgtttttgttttttgagatggagtttcgctctgtcacaggctggagtgcagtggccctaactcggctcaccgtaacctctgcctccccaggttcaagcgattgttctgcctcagcttcccaagtagctgagattacaggtgcccgccaccacgcccagctaatttttgtatttttagtagagatgaggtttcaccatgttgcccaggctggtctcgaactcttgacctcaagtgatcc

SEQ ID NO: 18880 - DNA, 1599 bp, Homo sapiens
ctggagagtcagaccttgggattcagtattgaccttggatctctttgaaaactaaagaatataggttccttaagaaataattaagtggaacccatttaagtgtaattaagtgtaattcatttaagcacagttctctagagccaagtaaattggccaagagattctccttaaaaagtgaggtccccaagtgaataaaaatatagaagacaaggcttaatgtatattagaacaagcattttatctgataggatgtatttaagttgcaatttgcacctagttttttttattgttagataagaaactggtttagtaattttagggttacttgaactttttagaacagccagagcttctaaagtaatgatgtggtgttctttgcatcatcccacctttaatgcttctcagaactcactgccattaagaaacaagcatggaataaaaccagcagccctcagtacttacttggaggaggcactgtctccaaaacttagcagattgtattgtggaacttgaattttaaagagaaacattctgttttgtagtgttccgtatttgctgaatgccttatttattggaagaggaggttttttttttgtttttttttttttttgagacggagtcttgctctgttgcccaggctggagtgcaatggcacgatctcggctgactacaacctcctcctcccaggttcaagcaattctcctgcctcagcctcccgagtagctgggattacaggcacctgccatcatgcccagctattttgtgtgtgtgtgtttttgcagggatggggtttcaccatgttggctaggctggtcttgaactcttgacctcaggtgatctgcccgccttggcctcccaaagtgccgggattacaggtgtgaccgcgcctggccttttttttttttttttttaaatgattgacatttaacttacacactgtaaaattcacccttttcaactgtacaagctgggcgcattggctcacacttataaacccaacactctgggaggctgaggtgagaggattgcctgaggcctccataaaacatagtgagactgagaccctgtctccacaaaaaaaaaaaaaaaaaaaaaaaaaaaaatacagctgggtgcagtggctcatgcctgtaatcccagcactttgggaggccgaggtggacggatcacctgaggtcaggagttcgagaccagcctggccaacgtggcgaaacctgtctctattaaaaatataaaaattagccaggcatggtggtgcgcgcccgtagtcccagctactggggaggctgaggcaggagaatcacttgaatctgggaggcggaggttgcagtgagccgagatcacaccactgcactctagcctgggcgacattgacactctgtctcaaaaaaaaaaaaaaaaaaaaatagctgggtgtggtggcacaaacctgtagtcccagctacttgggaggttgaggtgggaggatctcttgagcccaggagctggaggctgcagtgagctatgatggcaccattgcactcagcctgggtgaccaaatgagacactgtccaaaaagaaaagtaaagtgtacatacagttcagtggcttttaatatat

SEQ ID NO: 18881 - DNA, 1094 bp, Homo sapiens
atgttgcttcttctgggaaagctctggggtgcctcccaactggcttagttacccccaccctgagcttccacggcacccagtgcttccgtgtcgtaacttcataactcatgcaacaccacaaggtcattgcctgttcccatgtctgggcccctccctagaacttgggccattgagaacaaagacactgtctcagtcatgctgttacctagcacacagtgggtagcaggggtgcattgaataaatgcctacctgaagacaaataatttttatgtttctagccctgtaatgactaagcctgctcagattctgcctctggctttgaaagagcagtatctatatatggagtttaactgtaaaactcttaattgacttttcattaggttgcgtatttaaaatcccaaataggactgaagttttaggggcgtagccacaaacacctgagttcagactgtagcatggaatcttaaagtaaaaaaaggcagtcattctaaataagacttgttcgtggatctgacaccccagaatctctaaacagaaatgaattgtgctctttccttccagcgaagggacttggcagtagtgaatctgcatgtaattgtcctggaacttcttcgtccctggatatcacattgtgcatcattagccttgagcaatgcctcatgtgtaccaagtgcccagaagcaatttgttaaatggaatattctatgattaagtgtgtacataccttatagcagcaccagcgttagcgctaaagaaggtaaatacaggagaggtgatcactttggaggaaaaataatttatggaagaccttgaccagaagtaacatgtccagtgacattcacaattacatatttttctctttcatggtttttcatttaagcagaataaagcttacacatatgtagatggttgtcttcttttctgtgcccggtatcatagttctgttcagtccatgttacttcttggctaaaaaccataaaatcactaccttgccaacccttctccctctactctcttccctctaaaccaggggtgtccagtcttttggcttccctgggccactttacaagaagaattgtcttgggccacacata

SEQ ID NO: 18882 - DNA, 1035 bp, Homo sapiens
gaggtgcttcctccgcgcccccatgatgtttctgtggtttcactttcccatgctgggcactgccctccctagacaagacctgtctgtggactctttccagcgcagctgtttagccagacgctggccccgtctgcagccgtcacaggccctctgtctgtctgctggtcatgtcatgctctcctcaaggtgccgtcctggtcctgctgttcatattgttttgttctttcccaccaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggg

SEQ ID NO: 18883 - DNA, 1036 bp, Homo sapiens
tcataagaaattgatacactcttttccaaagtggcgtcaccattttggatttcccccagcagtatacaaggcttcagctcactctgcgccctcaccagtacttgatattgatacacaccccttttgcttgtttgttcagcagttctaatgggtatgtagtggtatctcattgtggctttggtttttatttccctaatgactaataagcatcttttcctgtgattttttgccatccagatttcttatttggtgaaatatcttttcattttttccctttgttctagggttgtttattttctgactgcattttgagagttctttatagattctggatacaagtccttttaagcattttacaaatatattcttctaggttggtttttcttttcattttgttgttgttggtggtggtggtttgttgttgttgttgttgttgttgttttcgagacagtcttgctttgtcgcccagactggagtgcagtggcacgatttcggctcactgcaacctccgcctctcgggttcaggctattctcctgcctcagcctcctgagtagctgggattacaggcgcctgccaccacgcccagctaatttttgtacttttttagtagagatgggttttaccatgttggccagggtggtctcgaacccctgacctcgtgatccaccggcctcagcctcccaaagtgctgggattacaggcgtgagccaccacagccagcctcttttcattattttaacagtgtcttttcaagagtagtagttttaaattttgatgaagtccagtttatcagatttttccccttggattttgcctttggtgtcatatctaaaaaatctttgcataactctaagttgcaaatattttcttctatgttttcttccagaagttttacagttttaggttttacaattaaaatgtacaattcaagttaatctttgtatataatgcaagctatggattaaggtccactgtagcaaaaggcaggtgtttttaagtatctccctccctcccttcctccctccctccctccct

SEQ ID NO: 18884 - DNA, 1018 bp, Homo sapiens
tggtctgtgctctctttctctccttgagtactgggctttgtctctctgatttcactctcagcctcagttgcctagttttagaagatagtttgttcatgaatgaatggatagatgaataaatgaacaagtgagattgaaatatacaggcgttcattaatgtccatgagagactggttccaggacccctgagtataccaaaattctcacgtactcaggtcccccagtcagtcctgcagaacgtgtgggtatgagaggccctccgtgtaggcaggtttcaaatccctcagagactgtgttttcaagatgtgttgggttgaaaaataatctgcatataggcggacccatgcagttcaaacacagattgttcgagggtcaactgtatttgtttggaaagtagttagcatagttctttacaagcattatagtaagtacttagtaaatggtggctttaataatttttgactgacttttcagcctgaaaccatgaagaagaaaaagaaaaacaccaggctggctaatcaaagcagggttccttagtgacatcattcattcaatgctgaggcaattggcttgggccataggaacttacagcctaagcagtagctcttccacctctcagtcagcctgttaatagcttgtatttattgtcgcctttgctgctgcccctgctcatgttgagattatcatttcccacctagatacctgcctacttggtgttgctctaccagtcttttcgcctcctttactcttccttcagattgcaggcttcttaggatcagggaatctctgcttcccactgctgcatcccagtacccagtgccagtgtttattgaatgagatggctgggcacagtggttcatgcctgtaatttcagccctttgagaggccaacatgggtggatcgcttgtgcccaggagtttgagaacagcctggacaacatggcaaaaccttgtctttacagaaaatacaaaaatcagccaggtgttgtagcatgcacctgtagtcccagctactcagg

SEQ ID NO: 18885 - DNA, 1044 bp, Homo sapiens
gttagcactagttggaaggtcacatctctggcagggaccttatcaggtaccagctccatggcctcttctgctcttcctgtcttcccaggttccagccctggtgcttttgggaagatccctcccctcccctgacctcgacccctcttcagaggaaacagtgaacttccaggtgcgacttcctgcccccagattcacaaagctgtccgcgcacacacctccctccttctgtgcctctgtcagacatgtgtccccaccatgtgctccaagtcccttctcaggggccttgtgctacattttatccatgcccacccatgggcagaattccttccacctgttcaaaagaactcccacaaccccagctcgcctcttctcccaaatctttccttccttttcggaattcgaggcgtctgcagtcaccacccttaccgtggttcctcgctcactctcctctcgctgtggtccccacaccacagagcctgttcttactgaagaccctctgacccctttgccacacccaccaggcagtcttctcaccttgcctgagtgctcagtactctgacctctgttttttggagacagagtcttgttctgtggtccaggctggaatgtggaatgcagtggtgtggtcatagctcactacagcctcaaactcctgggctcacgatcctcctgagtagctgggactacaggtgcgcaccaccatgcctagctaatttttttttttagtggacattgaggggtatgtgttgcctaggctggcctcaaacccgtgaactcgagtgatcctctcgccttgtcctcccaaagtgctggcgactacgggcatgagccaccatgcctggcctcttcttcctccttgaagcaatgttttcttaaatccctaggtttgcccttctccttttcaggccacagcttcccaggctttcatgactgccctccccatccatacgaggattaaaggccggtgctcctaagttcagtctggaggcttctgtgtttactctgcaccttctcctcagcaattccattctttctcagggctca

SEQ ID NO: 18886 - DNA, 1027 bp, Homo sapiens
tgattaaccttttagaacacaaagcacattgtcacatagaaatgctgttttgaatggtgggtgtcaatgagctgtgttgtgttatagagttcaggtcaggcagggcttgtttagtgggtcaggaaatcaatgctggtagataccagcatttaaaaaaaagaggggagaaagtcgaagaaaaggacgtatgagagtgggtttcatgtagtaaaagtaggtattgtttagtgatactgttgcaatttaaaacctattgcaggctgtatgctggcattaaattgggaatccctcaggcaggggaaggggcgtcaacaacgggttaaatactggctgtgcacggcagtccagcacggtgacatcaggcaagttattttaacatgtctcaggcactgttctgtcgtattcaaaataagactgctttacaggggtaggattaaagatggaagaaaatagattaatgttttaggatatagaataatgtattaggattagagatagtagagaacctggtgcttagtaacctccctataaaccatgattggtatctgtttgtacttctttgtaatatgtaataagcagaccttaaagatatagtattaactaagccgtgtactatttagtcttccctggagtggaatttattcagagttcttgacgtttaggatctgccatttcacatgatctagcagatctttgattttaccttaaattattcttgtgtagttgagacatcaatcttaattttctgccatgaagtgtgaagaatgttgtaaattgcttaggtctttcagctgtctgtcaacttcctcaagactgttaagtatggaattgcttcccaagtctattttaagttgtgtttcatcttttaaaaaaagaagggtttcttctttttttttctttaagtaatagttctaaactttttgccaaactcccatctgcttctacttgatgccatcataaattccttcttaccttctgcacttcactacccactttttaagctgctgtgtcagcacttgggaaagcc

SEQ ID NO: 18887 - DNA, 1026 bp, Homo sapiens
ttattattctcagaaccacttactttgaattatatatatatatatattttaaattaagagactgggtcttgctgtgttgcccaggctagtcttgaactcctggcctcaagtgatcctcccacatcagcctctcaaagtgctgggattataggcgttagccaccatgccccgccccctgagaataatttttaaattatcttttttttttttcaagtttccacatacaacattgaataattttaaaattctatcaaatgttggaaattgtcagcctacaatgttgatttgcatacattcagaaattatagggatttctatatttttgatatatctgttagccttaagcctatagttattttaaagtttcgtttttataaattctctctggttattacagagtgtctcactatgggaatgtgagcctgcatttccccacactcactttttagatcctctaaatcaggtcactataataacaaaaatcttatattatgttctgagtccaggaatgctacacgttttatcttttatttttatttattttttaaaaaatttattttgctactattattttttatggtgtagagatgagggggtctcactctactgcccaggctggtcttcaattcctggcctcaagcaatccccctaccttggcatctcaaagtgctgggattacagatgtgaggcaccatgcccagcctgcctatttgtctgtcttatctatgtatctatccatgtatctatctatctatctatctgcctgcctgcctgcctgcctatgttatttgtctattgacctgccactttaggataaaaagtatttataaaaataaaacaggtacatatttatgacagaaaatttggaaaacacacaataatgaaacataatcacccagaaataattatgataacattctggcatattttcttacagtatcattttcattattttatgtaggtgtaatcatactatagatggacttgaagatttgcttttctcattaacagttgagaaatgttctc

SEQ ID NO: 18888 - DNA, 1195 bp, Homo sapiens
agattggtcatttcatagttgctttccttgtaaaggttaaagcagagggaactcaatttatcatgtcgtcaggtaaaactggcttgtttggagattcagctgtttactctcatttggattccccacaaggtcatatagagaaattagtttcagcttggtgacatggaactttaagagtgactccatttcagttaggtctgttgggcctagtgcaggagctcagtccaaaccattgacctctatacattttatttaacaatggagactttatagaatatagctgcaagactggagtgtttgttgttctctgccttcctttcttcaccagggtgtttgacccaaagccattaggaagaggatttctgggctgtctactttttatttgcttttaaaggagaggtactcacctcagagcttcaggagagtcattctggttcttgcctgacaagagaaatgccacaaaaatgggctggctgcagggaggcccggccactcctggcccaactttaaccctggcacagtgaccgtggacggctccaagtactggatagttaggcaaatggagacataggatggctacaactgttgaatttgactttaattgaagatgatgttgcttttttcttttcttgatagtttattttctgcagatgaatctccttattgtggattacacccttgacttttcctttgtgtgatgaggtttgggaaaaccagggatgtatggtttactttgccagcctgttcatttcagctgcttattaacttgcatcttggcccctttagaaggaagcggcctgagatgggagctgagtaaaaacagtggatgaggccgggcacggtggctcatgcctgtaatcccagcactttgggaggctgaggtgggtggatcacgaggtcaggaggttgagaccatcctggctaacatggtgaaaccccatctgtactaaaaatacaaaaaaattagccaggcgtggtggcaggcacctgtagtcccagctacttgggaagctgaggcaggagaatggcgtgaacccgggaggcggagcttgcagtgagccgagatcgcaccactgccctacagcctgggtgacagagcaagactccgtctcaaaaaaaaaaaaaaacagtggatgatttatttaattcttttggcaagttcttgggaaaagtaacatgtagaaaatttggttat

SEQ ID NO: 18889 - DNA, 1051 bp, Homo sapiens
gtagatactgtaagaaactttttaaaagcagaaattgataaagacactttagaagaggcaggaactcaacagttattttgggtcataaaaagttacccagtaattataaataaaataaaagcccaaattcagatagttgtatgaattcctgataccctgccttagaagctttttcaggatgatttttgggatgagggaagacacttggctttgcctcagtctaaattattgagtgtgcttatgttaaattgtgtttttaaaaagcacagcttttgattatgctgaacagataaatattagaattgtagagacaactctttcaggatgattgttcagccctgaatttgctaaaaggctgcttataactttgaactttacctgtgctttttattatccttttgatgtttgcagaatctgtagtgataactggtttttattcgtgatattactcatttgtgtctcatttttccttgttcattccagtcagctgttaccattttgttgatctctctcaagaacgcttttggctgtgttcgtttctctgtattgtttgatattgtctattttgttggtttctgttttttttctccttttacttgcttgggtttactttgctcttcttttctcagtttcttgagctagaaccgtatgtgattggttcttcttttcttcttttttctaaattctttttaaaaaatttaagcctggcgtcctcgaggttgttggtaggtcaacatattaatatcttactgattagccagtgattggtaagaggtggtgctgaaacaccttgagctggtaaagctttaaccctttgccagctaagttagggaacagactcaacattccggcagcttacaagtctgccccaatgtttacttttgtctggacctctgtcctctgtgggcgcacaggccttatggtcagctagctatgtgtacatagctaagactctgcaagtcattgacttgaaccattttccttttctaacagaagcatttaaagctataaattatcctctaagtactgcgttagttgtatgttaactgtt

SEQ ID NO: 18890 - DNA, 1047 bp, Homo sapiens
cccagataatatcatcaatcccagatattatcattttagtagatgttaatataataacatctactaagattccttttccaactaaggtagcactcagaggttccagggagtagaaagtggacatatctttttggaggccaccattcagcccactgtaggcaggttagtagtaaagtcagcattcttagctatttccagccttgcattggtcctggcttggagcaagtgggtaatagttatttccaagactatttagcatttaatttgcagtgttcaaggattagcagtatactctaagaaatttgggctacctatcaaatagcttatcgattgaacaccttccactatgcacagtatgtcacctgcattgactgttttttctaaaggcagccctcatagataggggaaaatgtgcccattttaaagccgagacatctgcctagggccccaggagtggcagagtcagggataatcaagcctgtgctccactaagaagggattcttcttccatagcacacagtgtctataagggacaatgctgtagttggtggcatatctttttaagagacagtgttagtgtctttgaaagaagatttccgtttctctcaatgtttggcctgagcacagactgtaaaagatgttgacttagactgttggattgtgtggggcttgtttcctctgacactttacagtatgttgttttacaggccctgcaggcattgcctttgtataatgtttaatttaatgtttttagttgatgtaatttgatatgcttcatttggagactgttgaaatgagctgctggttttgtttttttcttcctttgtttttttttttttgcctttgtttctagtgtatgtatttaagaaaggatatgagttggcttcaggacaaatgttgagtaacgctctatttgtcaaaacagcaagtggctagattgaaaactgtattccccccacctgagtgaaattaaaataactgatgccacagtcactcccatctagccagtggttacccttattttacacaggagccttagtgagcaaa

SEQ ID NO: 18891 - DNA, 1034 bp, Homo sapiens
tcgtcaccccaaacagaaactctgtaaccagcaagccagtaactccctatcttctgcctcccctcagctcctggttacctctaatctgtctatgaatgtatccttttgtgaactgttctttttgagcaactcattgcttcactgacattttaatttattaaaacaatgatattttgcatcacctggagcatttttcttttgtaattgtattactgccttatgtttagatcacaccttgggcacataaactttaagatacatagatgtgtatctgtgcaacatctcagctagggtggcttatgcataaggcagcaggagcataagggaaatagctgaggcttcagggtgggtcggttggattgatgccaccagacgggagatttgtcttgccaaagctaggtttctagtctttcaactgtagatcataatctccacctggttgggcagcagcgctgataaggctgtttggtgttgggtgtggcatgtagaaggtgtgcagaaagggtggttgttactgtgacttacactgtagtgaacttgaagaaaataatggaaatcttgtttctcatttcatttcgtttttttaaattcttttttttttttaaatttgtatatattttttgagaagtctcctccatcgcccaggctggagtgcagtggcgtgatctcgtctcactgcaaccttcacctccgaggctctagcaattctcatgcctcagcctcctgagtagctgggattacaggctcaagccaccatacccggcaaatttttgtatttttagtagagacggggtttaaccatgttggccaggctggtctcgaactcttggcctcaagtgatccgcccacctcagcctctcaaagtgttgggttttcagacatgagccactgtccccgcactttttttaaaaaatttaatttaatttaattttttttgagatggagtcttgctctgttgccaggctagagtgcaatggcgtgatctcggctcactgcaacctctgcctcccaggttcaagcgattcccctttctc

SEQ ID NO: 18892 - DNA, 1030 bp, Homo sapiens
tagcttttcagcagccccctctcccgccccagtaccaatttactgtattagtctattttcatgctgctgataaagacatacctgagactgggcaatttacaaaagaaagaggtttattggacttacagttccatgtggctggggaggcctcacaatcatgatagaaggtaaaaggcacatctcacatggcagcagacaagagagcttgtgcagggaacctcccgtttttaaaacaccagatctcgtgagactcactcactatcaaaataacagtacaggaaagatccgcccccataattcaatcaccttccatcacgttcctcccacaacatgtaggaattgtgagagttacaattcaagataagatttggatggggacatagccaaagcgtatcatcttccgtcgaggttataaggattgtatgagatttgaaaggactttgatagttcctagaacttaataagtgcccagcatatattcttttccgtttcttgaaatataaggggtgcggggaggattggggagatattggtcaaaggacacaaaatttcagttagtaggaataaattcaagagatatgttatacagcatggtgactgtagttactaacagtgtattgtaaacttgaagattaccagaagagtaggttttaagtgttttcactgcaaaaagtgagtatgttaggtaatggatatgttagtctaatttagccatcttacagtgtatacatatttcaaaacatgttgtacatatcaatatatacaatttttagttgttaattaaaaataaataaataaggttgggcatggtggctcatgcctataatcctagcactttgggaggccagggaggtggattgcttgaggccaggagttgaaaccaggcaggggaacatagcgagactccatctcttaaaaaaaaattagctgggaatggtggcacatgcctgtagtcccagctactcaggaggctgaggcaggaggattgcttgagcccaggaggttgaggctgcagtgagccatggttgca

SEQ ID NO: 18893 - DNA, 1060 bp, Homo sapiens
ggctccctgcaacatccgcctcctgggttcaagtgattctcctgcctcagcctcccgagtagctgggactacaggtgcgtgccaccatgcccagctagtttttttgtatttttagtagagacagggtttcactgtgttggccatgatggtctcaatctcctgacctcctgatctgcccgcctcagcctcctaaagtgctgggattacaggtgtgagccactatgcccagctgattgtttttatttttgttgcaagcggccttatttctcatctttgagtttagcaaattccaggcagcatttcctgtcccccttcaaccttcagcccatcctttaaaatgaacgttggcacgttttctataaagggccagatagtaaaatattttcagctttccatgctgcatagtttctgtcacaactcttagctctgccactgtagccccgaaatgccatagaatacgtaaaccaattggcatagccgtgttgcaataaaacttcatttacaaaataattggttggctgtatttggcctatggaccatagtatgccactggactaatctttttcttattttaaataatttttttttttttttttagagatggagtcttactctgttgccaggctggagtgcagtggtgcaatctcggctcactgcaacctccgcctccgaggttcaagtgtttccccggcctcagcctcccgagtagctgggactacaggcgtgcaccaccacgccctgctaatttttttgtatttttagtggagatggggtttcaccatgttggccaggatggtctcgatctcctggcctcatgatctgcctgccttggcctcccagagtgctgggattacaggtgtgagccactgtgcccggccttccccatatctttttaataaaatagagactaggtctcactcttttgtccaagctgatctcagggtgctgggctcaagcggtcctcctgcctcagcctcccaaataggtaaaaccacaggtgtgcactaccacgcccagctaaaagattaatattttgttacttctagattggaagacacct

SEQ ID NO: 18894 - DNA, 1065 bp, Homo sapiens
tgtatggactcagggattttttttaattattagtattaataataatactagattattatctaggatttttactgtttactttgttgcttaaattgtaccacctttggccattggagcttctttgacttggctcctgtgccctctgaacaagccccccatccttttctgagcacttctttgctttctggtattcttgtagtttctctggctcagctatggaatgaatgacttctccacggagctctggttcctcttaatggggaatgatgtttagaaaccaagatctggccctaggttactgcttctggccctaggtgatattattgcttctaagccctctcactggacagaactaagaaccatatgtatgtagacctaggcatgtacacacacagctatatttctgtgtctctctgtatatgtatgtgtgtgtggatctatataaatgtgtatgtagctgggcatggtggctcaaccctgtaatcccacacttagggaggtcaaggcaggaggactgcttcaggctagtagttcaagaccagcctgggcaacatgggagaccccctctctacaaaaaatgtaaaaattggctgggtgtggtggctcgctcctgtaatcccagcactttgagaggccaaggcgggcagatcacgtgaggtcaggagtttgagaccagcctagccaacatggtaaaaccccgtctctactgaaaatccaaaaattagctggtgtggtggtgccacctgtaatcccagctactcaggaggctgaggcaggagaatctcttgaacctggaaggcagaggttgcagtgagctgagattatgccaccgcactccagcctgggcaacagagcaagactgcatttcaaaaaaaaaaattaaaaaattagccaggagtggtggcacatgcctgtggtcccagctgtaggggaggctgaggtgggaggattgcttgagcatgggagtttgaggctgcattgagccatgatggtgccattgcactacagcctgggcaacagagcgagaccctgtctctaaataaataagtgtgtgtgtgtttgtgt

SEQ ID NO: 18895 - DNA, 1078 bp, Homo sapiens
agatgctgaactttgcatcagggaagctttaaggccatagaaaccctctcaaggtttcatgctgtctcactgccagctgcaggcttgtaaacacaggggcgctgtagggaaggcccctgctgtcctcattccgggataaacagaggtttacagagccttgtaaaagaagagggttggctcacgaggacttctcttgctcaagtaagtggggcgattaaagtcgaatagaaagttggaaagatccggagagaaacaatgctgtgagcctcttcagcagtggctgagattacaggtatccagaaaagcagagttgagtttctggttccatttgctcatgttgtgcacacctagccagcagacttcagataagtggtggttttgattgaggcgggccctaaaattcagagatacggaacataagttggttttgagctcttttgtagccgtcatgatagttcagtcagcttttccaagattggacatttgtttgtcttatacacattcggataccttagcttgctgtacctgttttcttttctctgacatctttcttctacagaatattcataacatgttgctgaccgttggtagtcaacatcccaaagcatactaccaaaaagccctgtttattagcgatccggacatttaaaatttttgagtcttgaatgaaagttgactaaagtaaaataagatgcgtaaatcccataccttaaatatatatatatatatattttttgagccggagtctcgctctgttgtcctgctggagtgcagtggcgcaatcctggctcaccacaacctccgcctctcgggttcaagcaagtctcctgcctcagcctcccaagtagctgggattacaggtgcctgctaccacgcctggctaatttctgtatttttagttgagacgggctttcaccatgttggccaggctggcctcgaactcctgacctcaagtaatctgccttcttcagcctcccaagatactgggtttacaggtgtgagccaccatgcccggctgtataacttggatacttttgaatggtattgattgctgttttgtcagaagtccgccagttgg

SEQ ID NO: 18896 - DNA, 1818 bp, Homo sapiens
caccagggttacaaacaagagcccactgctggctccttgttttgtaaataagatttgttggactacagctatgcccgtacatgtacattttgtgtatggctgcttttgtgccacaacagcagggttgagtattgcgacagagacccccattgcccacaagcctaaaacatttgccatcgagccctttaagaaagagtttgctggccgtgcgcggtggccgtggctcccgcctgtaatcccagcactttggaaggctgaggcaggcggtgaggtctggagttcgaaaccagcctggccaacatagcgaaaccctgtctctaccgaaaatacaaaaattagcctggtgtgatggtgcacgcttgtaattccagctactcgggaggctgagacagaagaattgcttgaacctgggaggcagaggttgcagtgagctcatattgtgccattgcatgccagcctgggtgacagagtaagactgtctcacaacaaaacaaaacaaagaaaaagtttgctgacctctgatctgagctcttgtctcttgcctggacaattgctcctgacttgtttcctaacttcactctcagagtagtcatcatggcctttgaaacattatgcaggtaaggtaattatcttgcttaaaatcttctaatgttgtccagccactgttagaataatgtacatttcttacactggcctgtgagggcctgcagaatcttgctccatactctctccaatgtgatgctgtaccattccatttttgctcatgacatctggccacaccagctccttgctgctcctggaaccgtccaagccatttccatgttctgggtattaatacttgtttcccctacccgaaggactcttcccctagctcctttcgtatccgacttattctcatcctttgggttttccctgactttcctgattttcttgtcagaagtagttcccttcactacagagcaggatgcatcagcttgtcactgttcattccccagtgcctaatataatgctttggcacagcataagtgccagataaatatttcttgaaagaagactgaatgaatggatgaatgataaacacatttcaaaatcatttgcctttctgttcattttttgagatgtagttaaatatggtaaatctttcctgagtaatttagactctttggtttgttaaacaaattttatgttagacagttacttctgctaatgcattctttttaaaatcgtgtttaggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtgtaagttcctaaattaaaactaagcgtgcattgtgtgctatatattggggatgacaggcatctatatctcaaacctgtgctttacaaacatagtacacacacgggtgtgatgttgtgaatggcaggatataattgtggcatattaaaaaaaaaatttttttttttttttttttgagacagtcttgctcttttgcccaggctggagtgcattggtgcaatcctggcttactgcaacctctgcctcctaggttcaagcaattcttgtgcctcagcctccagagtagctgggattataggcgtgcaccaccacacccgcctaatttttatatttttagtagagacgaggttttgccatgttggccacgctggtctcgaactcctggcctcaagtgatctgcccgcctcagcctctcaaagtg

SEQ ID NO: 18897 - DNA, 1029 bp, Homo sapiens
cactttttttgccagttagttttagcatctattgatagttcttgctttaagcaattatcgttgactgatggtggttttctacgttcattgttctttctacaaattccttagtgtcccatggctttgttgttattgttgttttgagactgtctcaccctgtcgtccaggctggagtgcagtggcgtgatcttggctcactgcaacctctacctcccagattcacgtgattatcccacctcagcctcctgagtacctgggactataggcgcgtggcaccacgcgtggcaaatttttgtactttttggtagagagagggttttaccatattggacaggctggtcttaaactcttgatcttaagtgatgcgccctcctcagcctcccaaagtgctgggattataggcatgagccaggcgcccggcctcccatggtgttttgttttttttttttttttgagatggagtttcacccttgttgcccaggctggagtggaatggtgcaatcttgactcaccgcaacctctgcctcccaggttcaagcgattctcctgcctcagcctccagagtagctgggattacaggcatgtgccaccacgcccggctaattttgtatttttagtagagacagggtttctccatgttggtcaggctggtcttgaactcacgacctcaggtgatctgcccgccttggcctcccaaagttctgggattacaggcgtgagccaccgcgccccgtccccatggattttaataccacccgtgtcccaatgataactaaatgtatatctcaacacctttctcttgagctataggcttgtaactgcagcttttaatttgtgtattcccttagatgatttaacatgtccgtggtagggcgcggtggctcacgcctgtaatctcagcacttttagaggctgagatgggcagatgacctgaggtcaggagttcaagatcagcctggccaacatgttgaaaccttgtctctactaaaatacaaaaattagctgggtatggtggcgggcgcctgtaat

SEQ ID NO: 18898 - DNA, 1057 bp, Homo sapiens
gggtggtctcgatctcctgaccttgtaatctgcccgcctgggcctcccaaagtgctgggattacaggcatgagccactgtgcccggccagtgttttttttttttttttttttttgagacagagtcttgctctgtcacccaggctggagtgcagtggcatgatctcggctcatggcaacctctgcctcctgggttcacaccattctcctgcctcagcctgctgagtagctgggattacaggcgtgcaccaccacgcctggctaatttttgtatttttagtagagacggggtttcaccatgttggtcaggcgggtctcgaactcctgacctcttgatccgcctgcctcagcctccgaaagtgctgggattacaggcatgagccatcacactcaacctgttttttgttttttttttaagaggcagagacttgttctgtcacccacgctggagtccagcggtgtgatcacagctcactgcagacttgaactcctgggctgaaatgattttctgattctcccacctcagcctgtgggatagttgggactacagatgggaaccaccacacctggctaatttttaaattttttgtagagatgggtctccctatgttactcaggctggtctcgaagtcttgggctcaagcgatcctcccaccatctcctaaagtgctgggattacaggtgtgagccactgcacccagcctaatatatacttattttaaaataattttattattattatttttaattgaaatggggtcttgccatgttgcccaggctggtcacacaaactcctgggctccagcgatgcaaccacctcagcctccggaagtgctgggattacaggtgtgagccaccatgtccagcccagtctaatgtttttatttaaatctgggaacatattttggctcatgctaggttcgagatatatttgtttcgtaaggcttattattgggaactttccttttgatcttttttgttttgaggcaaggtctcactttgtcactcaggctggagtgcagtggcatgatggtagcccactacagcctcaacctcctc

SEQ ID NO: 18899 - DNA, 1184 bp, Homo sapiens
cgaggccaggagatcgacaccatcctggctaacacggtgaaaccccatctctactaaaaaaaatacaaaaaaattatctgggcgtggtggcgggcacctgtagtcccagctacttgggaggctgaggcaggagaatggcatgaatccgggaggcggagcttgcagtgagccgagatcacgccactgcactccggcctgggcgacagagcaagactctgtctcaaaaaaaaaaaaaaaaaaaaaaaaaaaaaaagtcatgctctttgatccagcaattctagactgactctgaaaatccatctgaggaccataaccctaaataaaatacaggaagagctttatgcacagagaagtccttaacagcactacacaaagaacattacctgaaaatggtcacagaaagcaagagaatgcaaacactcttagttgtccaaaagggcaacagttaattactatatattcacttgaaggaataccatgaagacattaaaaataaactatactttgaaaaattattattaaaatgatatattcctgttttaacaataagtgaaaagagccagatacaaccatataaacacaaacacacccccttcgattaaagtctgggaaaaaagagaaaatgttgactgtggatgcccctgggtaatctatcccatattccttatttctaaattcagtaatttttacaaatatgacaaaagcatataagaccatctttcttttcactcagcaagaacagcaactagacaaacgggtcaactttaaaactttcagaacaaaataagacattatttctttaaaatagccacctgataccacattacctgattacaaaggtattggcccaggccaggtctagcagcagcactaagatatatgacaggcttcttgttatataacacattgaagccatccactacgaagtcttcatatcgagaatgaatggcaagcctacatatctttgcaagtccttctctttcctcttcgtggaaataagcacacccattttcatatctgttaagagatacatattaatatgctcttatttctagttaaggattgtataagtcaaccttataatcatggagacaattcttttctcaagctaggaattgtcacttttatcaggcagagaggacaggaatgtgaaacatcctcatcatagatggctgacacctcat

SEQ ID NO: 18900 - DNA, 1095 bp, Homo sapiens
aggaattaaacattgtatggttcaaatttcttcgcttcagactcactgtataaatataagcaggtttttttgtttttgttttttgtttcgtttttttgttttgtttttttactggagctgccacaattccactgaaatgtggagaaaatcattctaaagttctaaaatcattcaaagttgctgaggttcaaaaaaagttatattttgaaaacagatgaacttatatactataccaagattttgatgtaattcactttcttcaaactttcctgcaaccgttgactctgcaaatgacaaaaaataacacatgtaattagatggacgtgggacatgaagaagtggttttcaccaggggctgtggaggtctgtgaacacggatgtcaggcaaagtcacctgccacttggtggtttctaagttcagccacctgtttttgtatttcaacaactgtaaatattcaccaatccttcaagttacatgtagtaattcaagaaaagcagtttctaataagacatggaaatctgttgtatttgcaatgtaagtctgtcattcaaaagctactgagtataaacacgtgcaaggcacagtactgaacactaggggagaccaacgacaaatgagaggatgcagcacgctcaagagctggtgataagagcacagtgctgccactcatcacctgcaggaccacggataagtcaattcatctgccagtcaccagctatgtaacctgtctatgcttcagttccctcaattataaaatggggaggatagtatgtatctcacattgctgtgaggattaaatgagttgatatgcaatacaggaagtgcttagaaacagggtctagaatgtagtgtcattagactaatgtctcaatcccaggtccctcatcactaatcatatctaactcatgggattggagtatattaattcaacagatattcactgagtactggacagtagaaagcccctcaagaaattcctttttgttttcttaaagaaaattaattctgaatacactgtcatcagtggaactgacattctagtgaagttgcagggatcaaatgagatgatgcatgaaagtacttcatggtgcctg

SEQ ID NO: 18901 - DNA, 1047 bp, Homo sapiens
gagccccacagcctgcccgtctgtatgctctcctagaggtctgagcagcagcggggcactgaagaagcgagccacacccccatcacatgccctgcgagggggacaagggaacctttccggtttcaacaccatgtgacttccacttataaccctctctgccaggtggagaatggtctggaatgggctgtgtagaatgtatgaaagtcagaggtcagttgacaggggacaatggccaaccaggtaaaaaaagagtggtgccctggactagactggtggcacttgggtcattctttaagatacagattcctgggcacaacctattgactcaaaatatgtgggaagtaagacccacaaatctttatgttcaagcaactctttcttagccattccagcactggtccagggactggcatttgggaacccctggtttaatcaccgcaaactatcagcaaattgctaaggcgtttcggactgtagttttcatgaaaattattacatttttctgaaatgctgactgaagattgtcagcaataaaaatattttgaactatttaacttgaaatggtatcaaattcaaagcctttaacacagatatgaaaataaccctcttttaaaattcaccgacctgagcctggtaattcctggaaaaatctgaacaccaccactggggagctgagctcatcttccacctggaagaatggaagtctcatatcaccaagtaacattaaactccagacgccttcaaaatgaaatgctgagttcaaaaactcgcttagaaatgctctatttgtaaataaacacactaaaaagttcagaggttaatttcagttgctagagaaaaatcaaatgtttagtaaaattttaaaaaataactatgagccagccttgagagtacactgtgaattataagatgtttgaccctggtacattgaaattaaagcagggggaaattttaataagggataaacataggtctaacattaaagattaaaaccagtaagaagcagtgaaactagactcagtgcggagagagcccatgctttcaaga

SEQ ID NO: 18902 - DNA, 1040 bp, Homo sapiens
tcctaggagtctaaaaaggaaagagagagttctctgggagagatttgctagtcaatactggtcgattctaaattctccctctgtggtctgtgccaaggctgggctggcttcatggacacgtgacccatgcaggcccaaaatggtattttcattttcctatcatcttggcccccgcagggggacgtaatcaatgccattatgttgccacacactctgctccgtggttctcagaacgtgcttgtcagctcttcctgatctgttgtagaactgtgatcgctcagggagtcagaggcaaacctggtggcccagtggcaaagccatggtggtcgcagctctccttactgctactacttggagtttattatgaggccccttgaggctgtgccctatgttgggtacatccaagcttctggttcatcccttaggaagattttgtgtctgagaaggcagcgtaaagtctggcaacactttgccgagcgtgaattcgcccacttgacgggctgtggaaaagggggttagtagatgagtgtgggaaacactgggttcaagaaagttagttggatttttcagtcgcaggacttctcaagagcttcactgtgcaatgcgcagtgtgactcctaaggagggcttccagcaggcagttgcccagtctttttgttttgttttgtttttgttttagagccggggtttcaccctgtcacccaggctagtctcaaacttctgggctgaagcattccttccacctctgcctcccgcgtagctgggaatagaggtatatgccagcacacctggcctcaaaccttttttttttttttttgagacagagtctggctctgtcacccaggctggcatgcagtgatgcaatcttggctcactgcaacctctgcctcctgggtccaagtgattctcctgcctcagcctcccgagtagccgggattacagacgcccaccaccacgcccaacttacttatttattttttccccctgagacggagtcttgctcgattgcccagagctggagtgcagtggcgcgatctcag

SEQ ID NO: 18903 - DNA, 1031 bp, Homo sapiens
ccgtcggctcgcgtcttccccttgaggggtcggggagtttttgccttctttagacttcagcgggctgccccggaggccactctctgacaagggaggggacgggggcccagagaggttaggtgacttgcccaaggtcgcacagcactgcggctcggggacacgccgggacccccattccccgacggggcggctgcagcccccatagggctgggtccgtttaggcaaatccggccgcccgccttcggggacccgcagcctgcggtgaacgttgcttcgtccttgcgtccccgtgaagcaggaggttattccagggtgggcttcggagagcgtttggcctgggggatcttggcggggacccccagtccttcctcctctctctcccctacccccggggcgtagggcgccgagttatttttagccgggagagagagccctgctttccgcagctgggccataggaccacgccctgatgcacgggttttgtttttgttttttctgcttttgtgctcaaatagatctctgaactcttgtccacgcttatgcagggactgttggcaagggggttctcaggttttaaaaagagcggggcgtggcggcgggggcagacgtcctatttgccatagatcctgttaaaggggaatcaatcagttccttgatttgagagtcaaatatcgagcccctaatatctgttgggcaacgtactgatcactgtccctgccctcggagtgtttatagtctagaagggagaatggtttctgatgaagaaggctcagatactataaactgttaagtaccataaagaaaaagcgtcccctttcactctgagatgggaagcacaggaacctgaccaagtgtgttgggttggggaaggcatttagaggtttcatctgtcacagctgtacagtttgtgattattttgtttgcttgtttgttctctattggtctgtcgccagaatgtaagcctcctgaaggcagataagagtagtgtcctcacttttgtatcctcagagtgtaggacggtccctggcata

SEQ ID NO: 18904 - DNA, 1042 bp, Homo sapiens
cctgaaaatgaattaataaaatattttgtagcaatagaacaaaggacaaaaaccacataatcatctcagtagatgcagaagtgtgtgacaaacaccaatatccttttacgagaaaaacagaaggaaattttctcaacctgataaagggcatctgaaaaacccacagctaacatcatattcattggtgaaagaccaaaagttttttcctaagacaaagaacaaaacaaggatgtccgctcttgctgcttgtctagccaaggcagttaggcaagaaaaagaattaaaagcatccagatggaaaggaaggcgtaaactctcttttgcaaggtgattttatatgtcattctaaggagtttacacacacacaagaaattttagagataataaatgagttcagcatggttacgggacagaagactaacatacactaaccagttgttcaagacaattgaataggggagaatagtcatttcaacaaatgctgctggcagaagtggatatgaacatgcaaaagaatgaagcatatggatatccatatttaaaaatgaactcaataaaagccctacatgaagagtaaaaactgtaaaactctgagaagaaaacgagtacattttcatgatgttggtttaggcagtaatttccagatttgatgcctaagcacaagcaaccaaagaaaaaaatgcatcaattgtacttcaaaattaaacgttgttatgcttcataggacatcttcaagaagatgaaaaggatccccaaataatgggaggaaatatttctaaattttatgtctggtaatggacttgtatatgtaaagaactcttataattgaataataaaagggcaaatagcccaactgaagtgggcaaaggatctgaataggcatttctgcaaaaaaagcacatgaaaagaagctcaacatcattagccatcagggaaatgatttcacttcatgcccacaaggatggctataatcagaacgagaagacagtaacaagtgttcacaaggatatggagaaatgggaagttggaactgtcatatgtt

SEQ ID NO: 18905 - DNA, 1076 bp, Homo sapiens
gcttccatgtgacttgtaagtgtgccttgttttttatttaaactatgtctgtagttgacaaaagtggcttcatcacaaatttttttaaacgtttctactttggggttccatttaggagctttctagaaagttgaggatgtttgaagcttcccttctgtgttccagtttgatatgggttaggttaaggaaaaggagatggtctcgatgtcatggatttaaagtcagcatttggattacaacacacattattgtgtgtcgagaggcagcattggaaagagcctgattttctaaaatatgcatcaagtgcataaattacaaatcagagctgagtggggaggtgcttcagcagcagcgggatcaatacgatttccactgggaagagacaggaattctacctacacataggaaggccaaggttgatccacttaaccttgttattgtaattttaaagctggtatcggtagctgggaagctttatgtgtgtgtatgtcagctcagcatcttttaatcgtgtctgattttactctcgttacttctcgctgttggaagcatctctgggtttcttgtggcgtctggtgtggaatggccttcctctctaggtgcctgaggtgtccgctgacgggtggcctctcacccccctctagagaaacctgacatttacaatggattgtatttgtccggcaaaaaaggcggattcattcatagagcagaaagaacctgttggcgtaaggtcttccactagttagatggtttcttttggggaaatgtttatatttggtaacttctagaaagccagaaaatggactctgatttcatagcattttgataaaatgccacaaaataagggctatagagagatttttacaagtcagattttttgttccccaaatcttttaaatgaagccagtgactcccagttctcaacacatggccccagtcaagacagaacaccatggaaaaaaccctgtaagtattatggcactctccgaatcctcctgaaggcatttcctctacagacatagtgttacaggaagtgaaatgcaaatgtgcaattttttttaaaggagcttttaaac

SEQ ID NO: 18906 - DNA, 1055 bp, Homo sapiens
gagtaggccctctctcacctccccagcccgccctggggacgcatatgggcaagtcgggtctgcacagaagccatgtgagtgttgcttagagtctagcctccccatccctaccccccttcgagcacagcaacccacacttcacaagcttggaccactggccatcagctggccagtctgtgtccttcttatagtggggtttggaaagaatgaatgaaaaataaagagaatgatgcaatttcctcccccattattatcttgttgagagttttcagttatggaccggcagggggaggacagtttctgcttccatgttggtctggtgtcccaaagacgctaaaaacaaacccacttgctttatttcagtgtaagagaaaaaaattagagatttttcatctgttggtctcattaaccaaaatgaagtgagctgagttgggtataacctagggtgtctctcttgagctctgaaaagtgtgaattctcgttttccccaggttgccgatatagaatctggcagacagattcagctgatcaaccgaaagtctctgcgatctctcactgcccagttgctggtattgttgatgtcttgggaaggaaccacccatctttctgttgaggagctcaagagacattacgaaagtacccacaacactccccttaacccctgtgaatatggattcatgaccttgaccgaactgctgaagagcctgccatacttggttgaggtaggcacgttaatggctctttagaactatcattgaaaactatcgattgggcatttccggattacctgatggtctagattagagtgtgtagagctggaagggacccgagagaccatttcatggatgaacacgccgagacctcaggcagtgaagcagccctgcctaaatgggtggcagaagccagtgaaagcctggtctcctcatcctggcactggggtgtgtttgtcccgttctaggatgaaagcctggtctcctgatcctggctctggggtgtgtttgtcccattccaggatggatttcgctactgttttatctttctgaatgagatggttt

SEQ ID NO: 18907 - DNA, 1051 bp, Homo sapiens
ccaagctgattgagttattagaagcagtgcctcatgtattgcaggtaaggcgtgtcacgggattacttgtttacaggcaggaatgttcctccatggctttggctgcctccatcaaagaaacagtttaattcctaagaagtcagttctgggcagaacatccactaaaaactttcttcagagggcaggaataacacacacaggcggcttctcaatttttcagaacgctgctagtttccagttttagaggaactccttggaggactgaggagtattttccctctaagctctatagaccttcttcatcccagcacagctttctccagaactgttcatgattacaaggaagctcccatgaatagccacatacttgtatgttggtgcctatgtgagagtcaagggcttaacctttcttctaaatttaactagttggagacaagttactgggctagagtgtagcactggatcctatgaagacttttaccagttaactcacagtgttataacagcttcccactcactaaaaacggcttgaaaaacttgtagaccaatttgtctggacaaccaatacagttttcatttctgtactcacgacttttcttttcaaaagattacacttttcatttttatactcaacgactgtttgggagaaggtgtgccaggccaaaaacgataagagtttcagaaggccttggacatttgttccttttgaccaactacattttgttgatcgacatgtgtttcaaattgcacacattctacataaagggagtcatgctctgaggctagtaacgagagggtgagccagcagcaaggaagtcgctgtctgctgaggtcttatgtgtataaataaactatttgctttgcagattcttggaatgggctccaaacgtctgctgacccttacccacagggcccaggtgaagcgctttactcaggatttactaaaacttctcaaatcccaggccagcaaacaggtcattgtgagagaattctcacaggcttatcactggtgagttgatgaaaagaacagaaatgaaagtaaatattttag

SEQ ID NO: 18908 - DNA, 1049 bp, Homo sapiens
ttgtactgctgctgttagtgcttgtaatcttgaaggcaaagtagtttttgctattcaactttatatatatatacacacacacacattttttttctttttttttttgtttttaagagatagggtctcactctgtctcccaggctggagtgcagtgacacaatcatggctctctgcagccttgacctcacaggcccaggtgatcctcccacctcagcctcccaagtagctgggactacagctgggactacattcctggcgaagatttttattgtaaatgaaagaccagatttttataatagggacagtcatcagcttaactttattgcacatctatcaagcatagtagacttcattttttataacacttttctagaagacctaaaattgttaccttctgaggaaattgttaattttttttctgtccagcaaagttacctaaaataaagggagagagatttccatctgttttccagacccttaaagtagtattggcactgagaataagcagctgagaactaataaagcgtgtgtataatcacattgtagaattagaaaacccagtgataaaattgcattttctagcagcttatctaaatttatgtatatattttttcctattatcaaagttgttgcaagaaagatgttttatcagttgtagaaagtgtttggggttcatatattctcaagaatctagtttttgcattacatttttgttgcattaggatattaagtctctaggttctttttttttcttctcgagacaagagtcttgctctgtcgcccaggctggagtgcagtggcacgatctcggctcactgcaacctccacttctgagttcaagcgattctcctgccctcagcctcccaagtagctgggattgtaggtgcccgccaccacgcctggctaatttttatatttttagtagagacagggtctctatctcctgacctcaggtgatctatttgaagtggttttcattgtgttgtaattgaagagctttggcaaccctcaaaatgctgattgaacaccttgtcctttcttgcaaattt

SEQ ID NO: 18909 - DNA, 1206 bp, Homo sapiens
ctcgtgtgtgtgcacaatctgtcttgaatataactctctccctatcgtgtaagagggctgtttccctccctgacattgaaggaccccaccttcagcaggcatctcctgacacagcagaccccatgagcacagatccctgggacctggtggctgcccttatcagattccctgacatccccatcttaggacccaagtctgaccaccttcggggtctgcagctgtgttacagaaaaggggtcctgatccagatcccaaaagagggttcttggatctcgtgcaagaaagaattcagggcgagtccataaagtgaaagcaagtgtttgtttgtttgttttttgagacggagtctcactctgccacccaggctggagtgcagtggtgcgatcgtggctcactgtaagctccgcctcctgggttcaagctattctcctgcctcagcctctcgagtagctgggatcacaggtgcccaccaccacacctggctagtttttatatttttagtagagactgtgtttcactatgttggccaggctggtctcaaactcctgacctcaggtgatctgcccgcctccggcctcccaaagtgctggtattacaggcatgatccaccgtgcccggccaaaagcaagttttttagtaaagtaaagatctaaaagaatggctactccatagagagagcaacccagagggctgctggttgcccatttttatggttatttcttgatgatatgctaaacaaggggtggattattcatgcctttccttcttagaccatatagggtaacttcctgatgttgccatggcatttgtaaactgtcatggcgctggtggagtgtagcagtgaggatgacgggaggtcactctcgtagccatcttggttttggtgggatttggccgccttctttactgcaacctgttttatcaggaaggtctttgtgacctgtatcttgtgccgacctcctatctcatcctgtgacttacaataccctaaccgtctgggaatgcagcccagtaggtctcagcctcattttacccagtccctattcaagatggagttgctctggttcacgtgcctctgagagctgggctcctcgggatctcctgacatcctgccccttctatccccagctcctggggccctccgccctcactgccatcgctgtcttcctgagcctcctccctctgaatttcttcatctccaagaaa

SEQ ID NO: 18910 - DNA, 1044 bp, Homo sapiens
taaattgtttcttcatctcattgtcccagcagctgtggccaatcatcatgtggctaaggacaaaacccagacgcagccctggcccaccatttgtatagacagaatattataaattgggtatttgaaaattaggacctgctgggcatggtggctcatgcctgtaatcccaacactttgggaggccaaggcaggcagatcactttaggtcagcagtttgaggtcagcctggccaacatggcaaaaccccatctctactaaaaatattttaaaaaagttagccaggcatggtggtgggcacctgtaatcccaactactaaggaggcagaagcaggagaatcacttgaacccaggaggcagaggttgcagggagccgagatcatgccactgcacttcagcctgggcgaccaagtgagactttgtcttaaaaaaaaaagaaagaaagaaaattagaaccactaggaaagccagggctctggctttcaaatactcttgccctggtccccagagtgggcactgacccaagatcagaaaccttttctctcctctgagcaccctcctctgtctccattccttatcttctgctttccctcccacagggcttccagagcgaccctgtccgccacctgtccacctacctatgcctgtctctggtggtggcacagtttgtgctgtcctgcctggcggatcaaccccccttcttccctgaagacccccagcagtctgtaagtcaccaagttccaacctcattcctgttccactttgaggtctcagtctcccccaggtgaccaaaagtctttaatttttttattcatttagccattcagcaaaaagtgtaccacatttctactcgatgccacagttggcagactttttctatatgggccaagagaaaatattttggactctgtgagccatacagtgatctcagtggcaattactcaactctgccattgaacgcaaaagcagaatatgtcaacaaattgcatggctgtgttgcaataacactatttgcagaaacaggcagtgggccagatttggtcatag

SEQ ID NO: 18911 - DNA, 1058 bp, Homo sapiens
tcattggtgggagcagcgttcttagttcagtgcctggacagcgtgttccttagatattctaataatttgtagagcttcaggatttgagaccctatgattttatttcagccttattatgtaagaaagggttggctgtagtctctcttgtcgagacttgatctctaggctatgtaaaatctgatcatcctggacagctctccagccaacagggagcacgccagtggcctgacactgccatgtattgccttgttccatctctttgcatgcctttgctttttctcctaggcaggcgtagtcttacttaggtgtattttttgaaaagtatgtcaagcattgtgcacagaataagtacccatctgaatgctgggttggttggtttggaggactgtttatttatgaatgtcatcttgtgttactcagtttttctgttattggtaaagtgaagaatgtttttgttgttgttgttattttatagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttc

SEQ ID NO: 18912 - DNA, 1087 bp, Homo sapiens
ggttcggtctcggtgtcctgcgaggaggctggtccccaccttggccgaggatcctggccttgccggttcctggacaggcatagaggagagccatggctgggcgccccagactgtgcactcaggggatcccggtccgtggggtgcaggccgcagcgcgggcgggagccggagccttcgactgcccagctaggcggtagctccggttcgggccgcagcgtctggatctccctttagtgctgaggcagcgccttggccccgggcggcgggcaacatcggggctggtgggccgtgcagcttctcactgctgcggccgcgctgggagcttgggaggctgaggccacccagcaggtaaaagctgcatcgtgccggggttggcagtttgctgggtgccaacttggatcttctgggccgcagagtttttctttagacacttttgaacttaaggaatttaagttctactctttactattggcactttggtctttcaaaacttcagtgtagtgtgcggttcttgcccattagaagagagtccagtctgacaagcatgtaaaatgtttctgtttgccactgtggctcttgctgttggacgcaattttaaatggcacgaagatggatgtttaatagttagatgtgttcattgtaggtgagagtgaactgatttaaagtacaatgttaatagtatggaatctgctgattttcagcaatttggaaaatgttgccgatgatactctgcttctgttctgaatcactgatcgactatacccgatgttttccttccggtagctggcagtttctgccagttctcacgttgtcttgtgtcaagtggattttgtcccacattttattatctccagacgttggtgtgtggcacgattcgaagaagagtggttagtgaatgaatgagtttcaaaatgtgcaggctgacgtcccgataacctgttttcaacaaccgtagtaaataggaattttcctgggtggtgggaaatggagaagcagcctgcttagacttgagaaaacttcgccaaggtggggccagaaaggaaaggatacttccgcagtgtaatggttggtgtctgttgatgttggc

SEQ ID NO: 18913 - DNA, 2213 bp, Homo sapiens
tggctcacgcccgtaatcccagcactctgggaggctgaagcaggcggatcacctgagattgggagttcgagaccagcctgactaacatggagaaaccccatctctactaaaaatacaaaattagtcaggcgtagtggcgcatgcctgtaatcccagctacttgggtagctgaggcaggagaatcgcttgaacctgggaggcggaggttgcggtgagccaagattgcgccattgcactccagcctgggcaacaaaagtgaaactttgtctcaaaaaaaaaaaaaaaaagtaataacctttagcaggttaattgctgcctccttaatgttgggtttttttttattttaagtgacttccttactattgcttcctggactaaaccaacatggaatcattttgaagtacattggaatggccaagagggagataaacaaacttctcaaacaaaaagaaaagaaaaacgaatgattcatctgctttaatcagtgtgattaatgcagcacccattgccccgggaaccgtttctgctgtactatctggatactaaaatgttacggaagtagctctttgttctccctcactctgcccttagttaatagaaattcagactcgccaagtaaggcttcgtgcatagtgtcttcatgtcgcgtatagttgagcgcgttcttagcagttggcttcatggacaactcattagtgttttgacttttcttacccagcgttaattgaattcttgcttttagacaacttcctttttgtagtggtgaaccttgccctttagtacagttcaagtgaatctggataattgttcatctttgctttagcttagataccatgtagtggtctgtggctacaggaagctggttctgtctgcttccacagtctgcttaaaaaactgtctgacttcgtgaatatagagaccaagtttaccacttctgatgaagagaccaattaagattcattcctcattctgtttctttccagtgggagaagagtccccatgaaataagatgaaactgattccatgcactagtacatgtaggcttctcccttgtgcaaagcttagcaatttgtaggaaactttgatctttttgtccaagaaaaggaatgtctgacaggcttaagctttcgtccccttgcacttagactcgaagttagtaaatccttaaaggctttttaatagcagacttccaaaagattgcatttaggatttctagcatgcttttaatttcagattttcagctgacattagctatagtatacagtaggttaagactcatgtctatgactttcactctaagactggcaaaaggacagcagtcttctatgtttagtcaatattcatttcagtagaagataatcttatctaatttttgagaccagaataagccttttaaggtaaacctcaaaattatcattttatggtaatactgaccattttagtcccctaggtttgacatgggagatagtgactacactggtgtctgacttttttcctagagatttctccctgaaaaatacaagggctgttggtgagagcagacttgaggtgatgatagttggcctctggtctacaaagatttcataactccttggaaagcttcttataatcattcttaacttcttggtagctagaaatttagagtagttgaaatctttaggaatgaacttctgagggccaaaaaatgtgactgacgggaacaattcttaaactgattaactagctgtaatatagttttgtgaatttattgcactgatgttgtaccttgtggtatatctgtccctattaaataagtgttgttttctcctctttaatattgctgtgaacagtggtgcccattgtagcatatgtttgatttttttttattatttcataagaaaactacgttaattttaccttactttcattgtaaataagcctgtcttcctatctggattttttgtgtgcatacatattctactgattaactacttttgcagttttaatcctgtattatttcttctactttgttttgtgtaaaaggggaaaaaataaaaaaagctggaatcttcatgtctcactttctttataacttagccaatataatatttatgattggatttatgaatctgattaatgaagtaccctgtgtggtccttagatgtctataaggtaccctacctgtaatcccaccactttgggagacctgggcaggaggttcactggagtccatg

SEQ ID NO: 18914 - DNA, 1035 bp, Homo sapiens
gagtttcttattctaaatttttcttcctttaccaaaaccagctttaagggcttttgccacattagctcatcctagaggcccactttcggctgttcagagtcagagaaatttgaagtataatcaaaatgacatcctgagtggtaagaaacactgtattgaggaggtatattgaccgtaaaatgccaccttaatttggtgaaagtagttttccttaattgtccaatgaatgtcaacatctgagtgattccattacacaaagagctattttagaaattgaatgctattcagggaaagtctttcctaatggatttagaagggtttaaatcaataagatgacaaaaacaacggatcaattctaaccatctgaaataaacaaacttaaaaaaagttatttcattttattaatactctgggcactgccacgattccccgcatgactttgagaaagtaaaccattttgagctcactttctttaattgtaaattgagtctaattatccctaccttgtggctctctgtaaggattaagttacatcatgtatataaagaatagcccagtgcttggactagaaaagtgaccattaaaggatatttaggctgggcctggtggctcacacctgtaatcccagcactttgggaagacgaggtgagtggatcacttgaggtccagagtttgagaccagcctggccaacatggtgaaaccctgtctctacaaaaaattagtcgggcgtggtggcgggcgcctatagtcccaactactcaggagtatgaggtaggagaatcgcttgaacccaggaggcggaggctgcagtgagccgagatctccccactgcactccagcctgggtgacagagcgagactccgtctcaaaaaaaaaaacacaaaaaacaaaaaaacccattgtattttcatctttgaaattgcagtttttcagaaaccaactagtttaaaattggcaatttggttaagaggttattttttgtatttggagctttaaaataattgaagtctatgaaccacaaaaatgttgagagt

SEQ ID NO: 18915 - DNA, 1846 bp, Homo sapiens
attatttttggtcattgagttcttagtgtagtttgctagatgattattaagattcttttgtgtctgacacttgtggtgagttgcttttgaaatctgttgagatttccatgtgagaactgataatcaggctcttgatctgcttccctaaattacttttttagagcccaaaccccaggtttagggtgagggtttgtaatacaaagaaacacttccatcacttctgcccttaacccttgcctctattacctaagcttagtaagtagttttcttaatattgtccaatgtttggtgttatctgcattgttttttgtttttttaattgtggttgttctgacgtgtgaaatttaaggaaagagccattttttaaaaatgccgagcagggcaatgcaagtacagccaaatattagacttgatgtgcaatcttcggtcctttttaatctggggtattataggcagtactttaaattgcaaagtcttccgggcctattttcctctacatttttgtaattaactctgggggcttacttgttttggcagtactgaaatcaaaggagctggttcttcttttctcccaattattttcatatgaaagcacctacaattagcctgttagtcctattcagatacatcaaatatcagtgaatgctttactattcgcacatttaagcatctttgttttacataaaattagagtatgaaaaccagtgttcaattttttatcttgttgagcttgtaaaatgccagcaatttaaaactaggacttttccccccataagccaaggaggtagaattactaatacaagggttaaagaaggtagattttgttttcaatatttgggtaatattagaaagattcttcccacagggaagaactagcaagtgtcccaattttttccaaacgttggggaggggaaaattcactgtatcatgaaaccctaagggtttgttgcacttcctgctttttaggcctggataacagtatcaccatccttatttacagaagggtaaaactgactcttaatgagaaaagctttataagttcaagggctgtaaaatatgaactacttagggtcgtttgccttccatgggaacttggctagacttagaaaaagctgtttgttgtgctaatgtaaaagtgtcatacaatttagaagatttttgaagatggtaaacttagaagaattctatgttctgaaatgcacacttttagaatgtttttctttgaaaacaggctaatagttttttctttttttgacaaagtttcagctcctctttaaagttattgtgtcatttttctggtttaaatttcccttatatttccacctgtaatgtcagtggcaacaacatcatacttcacttacttgttaatttactttttacccttattctaagagcaagttgagttgaactgaatcttccttgtcttagtaacaatgtataaatagtggcttttctgtacaaaaggttgtaatgcctcctgatggatataattttgtgattgtatttaaaagttgaataaatcacaccagcttcctgaaaatgttcataatgcatcttttggaaaacaaatacatgcctactttgtgcatatttgcattaacatggcaaagattgtatgaaatacctgtttttcagaaaataaaggttcagtctcaaaagatacagcatttaagttctgaatttattggtcaaaatagattttggaaaacttgaaaccttttggaacctgggtagcttgaaaaaacaaaacgacagggtctccctatgttgcccaggctgatctcgaactcctgggctcaagttacactcccacttcagcctcccaaagtgctgggattacaagcct

SEQ ID NO: 18916 - DNA, 1792 bp, Homo sapiens
caccgcctgaacacggagattgtctttctgccacagaacagcagcagacgtgtcgggaggttagctgcggaaagaaatcgggatgccgcggagcacagagtgatttggaactccattccacctgaccctgtgtgtacaatccaggaaaaaaacaaaccccactcagaaacagagaaaactggggtcgcgaagaaatcacagccaaggaagatttgatgcattcagattctcgtgtaacacttgttgcttggcaacagtactggttgggttgaccagtaagtagaaaaaggctaaaggctatgcgatatgaatttcagaaatggactgaaaatggagagctatgtaacagatacactacagtagaagaacttacttctgaaatgaagggaaaaaaaccaccccatcgttccctactcctccccaccacttacccgttccccctttacctaatctagtagattagccatctttcaaattcacttttatttcagtccttatatttcatatacttccgtctcgatgctgttaacaacttctgataacatggaaaattcaaggattgtttaaaggtctgatgatcacacacaaaatgtaattccggttatttaagtcatttctgtgattctatcatgtacagtttccagaattgtcactgtgcattcaaaagtaatgaatctaacagacatttgatttaatgtacactcccttttgcttatagtgtgcattttttttggaggtcattcaaattttccctcttctgtgatagctgtagtttctttcatagaaagtagctaatccagtgtaatcttttacctttttaaaaaccaagatagagtatctattagagttttacattgttgatgatagattaacaataaagtgatgttctggtggaggtagactgaaatttttttaattcatgtttttcatttgatacttttaatttacacttagtaaattaaaagttgtttaatttacttggcattttaggacatgtacatgaaacagtgaaaatgagatccaccaacatcttttattaagttcagttattagtctgtgaagtgctttactttttgcacaattttaatagcttgctattcagtaatacattatagtgaattcatgatcaaggtttccttaaatttagcattgcatttcagtactgactgtgtaagctaaattgctgatccaaaataaaaacccagactagaatagggttcttaaaatcaagtatcaatacaaaatagaacacaattaaaatcttaattgttggctgggcacagtggctcacgcctgtaatcccagcactttgggaggccgaggcgggcggatcatgaggttaggagagcgagaccatcctggctaacacggtgaaaccccgtctttactaaaaatacaaaaaaaattagccgggcgtggtggcgggcgcctgtagtcccagctactcgggaggctgaggcaggagaatggcgtgaacccaggaggcggagcttgcagtgagccgagattgtgccactgcactccagcctgggcaacagagctagactctgtgtcaaaaataaatgactagataaaaaaaaaaattgtttgagtacattttccctgcattttagagattaggacagtggtcactttctagttgccgtcttcacagacaaacttgaaaggtattaaggaaaaaattccacatagctctgggccttttttgtattctgattgccacgttaatctgtaatcgttaagtacccatgaaagaatgtgtttcagtatcagtgcttttttggtactttaa

SEQ ID NO: 18917 - DNA, 1049 bp, Homo sapiens
ccataagtgaaaagttccatgcctgacctggtgatggatcccagtagtgaaaatctagtcagaacctgtttcatgcacaaaatcactgaaaatgtataaaattaccttcaggctatgtgtataataaggcataagtggattctgtgtgtagacttgcatcccaccaccaagttcctcattatatacatgtatatattccaaaatctcaaagaatccaaaatctaaaactacaggtcccaagcattttggataagggatactcaacctatgtttgtaaagcatctttgggtatcgggacatttgtctgaagtcattattctgaaattttttcattagtcttactaatattgaatatataaatttgagaataaagctacagaaaagttataggaatgcccataaacgttttacctagactcaccagttaacaatttcccatgtttcattgttctgtgtgtgtatgcacacacagtttttctgaacaatttgagggttctttgcagacatcttagcacttcatgcctaaacttcaccatgtgtctcttgaacaaaatactataatactgtagctactacataattgtcaactcaggaaacttaacattgttgtaatactattatctgacattcagtccacattcagatttctccaattatctcaaaatatcctttattgcttattcctcctctctgaaccccctgttcctccgaccttcaagatctagtcaaggatcatcatgcattttgtgtatagatagatggtcctccccttatggagtgacatcccaataaatccataagtctaaaatgcatttaataccccgataaacccatggtgaggtaaaaaatggtcattcagatccactgtgagtcagggactgtccatccttgtcctacttcttgatctgctttaatatctagaacagttcctgagcctttccctcttctcttccgttgatatttttggtttgtctagattagttggtttacagaatgtgcctccatttatatttgtctgatattttcctcataattcaattcattcaaga

SEQ ID NO: 18918 - DNA, 1098 bp, Homo sapiens
cttgtgttttcatcaactattttttaaagccagtagtagtagtttgaatttcatacacagagaagctaaggcttaattagattcctttattgtgatataacttgtaataaaaccaagatatgaacctagtctgagcattcagatatccagcttgtctttctctttcttagctataccaacaaacccatacagtttgcctccaaaatgaatgaaatgttgtctcttccctccagtgttgtacatagtctagtaagtaagaaaactaagcctccagaaaaggctattacttcatcattacaaacagtaaataatttaattttagaatttacttttactttgaatttttatttgatggtggaaacaaagttcctataaaaatggagttgaactaagcagtttaaacacactcatatttgaaacatttgttacttaatcactaggtgactgtcttgagagtaattactgatactaaaactatttttcttaatcattaatttatcaattctaggatgaagaagctgctctggcagatggtgaagatgttccctatgagaacagtgttaggcagtttttgggtgaatataaatcatggcaagacaacattcaaacagttctatttacattagtccaggctatgggtcaggttcgaagtcaagaacacgttgaaatgctccaggaaatcactcccaccttgaaagaactgaaaacacaaagtcagaggtaagaatgccttctggtcagaatttataaaacataagtacaaaactactggtataagaagtttatctcttgatttaatttttcagttttgttcatatttttataagtagtatcaggtaaaacatttcgtaaataagccattttattttgtatttcagtatctataataatttagtgagttttgcatcacccttagtcaccgatgcaacaaatgaatgttcgagtccaacgtcatctgctacttatcagccatccttcgctgcaggtaggagaagagtcctgagtcttgatctgttgttaatgttacacatagatgctaagatgtttaattatacataactgtctaatattaaacacttaaggcctgtcattctataa

SEQ ID NO: 18919 - DNA, 1086 bp, Homo sapiens
ggttaataactttgcaggtggctttttaaagttttgtcgacctgacagccgactgctagctgtacctattgcaaggactggattgttttggtgttgtgcatacatagctcaacattggggaattattaatagtttgctaaaagcccctaattgggtgatgatcacagcagtgttttccttctatctcctgtgatttcactgcatgtttggacagaggaaaagaaagagtcttaacaaagaatcctgtaatgcacatcggccaccagcgttaacccatccaggatggcccagatcccagtactgagttaaatgtagaaataagaacagcagatagttgtgtggattttaaaatttagttttgttgttgtttttgagacagggtctccctctctcacacaggctggcatgtagtggcgtaatctcggctctctgcaacctctgccccctgggctcaggtgatcctcttctcctgccctagcttcccaagtatctgggactacaggcacgagccactgtgcctgactaacttttgtattctttgtagagatggggttttgccatgttgctcaggctggtcttgaacttctgaactcaagtgatctgcctacctcggcctcccaaagtgctgggattacaggcatgagctgccgccgtgacctaaaatttacttttatgccatattgaatgtggaagaaaataagtgttctaatgtaatgtaaatttgtttctcccatcttatgaatatagataatgctaagtttgcaacagagagcacagaaacgtgcaagttacatcttgcgtcttgaagaaatcagtccatggttggctgccatgactaacactgaaattgctcttcctggggaagtctcagccagagacactgtcacaatccatagtgtgggcggaaccatcacaatcttaccgactaaaaccaagccaaagaaacttctctttcttggatcagatgggaagagctatccttatcttttcaaaggtaggatttaagacttcctccatttttcagaagagtattagtcttactaatgctttgtgtgagtgtgggtgtgtatagtaggagattatttc

SEQ ID NO: 18920 - DNA, 1173 bp, Homo sapiens
tttcttcttctttttccttgacaaatcttgataagtttttttatattagttttattttctagaaaatgtcttatgaatttctcctatttgctctagcatgcttatagaaaatgtcagtgtttcttacagctcaaatttgtgtagttgttttaaaatgcggtctctttcttcttcccctggtacttttttctttctgtctactgaagttagttcttatacatggtcttatattttggctgtctcttttccctaggaacattcatacaggttgaatattccttatctgaaatacttgggactggaagtgttttggattttggattttggaatactttttttttttttttggagatggggttttactcttgttgcccaggctggagtgccatggcgcgatcttggctcgctgcaacctccgcctcccgggtacaagcgattctcctgtttcagcctcccaggtagctcggattacaggcatgcaccaccatgcctggctaatttttttgtatttagtagagatgggttttcaccatgttagccgggctggttgtgaactcctgacctcaggtgatccacctgccttggcctcccaaaatgctgggattacaggtgggcaccaccatgcccagccggattttggagtattttcataacacttactggtgagcatccctaatctgaaaatcctaaatctaaaatgctccaaaatttgaaactttttgagcaccagtatgatgccccaagtggaaaatcccacacctgatctcatgtgatgagtccaaactgttgtatgcacaaaattatttaaaatattgcataaaatgaccttcaggctatgaatagaaggtgtctatgaaacataagtgaatttcgtgtttagacttgggtcccatcctccacatatctcattttatatatatgcaagtattctcaaatccaaaaatatacaaagtctgaaacacttctggtcccaagcattatgaatgagggatactcaacccgtagtccttcttttaggggaaaaaaaaaaaaaaaaggcttttttttttttttttttttttttttttttttttgagacagagtcatgctgttgtcgcctgggctggagtgcagtggtgcaatctcggctcactgccacctctgcctcccgggttccagcaattctcctgcctc

SEQ ID NO: 18921 - DNA, 1057 bp, Homo sapiens
cttcatctcccgacctcaggtgatgccccctgccttggcttcccgaagtgctgggattacaggcgtaaaccacctcgcccagcctcagagggatttctggtaccagaattatagattgtttttgttaccgaacttcctaagttatgctcattctttgtttattaaggggagacactagattttttttttattaccctttttatcatcatagagaactttagtagtctacaagaatattattagaggcttagcagtggcctcactgcacatacatgtatatgtctttgggaacctacaggtttttaagaagttgttaaacttaatatttactagatatttgtttttggatggcatctaatatattaatagcctagaaaaaaggctccactaatgaatatgtcttggattacatagtgacatatattagcttttcgtccacatttgataacattgctaacattttctttttttttttactgaagctctttgaatttaaagttttctctcatttaaatttattaattaaaaacgtacctttactctgttccctttagcatttcaacctgatgttaaaagatgtatatgtgtgatacgtgtgtttgaaattttaactttcatcttggagtatttaattctctgaagcagtgcatgactcttgctcttcagcctcttgagggtgtccctggtttatattcctgatgatacaaaccctggaatttcttgtctgaagtgttaacacttaatttccaggccctaatttgattttaatagtggaagttcagattcaatgcattaatgacagattctacgttgacttcttcagatttgccagacagaaaaacctacttatgtgaggaaatcattaggctttttgactatcctctttgtataatgagacccttttctcattagatgagtaaaaagatccagagatgatcaccaatatcacccagaattcatatatatttaattgaaaagaaaacaaatcctgggattctttcctaaaaaggttgattacatttcttgcctgtccgaacgttgtataaacgtgaagaaa

SEQ ID NO: 18922 - DNA, 1050 bp, Homo sapiens
ttctagttcgagtcattttatggacgccgacttcccgctgacattgtctggtgatgtcatggtgagaattttgacagtcattaaatttctgcctggagggccaacgggaccaaagaaactcagatgtgagtaggacataaagctaccgagggcagaaagccgttgtctacaaagttaacatgtcaaacacaagaccccctcttcctggtctcctgctagcattgtggtgatgagagccagctgtcttgaacatttactaggggacaggcagtgttctaattaggcacttgatttaactcattcagccctcccggcaaagaacaacgttatgggccaggtgcggtggctcacacgtaatcccagcactttgggaggcctaggcgggcagatcacgaggccgggagttcaagaccagcctgactaacatggtgaaaccccatctctactaaatatacaaaaattagccaggcattgtggcgtgcgcctgtaatcccagctattcaggagactgaggcaggagaatcacttgaactgggaggtgcaggttgcagtgagctgacatcacaccactgcactccaccctgggcaacagagcgagactctatctcaaaaaaaaaaaaaaaaaaaaaagaacaactttatggacatgcaccaccactccccactaattttttaattttttaaagagaagaggcctcacgctgttgctcagactggtctcaaactcctgaactcaagtgatcctcctaccttgcctctcaaagtgctgggattataggcatgagccaccttgctggccgtaggttctatctttatccccattttgcagacagggaaactaaggcatagccaggatacatacattgtatgagatcaggcagccagattcaaacctatgcttcctacattatacctttaatcaccctaaacactgcttcaagaaagtttttccaaataaatgtctgatgctttttttccatggtttgaggcaagaggaacaaaataagacatatgatgggatttttttttttgtaaagctcaatttacagt

SEQ ID NO: 18923 - DNA, 1816 bp, Homo sapiens
gccggcaactgtaaatcttaaaacttgcaggttctgtctctctctctctctgttttttttgtttgtttgttttggggggggtccttgttttgtatttactgaagaaaccggattattgttttgtagagtttacccaagtccaaattttgctgattatgccatgatatggcttaatatttttttctctttattttctataaactggtagcgagagctggaagcttgccttgatgaggttagggttggttattcttggcaagataactctagagatgagggtgtttttccgtcaggaggcacttgacatctggttgactcctgttgtttttggctgctattgatgctcattggccagatctgtccattttctagggagctacaaaatgctgatattttaattctattacttcttgcattagctgaaatagatctttaaaaagaaacttttcctcctctactatttagttaccaaataggcagaataaatgctttatctttccttttatttaccagtttccagaataacaagctggttccgtagcattctttaccagtgaccaacagagcatacattgaaaatttttacagtgaggatagagcctatcaatagaagctgtcatggagttgaatagggtcatggggcttgcagacatttggaacagtgtttcccaaacttccttgaccacagagtcctttaaaacgtataagacattcccccagaggagcacaagagcagagactaaaggaactccatccacatctctccatttctctgttgtcctctcccattctctcgtcacaatcccttctctcccttcccacctcacttccccatccccctcctcacccctacaactcttcagccatttgctctggaaagggtcaaaactaaacagcccatcttgaactgaccttggttccctcctcattgagttctaattaattatctctggccaggatttaagtcaatagccaattaaaagtttattctcatgacattattaaaatttgatcctgaagttttaatttttccattttaaagataggattgcagtttttaaggactgggaaaaaaaagttctcatatgtgctgcatattagtgctttacattcttcacattattttctcaaagggtttatgattgagaacttatttagtagataccggggcagggtaccaaccatgaccacctcatctgattgagcacattggctaaatctaaactaataagtattcaactttacatatgatcattattttacttccccaaattcctttgcagatgagacaaacagatcgggatgtaataacagcattaactcacagaccttggagcctaagccatacaggagatgggaaaccacgctatgatactttctggaaacattttatatttgttatgatggacattttgctcgattggagcatgcataatatcttgtggtacctgtgtggaatttcagctttcctcatgcaaaaggattttgtatccccgtaagttggaaggttttttattttacccagacagacatcctgaatgctcttatttgaaaggaaggattaacagagtagacaacctgaattggttctgacctgcaaagcttaccatacctctaaattggattaccaatttcgcttcttaggtgggaagagttcaggcatatttcactgttttcagaccgagtcgatcacatattttcggttttttagtgtattttgaagaaaaaaaatgaacctgtgacactatgctgagcaagggattttatttctgtgactggtttttttgaaagccaacacaggatcctgggcagaacc

SEQ ID NO: 18924 - DNA, 1032 bp, Homo sapiens
gaaaacaatcaaatcaaacactcttcaaaggatgttctgttaactaaactaaataggaacttaaacataaatcgccaagacctggtaaatgtgtgaaaactatttttctccttcacaagccattcttgactctccaggaagaggaaatgcaaaataatttttctctcccacatcatggccctggctatttccattagccattacagtttgtggtagccaggggctccatatacaggttgaacattcctcatctgaaatccaaagtgctccaaaatctcaaactttttgagtaaaccagacagacaggacctcatggaggtgatgcgcttacagggggaaaagcagacaactacttacatatttacttgttaaataacagtgataagcataatggagaaaaagcacaggtgagcggataatatatcgtacaggatgacctgacctaactttctgtttatctgcagaaatgggaaggccaaggatggtttttctaaagacatgacatatgaacccagctctgaaggatgaagatgcaaaaaataaaagaaagtaagttctaaaagaacaggggagatccctacagaaggtgggaaaagcatgattattaatgataataaaatcattcttggttgggcacggtggctcatgcctgtaatcctagcactttgggaggctgaggcaggtggatcaccagagttcaggagtttgagaccagcctggccaacatggtaaaaccccatttctactaaaaaatacaaaaattagcccggtgtggtggtgcacgcctgtagtcccagctatttgggaggctgaagcaggaaaatcacttgaacttgggagacggaggttgcagcgagcagagatcacgccactgcagtccagcctggacgacggagcaggactctgcctcaaaaaaaaaaaaaaaaaaaaacaagttcttttgaccactatctctctttaattgttctatcttgtttcagctttggaggaaccgcaagtctttttagcataattcatcagtttgtctcaaaa

SEQ ID NO: 18925 - DNA, 1068 bp, Homo sapiens
tcactctcactccacgcccaggctggagtgcagaggcgtgatctcagctcactgcaacctccacctccagggttcaagcgattctcctgcctcagcctcctgagaagctgggattacaggtgagcaccaccacacccagctaatttttttttgtatttttagtagagatggagtttcaccatgttggccaggatggtcttgatctcttggcctcatgatccacctacctcagcctcccaaagtgttggtattacaggcatgagccaccgcacccaggccccatcatttttattttctacaattctggctgacatcttattgctccatccttgctaatgatagacttcatctcacatagaccagtgttttcagagaccggcttattgattcagtaaagggctgggggaaactgcacacacaaggacatataaaatctaagcctctgcctgggccacatgacaggattcagaagcacctttgatataatgggtgcccgacctcatgtgaaagtccaagttcaggtgtaatgtgagagcggtaagaattcactggcctaggcttgggaactaatgctgcccaccacgttcagcctcagaggagaagaaatgacttgaagaacataatttgtgaatttgccaattgtttttcattttatagcatcacacagtaaaagtagataaaataattttaatgaaaatacttctgtgggccaggtgcggtggcttacgcctgtaatcccagcactttgggaggccgaggcggcggatcacctgaggtcaggagttctagaccagcctgaccaacatggagaaaccccatctctactaaaaatacaaaattagctgggtgtggtggcgcactcctgttatcccagctactcaggaggctgaggcaggagaattgcttagactcgggaggcggaggttggggtgagccgagatcacgccattgtactccagcctgggcaacaagagtgaaactgtctcaaaaaaaagaaaaaaaaacagaattttgtgaaataaaggccacttgggagtatctgagccaccccacaatgctgtctgagtt

SEQ ID NO: 18926 - DNA, 1022 bp, Homo sapiens
cgagtgagtgctaaaacctcctgttttctgtgttaaacattccgtccctgtttgagacatcagtatgtacagttaacttttgttgagtgtttagcaggtactagggacatactagtgttttccttaatgtatttaatcttcataattatgaaatgggtgctattattagccccatcttatagatgaggcaactgaggttcagggataaagtaataaaattgcctggggtcacccagccactaagtgcagggtgttgtacttttgtacccgaagccctaagttcactattcgccactctgaatgtcccctttagggaatttccaccagaatcctcgttggggattgaaatgtctttagatggaggaaaaagttttatgacaagtctgcatctctgataaaaagtggagtgaatgaggaacggagaatcgcaaactccttttccttccttttcctttcccctgtcatagagcagctgtaggcagagaggtgtctgagttgttaccaaacacatgtgactgagctgctgctgctgggaaatgtgcctctaaaccagtcctgccttttccactggtgtcccttcggccctaagtgctgaggtaggatttttgtgctttgactggattctgaacaaggcattttaggaagagtggttagtcccgcaaatgaatcaatggcagatcccagggacgtgtgtgtgtgttttgagataggctctcactctgtcacccaggctggagtgtagtggcatatcacggcttgttgcaaccactacctatccagcttaagtgatcctcccacctcagcctcccaagtagctgggactgtgggtgtgcaccacaacaaccagctagtgtttaaaattttttgtagagatggggtctcactatattgtccaggctagtcccaaactcctggactcaactcatgctcctgcctcagcccccaagagctgggatcacaggtgtgagccactgtgcccagccccagggatgtgtctgatgagattcttttttatcacaagg

SEQ ID NO: 18927 - DNA, 1068 bp, Homo sapiens
tgaacacaaatcaagtaccttcaacagagttaatgccaatatgtctcatcctttagttttggggaaacatcctcttctttcaggtggtaccaaaaggaatccatgcagtccccaagctttcccaccagcaaaaaaacaacccttcactattcatgaagaaaagcctacatcatctgattgctccccagtaagaagttcttcctggaggcgtctcccatctatattaacttctacagttaacctacaagagccatggaagagtgggaaaatgacacctccattatgcaagtgtggtcggagatctaagagacttgttgtttctaataatggaccgaaccatggaaaagtcttctattgttgccctatcgggaaataccaagaaaacagaaaatgttgtggttatttcaaatgggaacaaacacttcaaaaggaaagagccaacagcatggttccatctcattccacagggggactcacttttagttctccagaaacaagccatatttgtgacagaaatttaagtatttccaccaaaaattctttgagactcaggccttcaatgaggaattgataacctttcatgtatgaatcctaattgttccttgaatttccaaacatgagtattctgataacatcttacactattttatttttattttatatattaatgtttactgcatttaccatactttcttcaggaaccacaagtgtaatcttttgtaaacagtatttattagattacatataataagcaacaatagtatatgatccttcttttatagttagaccttgaaacaagtctaaactatttttaaattatttgcaaaaaatgtgactaataaaaatccctagtctattttcaggtagattcttgtactttgagattatcataatcttctaactgatattttatatttttctaaaaacttttataagttctttagttttatttcaggcttgaacattggttctgatttgtatatcaacatatcagaagaattagtcaactaaagtttgaaaacctatgtagcagagatctggttcagaaactgcttctatactatacat

SEQ ID NO: 18928 - DNA, 1020 bp, Homo sapiens
acaaacatttattgactcctaagtgctagccagtgtttcaggcactgggtgtacacaggtgaacacaagcaaaaggttcaccctttcatggagcttacatcggagtgggagctggggacagagagagacataatatatatcccagtaaaccagattttgatcaagcgctgaagaaaataagagtgatgtgattgaaagtgtcttaactgtagatgcagtcaaagaggatctttctgaggaagtgacacttaagttgagctttaagtataaagaaggagccagccatccaaagaaaaggggaagatccttccaggttcagggaacagctggtgcagaaactggctggaatgcgcttgtcaagttccagggaatgggaagaaagggtcagggtaggtgggaggtagtggaaagaggatgggttgggtgagtaatagccagagcttagtgaacacgggggagagttggagataaggtcagagaggtggatatggggctcagaataggtaggcaaacaaattgccagaaggagtaggaagtagaaaatgatgctgcttgttgattaattctgtcgccttaactagggtcttatcacttactgtttttgcaggtactgttggactatcataataaagtcactctgctgagtgggagaggaagaggcagtggtcacctgggtcttttctggcagataaatttcaagctgggtgttcagattttcagcaggatgttcaattgaggacacacctctttctttattttgtcttatatactgctgtttaaaactgcataataagttctctgaatgtgttctagtatacgaatcctcctttgtttccagctctgtatgaatttaaggactgggcaagtgttaataatatgcccttatccatctaccaagatgaccatcaggatctaagtttcaagttgtcttttgtagggaggcagtttatgttgcaatagttccactcttgtctgatccttctgatgactaataacactcagctgaggtgtaggttggta

SEQ ID NO: 18929 - DNA, 1095 bp, Homo sapiens
tcctgtttttactcgattgagactttatccataccccttggaagttgtttaatttacctacacccgggctctttacctgcatgttgaaaacagtttggaatggacccaaagaaagttgttactaaggcctttcttttttctctcccagccagtcctctggaatgaggtgttcagttggcctagggttattcatttcttgtttccttcagcaaatatttttttgagggtctgttatgtgccaggcactctgctgggatttggaatacagagttgaacaaaagagcgataggacctatattccctgagcttttattgaccagtggactgtgacttttgatgtaattttatttttgagagagggtcttgctctgtcacccaggctggagtgcaatggggtgatcttggctcactgcaacctccgcctcacgggctccagtgattctcctgcctcagcctcccgagtagctgggactacaggtgcaccccaccttggctggctagtttatgtaattttttgtgtgtctgtggagacagggtttcaccatgttgcccagggtggtctcaaactcctgaactcatgtgatctacccgccttccaaagtactgggattacaggcatgagcccccataataatttaattattatttaaataatttttaattttaaaaattttaaaattattttaaaatttaaaatttcctttgcttatttatactcagtggacaacaaaatgtttatatattcacagagagatcaatgtcttattgtgatgagtctcgactgtcaaatcttcttcagaggatcacccgggaaaacgaccgagaccgaagattggctactgtaaagcagttgaaagaatttattcagcaaccagaaaataagctggtaagtatagtatgtttggaaatatgaggatttttgtgtttccataataaactaggtaatgctaccttgagtagtttaagaatggggaaagtctgtattatgatgatcaagaacttaatgctctctaatatgtaatttctttttcttcttaaagacaagatcttgctctgtcgcccaggctggagtgcagtggcacaatcatagctcac

SEQ ID NO: 18930 - DNA, 1032 bp, Homo sapiens
tcaccgtgttagccaggatggtctcgatctcctgaccttgtgatccgcccgcctcggcctcccaaagtgctgggattacaggcgtgagccgccgtgcccggcctcaaaatagttttcttgtgggatttcagggggaaaatgacttgtaccagataccacatgatttggttgggtggcgtgggaaggcgggtcttggcaattctcaggttcatcccatggcaaggatcggcctggatctcagtagtgtgtgtacacattcaaggtgggaagggttaatttatagttggggtcttgagccatgaaatcaggggagtggcttctgactggcaggacctgttggcgctgttttctgccacaccgtactttggggagaagggggagggggaggcatttcttcataaatgtgagaatgccccgagggcaagactcagcagggctctgtgtggtttctctgaggctctgagcggagcagccgcaccaccatgcaggtcaaagccgggaaaaatcgtaggacaggagtggggagagcctgtggcttccagctgggcgttggacatgtgaatgtaggggatgactgatttcttttttttgtcattagaatttcactggttcagtctccctctcgcctaggtacatgcccgcctggtatgtaacgacatggataatagcttatgcagcctgcactcttacctttaaaaaatgaatccctgttggctgggtgtgatggcccacgtctataatcccagcactatgggaggccaagacaggcagatctaccgaggtcaggagtccgagaccagcctgaccaacatggtgaaaccccatctctactaaaaatacaaaaattagctgagcatagtggctcacgcctgtaatcccagctacttatgagtctgaggcatgctccgggacgtggagtttgcagtgagttgagatcctgccactgcactccagcctgggtgacagagcaagcctgtctcaaaaaaaaaaaaaaaaaaaaaaaaagcagcccctgggtgctgagtgtctgac

SEQ ID NO: 18931 - DNA, 1035 bp, Homo sapiens
acatctggctaatttttgtatttttgatagagatggggttttgccatgttgctcaggctggtctcaaactcctgacctcaggcagtccactggactggcctcccaaagagctggaattaagatttcaaattttcttccttttcacccatatcaatcctttctccttaaatattgaagcccttgaaatcatctttggagaaaggcatagacatacctctcaggcgcttatccttaaccttggcaatggaaactttccacattgattgagacctgtctcagatacttttggttcacagaagtaaacgtcttttcccagctttcgtatattttgcgtgctccctttgattctgtcaggcttttattttattctttattagggtgggtctatttaggtttttgatcttattctaggacatgatctttacttctaaggcatggcttttctggagttataactgtaaggggtgctcagtaaggtatctctactgtggctctcagtaagaattccgacattttctgcactatgtaaactctgggtctacctttgttacaggtagttagacaggtatgagcgggacaggagagggctctccccccatccaccaggaatgtcgggtgatgatttggcagttatcacattgcctctctaagtgataaattgggccaggcgcggtggctcagacctgcaatcccaacactttgggaggccaaggcgggcggatcacctgaggtcgggagtttgagaccagcctgaacaacatggagaaaccccatctctactaaagatacaaaattagccagggatggtggcgggtgcctgtaatcccagctactcgggaggctaaggcaggagaatcacttgaacccaggaggcggaggtttgggtgagccgagatcgcgccactgcactccagcctgggcaacaagagcgaaattctgcctcaaaaaaaaaaaaaaaaagataaattggagaggccatttcctgatagtccacacccgttgcactaaattaacagtgttaattgaatgcagaca

SEQ ID NO: 18932 - DNA, 1020 bp, Homo sapiens
gattcttacatcgcgagggcaagggctaggacatgaggccactcagggctacagaggggccttgaactggacagagcgtctgcaccttggggacccaacatacaaactggggctccacgcaagatcccggcccacccgggaggaagcggcagcacgggagcgcccctacgtggctgtaggcaggatcacgcccaaggaaaactcaaaatcaaatccaaacacacttgtgaggatttaatattaaaaatattaatttttgatatgtaggcactcttcattttaatagtgcgttcctagtgtgtttactgctgctgatcgcgagagcactgtgactccaagtctccgtgagcaacgcaggagacagcggttctatattgagcatgcgcaaactttgagggcggggcgcctccgtcatcacactaatatgccggcataggaagccctacgatcgggaggtagcgtggccgagtggtctaaggcgctggatttaggctccagtcatttcgatggcgtgggttcgaatcccaccgctgccacacctcagaaggtctcacttttctatccataaaccatctctttatgtagtcctttgccaacttctcttccttttttctcctttctgatgtatttcttttttaaagctttagattgcttataatggattttttttaatggaagggggaagggaagagaaaaggcagaaactgcagtgcaggctctttcactgtctagcccaatacacaaacctctctttcacctacccatccagctccctcaaaacaaaacaaaaaaacaaaacacatctccccatttccaggggaaagcatctgagctagcttgaaaagttcccaacagcctgtctgggtcttcctggggttagttgggggtggttgtaatcatgacctgagttagggacgggggtccctttctggcctgctccgtgtactttagagggctccagggaccccataaacctctgttgtcaggtgaccctggagtagtaggggtctggccctatgt

SEQ ID NO: 18933 - DNA, 1091 bp, Homo sapiens
caaaaacacgttatgatgggaaacagtgatctaaaaagagaaacatccccaaacaagacacccaagccatgcacctgactttgtgttgcagtctctgataaaaaccctcacgcagcacctctggttaaagatgagccaagtcatctctagagacccagcaagacagtgtacagaaataaaaacacaaaagtaaaggcattaatgctatgtctggaaacttgaatataaataaaaacaaaggtatatgccagcataacaaaagaactggtgaagagacatgagaggatgagtggcttgaacatatttctgcatggtaaaatgcaggcgtgcatcggacttagcaagcaggtgaagcgacaatctaagctgcacggagatgagaagagggtgtcaaaattggtgtgaagtcttaatgcacaaacatgccactgcatccatgaaacaggatgccgtaaaatacgttacaccccaaaataaaaatggaaaagattggattcagtatgtctaatatctgtcataagaattctgaaaaaaacaaaaaaaagtaacaactcacaggattttataagaactcaattgtctagtacaataatgacccgcaccagggcacagctgaaatggcactgactgatatacagaataatgaaaaattctgcagtttggcataaaggaaagaatacaggccaaatttaaaagaccaagaaggagaatgttatggaatttcaacaactctgaaaacttaaacaatggaaactctcttaaagatgcttcatgccgggcgcagaggctcacgcctgcaatcccagcacttggggagaccgaggcaggcggattacctgaggtcaggagttcgagaccagcctgtccaacgtggtgaaactccgtctctactaaaaatacaaaaatcagccacgcgtggtggcacacgcctataatcccagctactcaggaggctgaggcggaggttgcagtgagccgagatcgtgccattgcactccagcctggctgacagagggagactctgtctcaaaaaaaaaaaaaaaaaaaaaaaaaaaaaaaaaaggatgcttcatgtatcactatttgtctag

SEQ ID NO: 18934 - DNA, 1033 bp, Homo sapiens
attttattttttaacacaaacttttttgagaatgagaaccgcctcccgagtagctgggattacaggcgcctgccaccacgcctggctaatttttgtatttttggtagagatggggtttcactgtgttagccaggctggtctcgaactcctgtcctcagatgatccacctgccttggcctcccaaagtgctgggattacaggcatgggccaccacacccggcctaaaacatgcaatatttaagatatacagaatggggtaagagaacaatacagtgaatacccatatatccaccacctagcttaaaaaagaagactgcccacactcttgaacttcccaccggagagggaacttatacctcctccttggtgacatatccctcccacctactaccaaaccatatcctaaatttgaaaaaaaaaaatcatagttcctgatttcacagtgtgttcagatgttttgctccattcaaataatcataaaatacatgttgctttctctctgctgtgatcttgatttgtttacatttttgctggatattttattaaaatgctacatttttggctgagtgtggtggcttatgcctataatctcagcactttaggatgccgagggagacagattgcccaagctcaggaattcgagaccagcctgggcaacgtggtaaaaccccatctctacaaaaaaaaatacaaaaattaggctggtgtggtggcgtgtgcctgtagtcccagcttacttgggagacagaggtggaagaatcacctgaacctgggaagtcaaggctacagtgagccaagaccgtgccactgtactccaggttaggtgatgggagcgagaccttgtctcaataaaaaaataataataatataataccttttgcccagcttaacaaactaaaatgaaagatgctagactagggcattaaaatggccctctatgctgctaatcttataaatagtccccttcaagtagttcagttatgtgtaggccacttgactgtaaagataatcacggatattaaccagtgtccca

SEQ ID NO: 18935 - DNA, 1029 bp, Homo sapiens
ccactgtatcaaaggactgctccataagatttactatgcaaagaagtatttcaatgacgtatgttacaactagtgtcctttcttatattgttaactaaattttcatttctgggagttgagtataatataaacaaatcctgttttatgggcattatacctaagaatagagagagttgaaaaatgaggtttaaaataaaatatggttctgtgctaaatggaagtatgagctactgacatgtaattacctcaaaaaccacatttctgttttgcttttctagttgctcatcttacagaaggacacgaagagaagtagagtgacctggggcagtgttcttaatgctgatgtatttttccttttcttgacttaataaattttagtccccttaggagtccaggatatatgacaataaactttaacagttgtattcacagcaggcaaattcatgggaactttaaagatttttgaaagctccacctataccttggctcaagggtccattcaaaaaagtagactgtcaggatatgaatacattcattgtactagcaaataggattttagaagtaacactgcggaatgatcattcctgaacaaataactgcatctccataaagtagatgaccatttttcacttcttacaagtatgggtacataagagaatacattacctgctggaggcgtcagtttaactgaattttaagtagaactcgggtttccttctgtgccactccaccttccattgggatgtgacttaaactacatgttcttttttgaaggactgggttatataaattgttgatgtgagatcatttgtattattctaagattcatttgttgtgctagatcttcaacttgctgctgagcttgggaagacattactggatcggaacacagagttggaggactctgttcagcagatgtatacaaccaatcaggagcagttacaggaaattgaggtaattcacttggcaggagagttacacttttgacacttcgatgtgttgctgttatgccaatcacatactggtaaa

SEQ ID NO: 18936 - DNA, 1045 bp, Homo sapiens
ttaatgatcctgttctcagtatcttacaactatagaatgttttcctttagcagtagtaagccatgctctgaatagattgaatctttgtatcaaagtttcctagggtatccgtttttaaattgaaattgctggaaatttctaacctcagtaaactctggtctactattcataccttgttagaaacatgtaaagcttttgtgtaggcaggaggagaaaaccctttgctgttacaaaactctttgatgaagagactgtcttttgtcagagagctgagttggctcagtaggaatactgacaataatctctgtgggtaagatcttttctgggacagcaggagccttcagtgcaggtaatgatggtgcttgctttgaaacatgcccctgagaacaaggtggaaagacttcagagactggattttcttttaaaccagctgctattgtcatttggtgagctgtgcaaacttagaataaggattcaggtttctgttatgtggatcagtaaatgaactcttagtttaaaggaatcctaaaattgcaggatgagtacatcctccttgtgtacaactattttgctgaatcactgtttggagggttattaaaactgacaacatcatttttcttgatatttatattcaggttttctgctttcccaattatagtaacattggcaacaggagttaaacagaagcatcactaaatgacgcatttgactttgtaataggaaaaactttcagccttactgttagtgaattactcctacagactacagctgccagtactaattttttgcctaaagcatagagctgagtatctgtttaaagctaacagtttacaccattaaaaatatattattacctgcaaagactcattagtgaaagaatattcaacatatgaaggtattgatatgttgaaattctcaagcctgcaataaatctacagtatttttagtagttgcctaaaccaggccagttcaataggatttagagaagaccctcttaatgaaaattcattttgtaatcctgtagagatgaacaggtgtataaggc

SEQ ID NO: 18937 - DNA, 1026 bp, Homo sapiens
ggggaaaattataaaatattgaaagaaatttctaaacatctaaatagatggaaaaacatcccatgttcatggatcagaagatttaacatcattaatatggcaatactactcaagctgatctacaaattcagtgcaatccctatcagtattccagctgacttatttgtagaaattgacaaactgattctaaaatgtatatagatttgcaagagactcagaatagccaagtcaatcttgaaaaagaagaacgaggctgggtgcagtggttcacgactataatcctaccactttgggaggccaagacaggaggatcacttgagaccaggagtttgaggtcaacctgggcaacatagtgatgccccatctctacaaaaaataatttttaaaaattagctgggagtggtggcgcatgcctgtagtcccagctactcaggaggctgaggtgggaggattggttcagctgaggatgtcgaggctacagtgagcagtgtaggtcaaggcgacactgaactccatcctgggcaacagactgaaactcttgtttcaaaaaaaattaaattaaataaaaaagaaaaagaagaataaagtaggaagactcatacttctcaatctcatcaagaaagaaagtgaaaagacaacccacaggagaaaaattttgcaaacaatatctgataacagattgcatcaaacatatattaatatgaagaactattacaactcgagtattagtaaactaaataaaaagacaacctaattattaaaaactgggcaaatgggctgaatagacatttctctcttttactttatttctttctttcttttgagacagtcttactctgtcacccaggctggagtgcagtggcatgatctcggctcactgcaacttccacctccagggttcaaggaattctccctgcctcagccacccgagtagctgggattacaggagcccaccaccacgcccagctaatttttgtattttttagtagagatggggtttcgccatgttggccaggctggtcttga

SEQ ID NO: 18938 - DNA, 1038 bp, Homo sapiens
tcaggccaggcgcaatggctcacgcctgtaatcccagcactttgggaggccaaggcgggtggatcatgaggtcaggagttcgaaaccagcctggccaagatggtgaaaccccatctctactaaaaatacaaaaattagccaggtgtggtggcgcatgcctgtagtcccagctacttgggaggctgaggcaggagaattgcttgaacccgggaggcagaggttgcggtgagctgagatcatgccattgcactccggcctgggtgacaagagcgaaactccgtctaaaaaaaaaaaaaaaaaaaaaaaatcaaagaaataaaagaagatcaaaataaatggaaagatagtccatgttcgtagataagaagactcaatattctaatgtatcagctcttctttgatctatatattcaatgcaatccctgtcaaaatccccataagttattttttggatactgacaaatttgttctacagtttatatggagaggcaaaagacccagaatagccaagacaatatggaaagaaaagaacaaagtcagaagactgacacacccaacttcaacacttactataaagctacagtaatcaagaagtgtggtgttgatgaaagaatagaacaataggactatttagttctattgttcaaaatagacccataaaaatatagtcaactgatcttcgacaaaggagcagaggcaatacaattaggaaagatagtctccaacaaagagtgcaggaataatgaatatccacatgccaaaaaaatgaatctagacccaaaccatatacccttcacaaaaattaagtcaaaatggattacagacctaaacataaaatgcaaaactagaaaactcctagaaaataacacaggagaaaatctaggtgaccttggggatgttgatggctttttagatacagcagcacaaaaggcatggtcaatgaaagaaagaactgataagcgaaacttaaaaaaactgctgctctgtgaaagatactgtcaagagaacgagaagacaagccacagatgggaaaaacta

SEQ ID NO: 18939 - DNA, 1008 bp, Homo sapiens
gctggatgcggtggttcacgcctgtaatcccagcactttgggaggctaaggaggaaggatcacttgcgcccaggagtttcaaactagcctgggcaatctagtgagaccctgtctctacaaaaatttttaaaaattagccaggcacagtgtcgtgcacctgcagtcccagctactagggaggctgagtcagaaggatcccttgagcacaagagttcaaagctgcaatgagctgttattgagccaccgtactcagcctgggagacagagcaagaccctgtctccaaaaaaaaaaaaaaaaaagatatataggctaggtgtgatggctcacacctgtaatcccagcactttgggaggccaaggcaagtggatcatttgaggtcaggagtttgagaccagcctggccaatgtggtgaaaccctgtctttactaaaaatataaaaattagctactcaggaggctgagacatgagaatcgcttgaacccaggaggtggagtttgcagtgtgatgagatcatgccactgcactccagcctgggcgacagagcaagactctgtctcaaaaaaaaggaagaatgagaaagcaccttatgtcatgacatgacacaaacttcaacatataaagtggccgggcacagtggctcacacctgtaatcccagcaactagggagactgaggtgggaggatcacttgaggccagaagttggagatcagcctgaacaacacagcaagaccccatctctaaaaaagtaaataaataagtttgaggctgcaatgagctatgattgtaccacttcactctcagcctgggtgacaaagcagaatcccatctctaaaaataaaaatagaaaataaaaataaatagtccagagaacagaatatgcatacacacagagatacagataaaccaaatatggtaaaatgtcagcaattgatgaatctaagaagtgggtatatgcatgtattttctctgtaattttctttaaactttttttatatttggaaaatttt

SEQ ID NO: 18940 - DNA, 1050 bp, Homo sapiens
tgagtcgagatcacgccactgcactccagcctgggcaacaaagtgagacttagtttcaaaaaaaataaaataaaataaaataaaataagtgactaaattggccaggtgcagtagctcatgcctgtaatcccagtgctttgggaggcagaggcaggtggatcacctgaggtcaggagttccagaccagcctggccaacatggtgaaaccccgtctctactaaaaatagaaaaattagccaagtgtggtggtgcgtgcctgtagtcccagctactcaggaggctgaggcaggagaattgcttgaacccaggaggcggaggttgcagtgagctgagattgcaccactgccctccagcctgggtgacagagcaagaagacattgtctcaaaaacaaacaaacaatcaaacaaacaaacaaaaaacagtgactaaactgagagcaaagaaatggaagggagggagcaggaggatcatcagtttccatccttttactgtgtgctcaaatgtaatttggctgcaggtgaggtctgtgcagaccctgggtgaggggcgagttggctatggcctgtttaactccacctgtgcagactgcagctcagcctcgtccatgcttcgtgactcagccttgtcctcagggaagctggggctggtgcaactttcagaagtggtcccaggtaagcctggccctcctgagtccatgggtggggaatgctggtacaggcctagcagctggctttccggggctgggtggaggtacaagagcggtgatgtgtggtgttcgccactttccatggtgcaattacccctgcatggccgagttcaagttttgaaggtgcagtcaccaatagtggagttgggaagagatttgcacagtcagctccagagccagcatgcaccatctcccacccgtcactgccccctgccttcctccctcttgtccctgcagcctgggatctcactgctgctctccaagtgaggaattccagtaaggcttcttaagacttctttttggtttacctggcagaaccccacctcaaactggcttaagcaaa

SEQ ID NO: 18941 - DNA, 1029 bp, Homo sapiens
tgtttgctttttaaagttttattcttgatttcttgtaaacatccattgcactgaggccgtatcattccttaagacagccctacatcttgccttggtaatcccttagataatgtggaaactcaaaccgttaggctccagtcatcttagaccatttcccatccgttttgtattttctcgtcctgaaagcagctgaactgaaagtaagtaataatatgctggaccagtgggaacggatgtgggagtatttgtggtgtgctaaaatactgtaattatctgtgaggctgcctgacacgcttttgcaatcttgttttcatcattcattctgcaaacgtttatggagggccttctttgagcacagaggcaaaactgaaagcttcagggatttgctgtagctgaggagccctgggagcacagcccatcaagcaagggatgtgatggtgtcctaaatggagtgacagttctcctgggaaaagagatcacgtggattccggtcaaatcggctaaggcttgtggttctcttgagcaagtctgttccttctggaaaccaaaagtgcccttcatctttagagacattttactcttccatccaccttttcagactgagctgtctctactatttaggggttgaaaatccattacacagtcactttacgttaacattgggtcatcttatgtttgtatgagacggatgtgggatttgaggggaacattgtcattcccttaaaataactatcatgaaaaaaatagcaacagtatgtaaagggaccaagagtggcagcctttagggaaaatggagcagagaagagctgtgaacaaagctcatttatttgaaataagcgtgctttatttcacatagaggggcatcagacgttacatttcattcggacaaattactgaacagccgaagtgattgtttccaatgtaggttattataattattggatacaaagatttaactagtgtttctgggttggatttttgaaatagtatgcaagtcataagcacagtttcaataaaacacgtattctg

SEQ ID NO: 18942 - DNA, 1056 bp, Homo sapiens
tctgcgagatgtctctcagaccactgccagtcctgatggtctggagaagttcatagaattgggagatcaattagtatcgaatttccagttacccacctgtttacatttttcctatttttagattgtgttaacagaaatgtactatgatgggttccatcgttccttttgtgatacagacgacctggaaacagtccatgaaagcgactgcatttttgcctttgagactcccgaaatatttaggcctgaaggaattctcagtcaaagaggtaagggagctcctgtttccataatgccacctgggtttgcaggtttaactatagtctacctttttagttgtctattatataatgatatacatttttttttaaattgtggtaaaatacacatgattttttaatgatggtataatggtaaaaatcttatagtaatattttcctagaagaaggcagctcttactgttttaggcaaagatatatccatagtttagttgggaaaacctcttattgagatttaggactgactgtgacctctttaagtagcctttttggcatcttatcatgacattcaggaagatatactatgccataggtttttttttttttttttttttttttaaattttgctatcagctcttaagattctaacatttttgctatagaatgttttcttggtacctgcttttaagaaatttgcatgtaactcttcattgataggcagcaaaatgaagtaaagccctggacagtatttttcctcttactgcggtttgggctgtgatttggaacttagcttgtctccccactgtgcctggagttacagggttattctgattttaagagttaccaagcaactcagactttgctcctcgccacagcattcttcagggttcctcttagggctcctcttcttttgctctaccccagtggttattaatgcatcagtattacctgggaactggttagaaatgcaaattcttggtccctactccacaccgagtaaaggagaaactctggtaaacaagccctttaggtaggtgatcgtgatgcaagctaagtgaga

SEQ ID NO: 18943 - DNA, 1052 bp, Homo sapiens
gtgaagttgtactttcttttttttttagccaccatcagagactgatatgatgcctgagggaccatctttccctgtctgtagcacttttgtacaagaactctttcaagcgcaatacaggtatgagaaaatcggatgtttccacttattttgtttacctgacatcgttctgggtgattttaatgtcaagcgtcttacctttttgttttgaagatcttctttgacgtgtcctcattgtcagaaacagagcaacacttttgatcctttcctttgcatttctttgccaattcctctgccccacacaaggtaagaatggatttagtaaaatgaagactgtattttcttatggtatccctttgcctctgtaggctcctattaggtcttcttacttatttagacaggtaatgggattaataatgggattgaatacagtcattgctacaaccttacaagaataaatgccctcctgagtttgcagggtgagcaggcacatgaggcaagcaggggctgtgtagtctggcccagttcgtcatccacacatagtatcggggttgggggacgggggctgctgagtgacttcaggattctctagagaccttactttacatttcttgtttcttcgttgctttattttgaacaatttctcaacatttccaggagttatgctgttctaaagaaaatacaaagcacagaatcaagtgtagatatatttttgtttgcttcatagaatgttcattttatgaagattgccttttccaaagatcttgatgattgtttgacagttctgcttagagccaagtgaaatttttccatttgggcttccgagtaacagtgtgggttagctttagttttttgttgatttcgtctcaggtttattttgcatcttctatattttagttgaaataagtgactaatgagaagatctgactttgatctgtacaggcctctctatgtcactgtagtgtatcaaggcaaatgttctcactgcatgaggattggtgtggccgtacctctgtctgggactgtcgccagacttcgggaagcagtgtctatgg

SEQ ID NO: 18944 - DNA, 1034 bp, Homo sapiens
tgtaatcccagctgcttgggaggctgaggcagaagaatcgcttgaactcgggaggcggaggtcgcagtgagctgagattgtgccactgcactccagcctgggggacaaagcgagactgtctcaaaaaaaaaaaaagaaaaaaagaagagtgataactttgaaaagttactttctttctctgaggctaagttttttcatctataaataagaatacagcatagggaatttcctaagggtgaatttatttattttattttattatttttttgagacagagccttgcagtgtcacccaggctggagtgcagtggtgcgatctcagttgactgcaacctccgcctcctgggttcaagcgatcctcctgcctcagcctgtagagtagctgggattacaggcatgagccactgcacccagccattaagggtgaattttatagaaaataacatctataagcaataagcgtaatgcctgatacagtataagcactcaataagtattaactgttattgttaccctttgcaccaagcactgtatttgctaggtattggggaagtaatattgagtaagacattattcctgttcactgtctagtgatacatgtgagatggtatgtcctagagatatgaataaaacgtaatgtaagaagtcatataatgcacttatgacaaaggagcctcccataagttttggtgcttttggaagtgaaactccggagcttttccagtgtggctgtgttcgttctcagacttggcttcacattagaaatagtcattaaaaataagtcacacttgaaaaaaaaattagcagtgggctgctgccaggacatggtttttatttttaactttccccaggcaattctaatgtgcagccaggattgagaactaatgctttagatattttctcgttttctttatctttggcatttttaaggattatgtagtatcatagggtgattcttttctttttttattctatttttcaaaactaacataatagcatctgtacagagttttagactttacaaaatgcttttat

SEQ ID NO: 18945 - DNA, 1028 bp, Homo sapiens
aacctttctttgtgaacatttcaactatatataactaagaggggagagcagtacgatgaacctgcatttccctgtcacccagcttcaacaactaccaatttgtggacaatcttatttcatctgtataacctttgcctttattctccccaaacttttgaagcagcttccaaatgtatttcacccataaatatttaagtatatatctctaaaagataaggatgctttagaaaaatgataatgccattgtctgcctaaggaaaactaatattccttaattagtgttcatatttctctgatattgtttctgtcacacacatatatatgtacacatatatgtgtacaactgtgcatatatatttcctacactttatgtaaggatccaaataagtttccaaaatttcaatggattgatacatctgttgtcgctcacaacctctctctctcatttattttatttttcctctggcagtttatttgttgaatgcgtgtttgtctagtagagcagagctcttcaaattatttgtggtttaggactaatttttaaaatttccaatctattgtgggctgtttgtaaaatacaatacaaatgaattaatagaaaagtgacataaaaaaggcatatgtaagaccagccccattaaaaaattgttaaattcagaagacataaagttatggtttaatttgtaaatacttctaaatgcttactctcaatttctataatctcatcatggactggcaacggaaacttcatagtcttgattttttgtattatattccagtagcttcaattaagatgttcctctgtccatgtatttcctgtaaaatggtagttagagctagaggtttagagactcaagtttgaggtttttttctcctctttttggcaaaactttctgtcgtggtgttataaacttccatcagaaagcctgcactgtttggttttatctcttgtggtgccaagaatcactggtagttgttccctgacccgttaatttattaagggttgaaagtggtgaaattataattct

SEQ ID NO: 18946 - DNA, 1045 bp, Homo sapiens
cttaaatcaagataacagctgtaatcatatagatgcttttcctgagttagttgttttatgtcttcctttgtgtgacttaaagtttttagtttgactctgctacttttgttctatttgtgcgtggcttgatggatttttcctgtccccatctatacactcgtcacaatgaggggctactaaataaggcagtgttctctgtttgtgtagtccccacagctgtttcctatagtaaagactctggaaaacaatgacctcatagtttccacaaaaaaaaaaaaaaaccttttatatttagtaggggaaaataaatcattcaaaattcagtaatttaaagttatgtcctctgttgcttcttccttcaaaaatattattgtttgctctgctaattaattgttcattggctgttcctcaaatgaccttttatgtttaacaaacaacatttttgcagtggagcacgtcgggatatcttgtctttcgtttgattgtgatctttctctatttagaaatcattgttttaagccatggactgtggcagttcctagagcaattggccagtcactgaacatctgttgcttcttccctccagctgttgggttcggatggtagcaaacagtgtgtccacaaataaacagttgacgctttagaagatttcataggactggtcaggaaatgcctttgttggtatctgcttctactggaaggaccccttctttgtaaacacatcactagctcagtatatgttttggctttaattcttggtattcttttgatcttgaagagcaaggcagagagccatctgattgtcaggagatttaagaaacaataataatcacagtgatggaaatgccgcttatttgtgtagggccatatcatttacaaagtgaattcatgtacacaagcccagagagaaaagcaagctgatgatggcaggttccatgtgccttttatggttcattagagttcttcagcatcaaatgccctcccattcattgctacactcattttactgcttgctcatttcagtcctttggtactctagtgacac

SEQ ID NO: 18947 - DNA, 1027 bp, Homo sapiens
gcgcaagtttccttttacttccccagcctttaaaatggttaccttgttatctctcgcgctctctctttctctctctctccccccccccaacctctccctctctctttctccttctctgtctctgagtgtgtatatgtgtttgcagcagcactagggtaaaacttgggcttcactggcaggacccttgcatcactttcctagtaaaatagtgagagtaaataaatcactttgaatacataatatgccattttaaagggaatcagcttattgctttcataggagcatgggtgccccagattcttacaaatgctttctgagttttagagctcagagccgttttgcagcaagtaaaaagatggatggtcatctttcaagcaagaaagataaattttatggcagcagtttttaaattgtgctggcaaagaacagctagcacagagtgatctattgataaaagaattgtggggactccttccagatttgcagtgaaacaaatggtaattgatgaatagaattctctctcccatttttttttccttgaactttggtgccttgtggtgcttatttattagtgagaattctcaagtcacaaaaggaataaacttgtataagagactagtggtgaacaacctggcaatcagaggctcacacttgctgagtttcccagcctgcttttccatgcactcatgctgggggttctggtgctatgctgcaaacccatggtacacagtttttttcttgttagtgtcaagctctttagtatactgatacttcagtgttttccacaaagcacactgacttcagggtgtcccttggaaaaaatgaaattgtgtaggtcacatttagctttgtgacagagtataaaataaaaagtacatcccttcctggtcagttctctggtccatcaaatgccatcacttgagttttagcaaagctccacacctctgagggagaaagttgatagaatcatgaagttttagacttggaagcagacttggatgtggtgtgagtagttcctagcctttca

SEQ ID NO: 18948 - DNA, 1022 bp, Homo sapiens
agggagggacacatgaactctccctaatcctctggagtcctctgaaaggacaaggtctgtcttccttagctggtctctgaattgcagcccatctcaggatttcaggactgcagaattatcgaagggttcccaggatatgtgcctgtttccccttgtttgtagtcccaaagagagtatcccaggtattttgtgtcagaattgtttgaaacactcacttgacttaacattgacccctgttcctgggttgctctccactgatttgacatcttctgtctcttctgtcccaggaacctatccgcttacggtacaagctgacattcaaccaaggtggacagcctttcagcgaagtaggagaagtgaaagacttcccagacctggctgtcttgggcgcagcctaacttttcacaagatggacccttcatttcaagcttaggctggcgttacttttgctgtctagtcaggactaatcacggtgtttcagtgcggagtgccaagagtcctatcctgacgtcaggctctgggtgtcaacctctgacttattctgcagatgctctgtgtgtgtgtgtgtgtgtgtgtgtgtgtgtgtgtgtgtgtgtgtgttcggggagagggtggtagcacagggcttgggatatcggcagtgtgggaaatgcgaagcatttctcatcatcatcatctctgctacagtcatgtttctgcatgtcagcgagcgacactgtccctgcctcaggttggaggttttatcagccaaagtgtttttttcatgtatcgttcgttccattcatccactctgtgccttgtcagcctttgaaaggcttggttgctcccaggctgctgttctcagggaccttaaaagggacctggttagtcttggggcagagagtatctacttgggcactctcttccaagaaagaccttgtctccattttcattagacaatgcttcttgtgtgtgttctggaagatcttctaaatggaatgcttgttgcactgttcccaggcgagtggctgccatgagacctg

SEQ ID NO: 18949 - DNA, 1044 bp, Homo sapiens
ttagaccagggctggcaagttcatgtgccttttctagagagggcagttctagcacagggcccactagctgttggcaggtatgagtatgggctcagggttgctagtttaggtctttgtatatgtttgagtgtttagatgttggtgactaatttgcagtgttgaaagccacagtatggacgagaggaggggtctgcaggctcagcttgcctcttgagtgccagtgggtgacatccggctggtcttgggcactggataccagatctctgcctctggggaggggttggttctttagccactttctcctctcaaagggtctccttaaaaggtggggtgacctcagggtttgacatacctcactaagctatttcctgggcataaacctcaggcagttatagcaagattgaacaggggacatttttttcttgatctgaaaacgtcctcttcatcaaaacttcagtgtcctcataggcttgaggcagggttagccttggttccagcgcagtctccagcaagtgattaccagcctggaggggagcctgggaccactggctttccaccttctcctgggggtcctgtgtctgtgcaggtgctggagatgtgcatgaaccactgtggggagaagttccacagcgaggtggccaaatttcgtttcctgaacgaactgatcaaagtgttgtccccaaaggtgagtacctgggcttggctctgctgactgtgtcgcacctacgcccactgtcaaactcctggctccctcctcaggccagaggcaggcccacgcatggacaaaacctgctcctgcctgtgaaagaagcgctctcctctccaagctctaggaagaggctctgctcattagctgacccctgcccctcactgttagcattttcacatttcccttttaagaaggcctggggaacgtgtggcctagaggagatgaggaactccagcttggaggcacaggttcctgatagagacagtgagagatcccaggggtggcgtgaaagtttcctatcacctcctgccttgtcctctgtacctgtcctcctg

SEQ ID NO: 18950 - DNA, 1119 bp, Homo sapiens
gaagccaacacccgggccaacctctgcactaaaagtggagccgctttcaggggaataacttgtcagttaatttttttttttttttttttttttttgagacagagtctccctctgtctcctgggctggagtgcagtggcgcaatcttggctcactgcaacctccacctcccaagttcaagcgattctcctgcctcagcctcccaagtagctgggattacaggcatggatcaccatgcctggctaatttttttgtatttttagtagagatggggtttcatcatgttggtcaggctagtctcaaacttctgacctcaaatgattccccccacctcggcctcccaaaatgccgggattacaggcatgagccactgtgcccagccagcttgttaatttgctggttcattcaatcagcaaatattcagtaagggcataccatgtgcccaatgctgtgctgggtggtggtaggcagcgcaggcacaattcctctccttccagctgtctgcccactggtctgatcctgtagatctgtgataagacagctcttggccaccatgtgtatggggaggggtgtaaatttcttcctattatgtactctctaactttattatttatttgacagacaaagccacagacccaagcatgtcggaacaggattggtcagctatccagaatttctgtgagcaggtgaacactgaccccaatgggtaaggtaacttctcacacacatagttgactctgggggcaccccacactgagtgtaggcctttgtctctcaagactgttttagggttaagctctctaggcaaggatcggtggctcatgcctataatcccaacagtttgggagaccaaggcaggaggattgcttgagcccaggagtttgagacctgcctgggtgacagagtgagagactctgtctcaaaaaaatagaaatgcagtcaggctggcattcattctctcattttcccctataatcctgagaacattatttttctaaaattagcaaattcatgtgggggaaaaaaaacacaggatagctcacttgcaactggcagttattaattttaaatactgttataaaacactaatgctgaggagaactctgaatgttactgataga

SEQ ID NO: 18951 - DNA, 1047 bp, Homo sapiens
atagatcaatttgtgtattcaccaaagagtagactctacaaccactgaaggctttgcatgaaatgttttaacatgtttcatctaatatttcatcttcagacacaaaaaatcaatacatgaaaatattcaattacgtataaagggctatagactatggttggaggaggaaatcgcaaatcgacagtgggatattccaaaccactgtattgtgaaagcaaacacaagaaagaaaatagggattcctattgttcccgataaaaggaaaggaaaggtaactcccagagagccactccctcactttgccatattcaaatgttctgaacaaggcacaggtctggccatacccaaggaaagatgaggattcagggtgtaacaaaagacagcagagatcatggggcgtcttaggattctgcccccaatatccacccttccacaaaaacttaatctgacatctcacattggtggggatctggtgttcttgtaagaaaaaaagaaagtctcagaaagtgtttcccttgtagactctggggcagttgatcctcagcactttctattttggaagccagaaaattcctttttgactgagaaggggtgcagtcctgtgcaccataggattcccattgttgactgcatgtcagtgggagccaccagctattacaaccagaaatgtctgggcaaacttcctcaggatgcagaagctgctcccgtgagaaccgctgctcctctccatatgtgaacagactgacagatgcaggcagcaccagcaatctctttaaccactgaggtgcactggaaaatgtgagttgcagtgtgtccctgtgttagaattattaagaggcttttgttgacaattgctgagaccatacaatgcaccacagcaagattagctgggtaaatgatcttctgataaaggtttgaacccagatgttcctcttttgttgttttcctggaagtgggtaaattcagttttcacttcggtagctcccctaacaatcccaagaccaggtcttttactgcttccctaggtggcatgaccattatcggcct

SEQ ID NO: 18952 - DNA, 1085 bp, Homo sapiens
attagctatgtatatattgttcacttcaaaacagagtaagataaagcaaaccatgtacatactagcataggttacatataaaatgtcagttatagcctctgtatgttaaaaaaaattcgatgtagtcacaaggacagaaaaccaaacactgtgtgttctcgctcataggtgggaactgaacaatgaggtcacttggacagagggtggggagcatcatttaccagggcctgtcaaggggtagggggtttggggagggacagcattaggagaaatacctaatgtaaatgatgagttgatgggtgcagcaaaccaacatggcacatgtatacctatgtaacaaacctgcacgttgtgcacatgtaccctaaaacttaaagtataataaattcaatatagtgattaagtggcattgtaccaccctgttatcttgggaagcagatgctttcatggactaaattttgtgtttggtgctcctttcttgcagctttcagtaaattctcattttatgaaagacctgggcttagacagtttggaccaagtggagattatcatggccatggaagacgaatttggtaaggctcagtcttctatctacacactgcgatttttgattaaggtggattaaactgaaagaagtggtgggcgtctgaattggaattagaattaaatattaatagaaacagtagcatccactgcccttcacacacaccttcctgcccacttaccatcaggtgaagtaagctttagggatggtacatttattcagagagcaccttgcacaagcccagcagagtgcccagtgtggtgccaagagccgaatgaccagagatggttccaggggactgattcttcagacagggttctaagacaaagggcaaaagcctccccggaacacatgctgatgacatgtcagcccctcctgagctcgggtaacgcgaaccaggtagaagtaatgtgtgccaggacaagagacgcacccagagcctctggccttggtctcctatcctggctcacaagcacactccaagtttgggactgtgtgttgggcaggtgagacctttataaggttccatggctgtttctgc

SEQ ID NO: 18953 - DNA, 1050 bp, Homo sapiens
ctttgggtttaccatgacagctctttccttttgggttattttgacttgggtcagcctattaaaggtggcagcaccctgtagaggcctcgggatgctgaagatgccatgagaagacacaggcattctgcagacgctagacaattttagtggcagttagtgtcgcagagcagtatgaatgtccagagcctgagggttgaagccaggaggcagaggggccggtcctgactcccaggaaggaggcctgagatgctgctgaactgttggggcttctgcgattacccagtcctgcaacttagtgtgtcctggtggccacaatgagaatcagatgctgtgggttctctaaagccccgaaagttctgtgaaagttacctataggcttgtgcattgatttagaggtattttccattcaatgacagtgtttccttcctgccgtcgctctaggttcctggtagagttacacagttgtgccgccagtatagcgacatgcctcctttgacgttagagggcatccaggaccgtgttctttacgtattgaaactctatgacaagattgacccagagaaggtaactgatggtggtttgaatttttttctttaaatatagagtatttaattacatgctagaaaatgcaaagggaaagatactcagtaaaaatctccctggctcccagacacccaggcccattctgggagatagccagcgctaccagtttcatgtatgtttccaaaggtactcaatgcatatgttaaagaagtatacacacgtgtgtatattatatgtatgtatctctcaccctttttaaaaaacacaactggccgggcactgtggctcatgcctgtaatcccagcactttgggaggccgaggcgggcggatcacctgaggtcgggaattcaagaccagcctgactaacatgtagaaacttcatctctactaaaaatacaaaattagccgggcatggtggcacatacctgtaatcccagctactcgggaggctgaggcagcagaatcacttgaacccgggaggtggaggttgcagtgagccgagatag

SEQ ID NO: 18954 - DNA, 1033 bp, Homo sapiens
atgttctgaatgttcaaaaaccaatttacaaatgaatatttctaatttgagcactccctgcacatgtgtgtcctcattctctctttgccaatatttccccaaatgaatggcatgaaatgtagtactatctaaggggaaggaaatggatgaatcagattcatgcctggcaagactggctaaaacaaacactgggaaccggaagcaggagaagctaaagctagaagttggctgagcgcggtggctgacgtctgtaatcccaacactttgggaggctgaggtgggaggatcccttgaggccaggtgttcaacaacagcctgggtaacacaggaaggccttgtctctaaaaaaaaaaagaagaagaacaagaagccagaagtccagtccagtaataatctcaacagttcctagacggcagggaaaaaaatcaagccagtggttaaatcctggatacttcagagcctatcggtcattgctttaattgtttggtttttgtctctgccagatctttatttttcctgacatactcttgacagtctatttgggatatttatttttctccgaaattaggggcttctctttattgtcctgagtcatccctgtgccaaagagagtgagtcgttgcgaagccctgtgtttcagctcattgtgattaaccctaagacgactctcagcgtgggtgtgatgctgtactgtcttcctccagggcaggctggcaggcaagtgtgcataactgctactctatgggtgggacattctgaaaggcactgtgcaaacacaaaaactagatatttttgtgtcacttagaagaatggaaaacatgaaatactatatatcatgataggaatattcagaagtaggatgaagattagtggacttgagtcaaaccccagattccctgcatcctgatctctactagtatggggttatataggtttttaatagtgtttattcaagccctgttttttcccctaaggtaaatattttggcagcacatggtggatcatgcctgtaatcccagcactttgggaggtc

SEQ ID NO: 18955 - DNA, 1113 bp, Homo sapiens
tgacatcagcctgggcaatgtagtgagaccgcatctctacaaaaaaaaatttttttttagtatcccagtatggtgatgtgtgccagtagtccaagctgctccagaggctgaggctggaggattgtttgagcccaggagtttggcactgtagtgagctatgattgctccactggagtgccaagcactccagcctgggtggtggagtgagaccacatgtctaaagggggaaaaaaacagcagaggaagtatggggataaacacactaacatgatgtcattcaagatgaggcctgcctatttgcttttagctgctcacacccaaattgatcaaagacattgaacagtaccaggttcattggctttgctcaggcttgaagccgagtggagttgctcaggggtggccattagtctggtccttgccgcttcactgcatgccgggcagcttgggtggctatccccatgtgtggttttaacacatgtggaccgatgggcttctgtctcagtagtctgctcgcatggtgtgttgactgtttcttctctctgtgtagctttggtgtgaagcttatggacttccaggcccaccggcggggtggcactctaaatagaaagcacatatcccccgctttccagccgccacttccgcccacagatggcagcaccgtggtgcccgctggcccagagccccctccccagagctctagggctgaaagcagctctgggggtgggactgtcccctcttccgcgggcatactggagcaggggccgagcccaggcgacggcaggtaaggaggctgacttctgctggcagtggaggctggacgccccagccttcttgcaggtggtggcctttgagcacggcatccatgcccaaagaactgctccagcatggagtgaacagatttactttcactcctctggttggcaaaagatggaaaaaaagactatgaatggctcgcttctttttatgttttccaaagaaagcaacattggtttgcattctttgccacactgctttggtgctggaaaccggaagccagtggatgtctcatagtgtgatgagcctctgtcacctgttggatgtatactgtcagcattcatgtaccttctgttcatt

SEQ ID NO: 18956 - DNA, 1031 bp, Homo sapiens
cattccaagcactaatctcaccataaagtcagtgtgtagcttctcagttaacgtttcttccacgtgtattccagcttaacttggtggtgtgcttggtaagccctgcagtggaacggcatcatacacatgttaaaagtgacccagatgtacgtgagtggggggaaacagaaaggaaaataaattcaatagtgtggacttttgtccagaattgagtgtgagaacacccacctggcacagtgagttgagtgatttggcgtttaaggagacatatttctggtataatgtggccccacaatggaagccaaccactgaatttgatgttcagtgggaaaaacctcagtatttgccaattctagaagaaaaaaaaatggcagtgttgaacttagtgagaagcagtgtgtctctatatactcttttctatgggcaattcatgggattttcaagggtgattaagactgtttgtaatttgtgcctttggatgccaacctgtcccatgtgtgtgatgaaatgccactgtactcactaggaatgctaacagttaagaggcctgttggaagtaatatgcttttcttggtatattaaataatactactagaaatagttttacattaaaacgaagtgacaagctcttattttaattgctcagtcttatagtgaggtgtgctgtttgtttcttgttctttgtattgcattttttacccctagcaaaggagaatgcattattctgtccctattctgtccttccaaaatccacatttattctatgcagacgtattacctctctgaaccctcattcatacattcagtagtatttcctgatgacagactctacctgtaacaaaattagctttcatatattttaagttacagaatacagtgcatgagtctagttagcacgtgacagacaattctcagttacctgccttgtgtattctccctgccagctgacccagtaagcacgagctcaagaagccaggtatctttttactttttgaactgaaagaaaaagttgttaagttcatagatcagtc

SEQ ID NO: 18957 - DNA, 1028 bp, Homo sapiens
gaggacgctgactcttagaaagaaaaagtaatttgcttaaggtcacacagcagggaactggtgtgcccaggttctggatacagagcctgtgtccttattaacccttattagctttccagtactctcctaaaagaaaaatgggaaaggatggagaggacagttcctccctaatccagcagagttttaaggcacacagactgatcagattccacatgggaggaaggctgggaaggatcatttacaggcagagcttcaattttaagctggaatttgaaaggagcaagaaattttacttggtcggaaagtgggtgaaaatactctgatgggaagagaggtcagagtgataggagaggagaggtttgaggcagtcagacctgggattgagcttgggaacccagtgtcctcatgtaggcctcataacgggttgttgtaaaaattaagcgaggtgaagaacctgaagcctggtaggtggccagaaagtgtcaggccttttgcaggtggtttgcttttgtggtgttctgactctcagctgaaacaggagcttgatagcagtgataataactcttacttttttcttcttcttcttcttctttcttcctttctttttttttttgagacaagttctcgctttgttctccaggctggagtgcagtggtgtgatcatggctcactgcagccgcaacctcctgggctcaggctatcctccaaccccagcctctccggtagctgggaatacagatgcatgccaccacacctggccaatttttgtatttttgtagagatgggatttcactatgttgtccaggctggtcttgaactcctggtctaactgcctcagcctcccaaagtgctgggattacaggtgtgagccactgcgtctggcctacttattttcttctttttgagccttggcgtcagacactattaacatctgaacactcatcttgagactagtccacatatatgatgaccttacgtgtgaatgggaggctcaggtttcaacataataaaaggcacatttgccaggc

SEQ ID NO: 18958 - DNA, 1065 bp, Homo sapiens
acaattggtttgtaatttgggagaaatagagctttttatctcataaattacagattaattagatggtcaagtgatctcattctctctgcatccacctgtgtagatagatgttcattctgaatgttatttgaggtgaaattatttgaaatggtaaaggaataggtcttcggggagtcttgacaatctagagtcttaagtctggattgacttagacttttcctgctcttatttttcattgttttaaaaaaattgtttttttatttcctgctaatattaagactgttatattttagttcatttaggtcatgacatactttgcttttcaaaatagcaaaccttgatcagttaactgcaattaaatgacttgtttaaaataatatagtgggtagaaatataagaaaaatataaaaataatatagtgggtagaaattaaaactaaactcacaaagttatgcctttgttttaaaaagtttttatgtttaaaagatgatattcagataaatgcttctactaaaataatgtcacattggcttatttgtggtctgaagagttgtagctttgtcagtgtcatttacccagcagtcttcttaatatctggtctaacctagatcctggctattgcctacttattgcacacaaatttgggtagaggtttaggaagtcatcatgggctgatgtctgttctctcaacttccacacttgtcagtatttcaagtggtaaaaacttaagaaaatattttctgcctccttctctctctatgcataccttgtgggtaatttcctcagatctatgttctgtttcactgattctctctttagctatgtttgatctgctactcaaataacactgagtttttaatttcattgactatattttccatttctgaagttctagttattcaaatctttttgatactacattattcttttctagtgtttctttcttttaagtcattttaaacatacttatttaataatctctgttaattctgttttctgaaattctctgtgagagtggtaggtgtctgcttgtggtggattatttcctcatgtgttttgtaatta

SEQ ID NO: 18959 - DNA, 1050 bp, Homo sapiens
tcaagggatcctcctgcctcagcctctcgagtagctgcacaccaccacacccagctactattttttttttttttaagatggagtctctctctgtcaaccaggctggagtacagtggcacaatcttggctcactgcaaccaaggtgctgggttcaagcgatactcctgtctcagcctccttaatagttgggattacaagcatgtgccaccacacctggctaatttttgtatttttagtagagatggggtttcaccacattggccaggctggtctcaaactcctgatctcaggtgatttccctgccttagcctcccaaagtgctaggattacaggcgtgagccactgcaaccagccccagctttttatttttagtagagacctggtctcggtatgttgcccaggctggtctcaaactcctggccgcaagtaaatgtctcttcttgacctcccacagtgttgggattacaggtgtgagtcatcacacctggcctgtacgtgtgattggaatcctgtgtagctgagagtgcaggccaccctgcgatacatctttgctcaagagaaggaaaaatattctaatgattaattaaacaaggcagcaaatgctccctcactagagttggttgagcattattatagatgtttatctgacaggagttttgcatcttgagtgcatgtatctcataggtgattttaatactgattcttgatcttgcattcatggtcttgttcacttaatcacaataggtgttggagaagctgaaacaattgaatatttccactttttctcattcttcttgcttttccctggagaaaaaaatggtaataagtaggaatccattatatgccagacatcatatgctgtgcacatgcacacatatttttctcgcttttcctccttatgacagttccacaaggcagacagtgtttgtgatagttttgtagatgaggcaactgagatgcatagaggctaagtcactaactaggtcacataactagttaagataaagctgagctccaaacttgaacatgtcagactctgaaatctatgct

SEQ ID NO: 18960 - DNA, 1455 bp, Homo sapiens
ttgtttttacattgttcgtgacaggtaagggactttcactctttttatacaaagttctgagacttaaatctaccaagctatttagggtctctttgactcctgggtcatcttagaggcttctcccttcacacttttttttttttttgagacagggtctccctttgtcacccaagctggggtgcagtggtgcgatcttgtctcattgcagccttgacttccctgggctcaagcgaccctctcgcctcagccacctatgtggttggaactacaggtgggcaccaccacatccgctaatttttgtattttttgtagagtggggatttgccatgttgcctagggtggtctcgaactcctggcctcaactgatctgcctgccttggcctcccaaagttctgggactacaagcgtgagccaccttgcctggcaccttcacattttaaaattccggccatgcttgcctaccttcagtttccacaggaggtcttgctttcttacctgctagcatctacttggaactcctggaagcctctcccaccacaccttttctccaggcacctcttgctcattcttcagccttctgggaaaggtccctctgcctctgaaaggccttctatgatgctacagcatagattggatgcctctcctgggcgttcttgtaatcctgtgtagcacttgcttttctgtgctgtgactgcctcttgtgtgtgttctccatcagataaataccttgagagtccttgctgtgtctcctttgattcccagggtctgctgtggttcctaccccatggccagggtgcagtagacattgttaattctggtatttgagttcttactagatcgccttggtggtgtgggcccgagtatgggaaaacatgaagtggatagagtagatggtgattcatgctggagctgtaattctgggcctgacctttgactgtctttaaaaatctttattgctagatgccagtggaagctgaagctattacagaactattaagggtgtggcaattatgcacccaaagtcagaacatctgtttttaactgggaaacctgttgcttccttgctgttgatttcctagatgtgtgtgtgtatgtgttttctgcttaagtaatcagaaaggactaaggaagataaacggaggctggagagtgcctagaattgttactgcttggaagtaggtggttggttggccccagaatcaggattctgggtgtttttaggtcaagatgaaggctacaaagcaaagggtttttttgttttcgcccctgcgatctaggtggagaaggaagttatatatgtgaatgtcatgcccatcgtgttttggtttatcaatttgtggaattctaggtggtgtcttgcagtgagatattctcctcagaagggagacctttgagtactttcactgtaaggttccaggggagggacttgtagagaattagtaatgcctggaagga

SEQ ID NO: 18961 - DNA, 1044 bp, Homo sapiens
tttcttagctatgaagtgtaatttccaagataaacttgagaatataaataaactaaacactttcatcctgttctcacctctgcctctaacttcatcagtctgttcctcctcttctgtgtgtctcagcttctcctttaagaatgtggcgaagatacattgtccgagttcagaatgaaatacccttcagtacattgaggccactgcaactggattgctaagttcggcaacattcaagatcttccatatgggtgagagttgtcttcaaggatataaaaaatgccaaaagtttttttgttgttattacctactccgtgagatcctggatgaaacttgataacagattttcacatttagatagaactttgaggagtctgatcggaactacatcaaatccatcttggttttgaagagatccacaaaagaagagtgaagattttatagctttcctcagaagtctgttacagtgtacctttttttttttttttgtcaagaagttgatccaaatagctagggcagaatccctgtattgtcactgaaatcctgttactaatgccttgccctccatggaggtgagaagcaattgatcacccctcatccttttctgtacccgaagacttaaatcccctggctgctgcttctccagcctataagtaatcccaggtcctcctactgtttctcatagccctgcacttgcctctcagttgctctgggtgctcctgccggcctcttccgaactaccatgccctcctcagatagaataggaggcctgctcgtggtgtgtctcactaaagcaaagtaggatttcagatgcgttctagttctatcctctaacttctctggctcttatctagaacatgactggcatgttggcatatttcgtacctcccacccctgcactgcagtataatattataatagtgtttctaaaactttaaggggatagggaagaggtaatagacacctgaagcatttctaagaccagttggactcctttggcctgctgtcgatcagatagccacctcagcttagaccagcgctctcagg

SEQ ID NO: 18962 - DNA, 1338 bp, Homo sapiens
atatatattcttacccttaaaggttttcctgtaagaactagctaggaaaagaaatggtacatatatgagaagtaaaatgatcgtgtaagttagtagatgtttgtaccaaggaagtcatgtaaaaataaatgtgcagtgtcacagctgaggaaggtttgggtgtgaacaagtggcccaggagagcatgtgacagcagaagattgaggcatgcagtaatgacttctatgtctaccatgaaatatgtttattttactgtaggaagtgcagtgtctacatctaacaagataacccggttggaacagagaaaggagccatggactctaggtctgcattcctctaacaagagaagtatcctacgaagcaactacgtcaaggaaaagtcagttcatgctattcaggtccctgcaaggagtgcaggaaaaacatggagagagcagcagcagtggggtttagaagatgaaaagatagcaggtgtgcattggagctatgaggaaacaaagactttcctggcaattctcaaagagtctcgcttttatgaaacacttcaggcctgtccccgaaatagccaagtgtatggtgctgtggctgaatggttgcgagaatgtggcttccttagaaccccagaacagtgtcgaaccaagttcaaaagtctccagaaaagctatcgaaaggtgagaaatggccacatgctagaaccctgcgccttctttgaggacatggatgctttgttgaaccctgcagcccgtgctccgtccactgataaaccaaaggagatgatacctgtccccagactgaagagaattgccatcagtgctaaggaacacatcagcttggtggaggaggaggaagctgcagaagattctgatgatgatgaaataggcatcgaatttatccgcaagtctgaaatccatggtgcccctgtcttgtttcagaatctcagtggtaagaattgtgctttgtttctctggtaggaaaacagatgtgtgatcttgtggaaaaaggagtagaccagaagtggccaaacccggggggtgctgtcacacacacctcaccactttcactgtggtgtggccacatcactgaagtactctcaggtgcttgctgctgcccccattgcagtcagagtaacagctccaagtggccgtggagaagtcgttttcactttagagcacagcatggattttgagtgtttgggtccttgtggaaggaagacaaatggagttacagggttctaaggatcttgtattatctgataattggcataaagcaatcaattgtattgcattataagtcaagcatgcattattacgttatctaaaataaccagtacaaaatttt

SEQ ID NO: 18963 - DNA, 1024 bp, Homo sapiens
tgtcccagccgggactgggagtcagcctcagtgcttcctctccctgaccctcctgcatcccattgtcaccagatcctgtccagcccagctgccaatagccctctagccctgccactgctgcctcaggctgagctccagccccggcccacactctgcctctgtgctccctgcagaagacccctggatgcccccactgctgcagcagggctgtgacccctggtgaggctcctgctcatctgccaccgcctccccccacccactgctcagggtgcagcgcttccttcgtcagctccggagcctctacacagagcgccctgggcctgcgcgccctcccctctggtgtctggctttgtttcctggctagcacccgctcgccctttggcactggtcagcccctcgctccctgcacttcctccatcctcacacttgttaagtccccatcttcatccctctcttgaaccccagcatcagtcaggatgcttcagtcatgacagaaaagccaactcagactggctgaaacaaggacggacttggccacaggggtcttgaggagatgcctggtctagaggctccagcaaggtcaccacacagccatatttctgtgtctactgtgctttcactgggctggctgcatgcttggggcctacgaggtggtttcctagaaatccagctgccttcttcatggtagcaaaatagctgccatgcctctgggcctcgcgcatcatgcctgggatcaggaggaagagggtggctctcacttagtggctcccacatccttgcaagcatcctcatggcccacagctcccacgtggacacctgtgaggtggggatgggattatccagctggcattggaaaattagacccacctcggagagaggggtgggactgtccctctcaggccacgtggctgagggagcaggggcctttccctaagcatatcgaaggtgcgatcacatcttcagtagcctcaggggcagcagggagtgaacttggacactgaattggtggctggcctcccccgct

SEQ ID NO: 18964 - DNA, 1058 bp, Homo sapiens
agtgcagtggtgtgatcacggttcactgcagcctcgacctcccaggctcaagcaatcttcccacctcagcctcctaaatagctgggactacggaggtgtgccactatgcccagctaatttttgtgttttttgtggagatgggattttgccatgttgctcaagctggttttgaactcctgggctcactgtgcccagcctataaggaactcttataatatagaggtagattttattcattattaatttgataaggttttaaatctggtctaacagtccttgtctttaagctggaacatttagtctatttttattcattgttattactaatctagttggattatttctcctgacttactttgtttttttgtgtttgtttttcctatcctggttttcctttccattattttttctcattacattattcccctttactatttggaaattatatacactatttgtttttttaaaagttgttactctagaaattgtaaaatgcaagtgtaaaatttattcatgtccagcttctactcctgaccatcacaaggctattagaacactaatcccagtgattgctcacctcccatttatgttattatttttgtgtatttagttttttaaaaacctcattctttttactgtggtattaaaaacttttttttaaagatagaagcatttcttctgatttttactgttttatacagttaacttggatttaaccacatatttaccaactttttttgctctttattctaccctgcattttagaccttccaacttgtatccctttctttcttcctgaactatatgctttggaatttcctttagggagcacctgctggtcacttgctctttcagttttttgttgtttggaaatgtttttgtcttatcctcagtcttcagctcgttatagaattctctgttgagacacccgctcccagcatagaagatatgtttccactgtgaccggcttccattgttgccattgtgatggcagccggcagtctacttgttgctctttagaagtcatctgactttttctttgattgtgtttaatctct

SEQ ID NO: 18965 - DNA, 1033 bp, Homo sapiens
ggaagcagtgagttggtgctggagcatgcctttcctgggtgtggcctgtgcattggtcaggggaggggggcctctgtcgggctgcctctgatcttcctctgtgtccccacagccgctcctctggaagagctaacaatgggaacctcctgcctccctgatacgttcaccaagctgataaacccccaggaaaacacctgcagcttggaggagtttgtcctccagctggagctgtctgggtatagtcccgaagacctgactgctgccttggagatcttggaagccattatagccacgggttgttttgggattgacaaggaggagctgcgcagacggttctcggccttggagaaggcaggtggtgggcgcaccaggacattcgcagattgcatccaggtgagctgtgctttaggttagccggatatcaccgaagcggaaattgcagctcccaggccaggtgcacactgaggatgggcttgatttggggcatagcatgctgcgttctttttaaacgttgaattagtcattaacacttgaaaactggggcatttcacatccgctttgagggtacagttgtggatccccaaaggtcacacggctgacgtggttcacgagcagccagagagaaagagatgctgctccagggcacagggctagcaaggggcagccccggggctaggagccaggcctgcctcgtgggcctgggctgctcagggcactcaacccgccagtcaggggaggccactccactcgtcccccgtcaccagcgtggaggatcccgagctccccacagaccccgcgtgtctcctgcctccccaggccctcctggagcagcatcaggtgctggaggtcggtggcaacactgcgcgcctggtagccatgggctctgcctggccttggctcctgcactccgtgcggctgaaagacagagaagacgccgacatccagagagaagacccccaggccagacccctggaggggtcttccagtgaggacagcccccccgaggggcaggcacctccttctcacagccccc

SEQ ID NO: 18966 - DNA, 1027 bp, Homo sapiens
ctccgggccatagcacatgtgctggttcaggaaggagggcaaacttgactcaccggggcccggctgtctgtcaggcagcgtcaggtccaggacacactagacccagggattccaagtggaagaggttgtgtgtgtgacttccctttcctagggctgcagccccacggtgtggcctttactctcaaggtttccctgttagaaggcacaggtgaaagaggaacagcagcatgagtgcatgcaactagacagcatttgcactcgaatggaccaggggcagcgcgggtgttcctcgggtgggccttctgactgcctgtcctgcaccctcttgctgtgcctacctcctctcacagccatcatctctcactggggaaaatcaagcaacagcgcatttgtatcaacaaagaaataagcccctttaaaagaactgagatggctgggtatggtggctaacgcctgtaatcccaacactttgggaggccaagtggagcatatcatgaggtcaggagatcgagaccattctggccagtgtggtgaaaccctgcctctactaaaaatacaaaaattagctgggtgtggtgcctacagtcccagccacttgggaggctgaggcaggagaattgcttgaaccagggaggtggaggttgcagtgagctgagatcatgccactgtactccagcctgggcaacagagcgagactctgtttcaaaacaacaacaacaataaacaacaaaaactgagattatggaatatttggcacagttctcatcaagccagaaatccttatccagtagcttcttaggccctctgttaggtcgttcttattataaaggcatacctgaggctgggtcatttgtaaagaaaagaggcttaattggctgacagttctacaggctgtataggaagcatggtgccagcatttgcttgggttctactgaggcctcaggaagcttccagccatgacagaaggtgaaggggggcaggcacatcacctggcaaaagcaggagcaagagagagagttgggggagg

SEQ ID NO: 18967 - DNA, 1084 bp, Homo sapiens
aactgcagagcagtacaaaaaacttaagaaacaacagtgtctatcctttccacattgacagctctcatcagtttttatgtctgctataagtatttttaaaataaaacaataatgtcccctggccccctgctccccactcccccaccagcctgccacttgttccctgagcagtggcagtgtgttcctgtgctgacctccctcagagaaggccaagaaaaactgcagcccagtagtagcagtgccttctatttctgttgatcttcaaagagtgcagtcactgaagacaggaaccccccaccctccagtctagggttagggagagacaggaaggtataggcatctgctgtgtctccaggcattgctggagggagtgggcgagggatgggggcagcgggtaagcatggggggccacataacctcaaaaatgaaagtgcccaggcctcttgccacaaggtcccactacagtagctggtttttccggctggaaggggcttccgtcgtgtgcatgtgactctagtaccagcgtaggtttccaggcaggactttctctggcacccagagcatgtgctgctggcagcctttgatctgctggggccatgtgagctggagctggtgcgtctgtgtcagtcttttgcctttgctcctgtgtcttgcccggaaagtggggcaatgtgaatgctgtatatttctcccttgcctttgaattctctgaaatgttgccttactgcgtctcatttgagcttcacaaaaccacaaagctggtggttgggggtgggggcagggtggtccttatttcacaaatgaggattcggagaaaatgagccaagtgtggcattcgggagcccttgtctaggcgttgcttcctgccccctgtttccagatctttctgagcccatgttcagcatgaagctgctggccagagtggatgctcagacagcctgaccttgctgtccccggcctcagcagagacaggcaagaagcctggctccctgggggcctggccgtcctcacctgccacaacatggctggtgtgctcacacacaccctgccccactccacctctccctgctgggcattcaagtta

SEQ ID NO: 18968 - DNA, 1022 bp, Homo sapiens
gttggaggctgtgatggaatggatgtcagttgctccactagtagagaggtgaggacggtgaaccaacttggtggggagaagaagggttttttttgttttttttttttgttgtgttttgttttgtttgaaacagagtctcactcttgcccaggctggagtgcagtggtgtgatcatagctcactgcaacctcaaactcctgggctcaagcaatcctcctgcttcagccttccgagtagctgggactacagatgcacacctccaacgcctatagctaattttttgtatttgttatggaaatgaagtcttgctctgttgcccaggctggtctcaaactcctgacctcaaatgatctgcccacctcggcctcccaaagtgctgggattacaggcatgagccactgctcccagccaagatcagaagctttgaagactatgaggctttttctcttttttgcccactgagtcatgagtttactagtaccgtttcttgccttccacccgtgtttattttgagagctgtcctgtgtatcttttcctagccaattagcctcttaaggaagcttaaaaggagaagaaatagcgctgggccactggctgagggcgcctcaggtctgactcccccaagtgctgtgtcgtgctgctgctcaggcagaagccagcgtccctggcgccgcgccgctcttctattctcagtcacagggacgttttgaatcaggggcgtctaaaccaaaggtttagagcctgggctccagagccagactgcctggtaaatgccaccttctcactagcaaaggggcatttgtttgtgtgaattccttggctccttagtgttctcatgtgggactggaatgatcacccttacctcctcaggccatggtgagggtcagttcatagggtacacggggagcctaggacagcatccaggatatagtaatggataaatggtcgtagtgttattaggagccataggttgctcatgtgagcagcatggtaggatgggggttgggaggggcttgtctaga

SEQ ID NO: 18969 - DNA, 1052 bp, Homo sapiens
gatagagaaagtagcctatgcaatttctgccttatatttttttttcgtaaatgttttatttgaaaaagcaggtacattccctgtgtgcagtttaaagcagttttatagatagtattatttaagggctttatattgttatatatatatttttgaggcagagtcttgctctgtcgtccaggctggagtgcagtgacaacatcatggctcactgcagcttcaacttcctgggttcaagtgatccttccatctcagcctcctgagtagtgggactaaaggtgcatgccaccatgcctggctaattaaaattttttttttttttttttgtaaagatgaggtgttactatgttgcccaggctggtctcaaactattggcctcaagcaatcttcctgcctcagcctcccaaagtgctaggattacaagcgtgaaccactgcacccagcctctaaattgtcatttatttatctttactccctttatctgccaaaagctggatgaggtaggttaatctctttctcttcaataggattcttcccatttttacttgaatttctgatagtttttgttttcataaaaaagtttgagtctatgttgttcatcacaagaagattcttgacagttatattttcattgcggaattgtggattttatcttttgtcaagataaaatggctattttcccccagtgaatgctttttactttgcatcctatttttttcatattttaatattgctatccctgctttctttcgtttgtattcccttgatatatctcttactagactttttattttaacttctccatgtctttttgttaggtgaatatctggtaagaacatagagttagctttatttacttattttttggtacaatccgagagtcttaaacaaatactatttatttctataacaaatacacttggcctcacttctttcacttctttctttttgttgaatgttcccaatttttagtttttttttaatcttttactatatagattaggttttgcttctttttttctttactaatgttttaaaaagcatgcatactgata

SEQ ID NO: 18970 - DNA, 1052 bp, Homo sapiens
gacttaggagcgcagaggaaaggccaatggggagtaagctgggctgggatggagtttttttttttttttttgagacagagtctcgctctgtcgccaggctggagcgcggtggcgctgcaacctccacctcccgggttcaagtgattttcccacctcagcctcccgagtagttacaggcatgcgccatcacgcccagctaatttttgtatttttagtagagatgggatttcaccatgttggccaggatggtctgaatctctaccttccaccgtagatgtctcccagacggacctcgtgatccacctgcctcggcctcccaaagtgctgggattacagatgtgagccaccgcacctggccttttttttttttttttttaagagacaaggtctcactctgtcacccaggctggagtgcagtgatgcagtcatggctcactgcagtcttgacttacagcttttagtgatcctcccacctcagcctctcgagtagctgggactacagatgtgcatcaccatgcctggctagttctgtttattttttgtagagatgggatctcactgtgttgcccaggctggtctcaaactcctgggctcaagcgatccaaagtgctgagactacaggcttttgagacgccatggctggtcaaatggaggatgttctttccaggactgatagcatggcccaggggtgtgggttgtagtgagccctaattcttagaggtgtgcgagctggtctttgacctgacctaattcttaaagtttttatttatttgtttatttttttgggacagagtcttggcctgtggcccaggctggagtgcagtcgtgccatcttggctcactgcaacctccgcctcctgggttcaagtgattctcctgcctcagcctcccaagtagctgggattacacaggtgcatgctcccacacccagctaatttttgtatttttagtagagatggggtttcaccatgttggccaggctggtcttgaactcctgacctcaagtgagccacctgccttggcctccccaagtgctgggattacagacgtga

SEQ ID NO: 18971 - DNA, 1051 bp, Homo sapiens
tgcagtggaagcttaaactccaaaatctgacatcaaagctctgtttataaagctgtcacacctggtagttgtctacgctttagtctgcagctaggaatgttaaatttgtactagttctgaagtcaacacatgatcacttaagttctttgattttgcttttataatttacctttctcttaggtgagcatgtgtcacagaaagattgaataagattcagtagacattgactaactgccttctgtgctctagtcagcggtggcaatgtttagatgatgaatatcttagtttttaggttctacgtgaaccggtaaatgatttctatgctgttgcccatgtcttagaacagcaaatgcagtggatgcaattcttacctcctatgaaaatgagttgaacgctaatatattttcaccttaacctttaaaatcacatcttcttttctttctgcaggcatgctcagtccctggctgcgctgcaggcttactctcactggttagcacagtattgcagtgaagttcaccggcagaacacgcagcagttcgtgacactcatctctactaccatggatgcaatcacacctctaatcagcaccaaggtctcgaaacagcaaagcctacaccttttatctaactctctgtctctccttctgttcctatacccatttactagaaaatctaaatatgacacagagttagacccataaatctttctgctgttatacatctgttttatttcatgttcctttttagttgtagcctacatgcattcagatacaactttacttttttagttatctgagttccacatgaatacatgctcactgtgaaaaagtaaaatatcattcagatttccagactaaaaagttgtgatacctctgaaacattttccttcgcgcggtaagcacagttgggcagtggttgtgcaggcacacctcattttattgcacttccctttattgcgcttcacagagactgtgttttttacaagttgaaggcttatggcaaccctgcatcaagcaaatctgtcagcaccatttttttgacagtatttggtg

SEQ ID NO: 18972 - DNA, 1279 bp, Homo sapiens
taatattctcagttttccttagattgtcctttgttattaagctatatagaattaagctattttcttttccttagagtaaatagcagaatataaaatcaagtgcataaagttgaaagttgtagtgctttttaaattgggcagttttgtaaaatatttctaaaattaaaaaattggtacataagattattttggtttggtttattgtaaaaccgtgatgtttgctctgtataagaacacaatctgatatggtaatatgttcttaaaaattatttggtgatagctttccatatgaattcaaaggcatcattattcacactttcatattctttctgtctgtggttaagaaaggctgtattaccttttttttaatgatctgtgtgtctcatgtctatctcttcatatgttaatttaaaaatctagctgcttgtatcaactatcaaatatcagttgttttgactttaatcataatgtagtcacagacaactttgttgtggcttccatttggatggtatagaaatgtcattatggattgtctatgtactgatgttgttacgtgtaacttttgtgctcttggttttacattttaatcctgtgcttcctattgccctgtgaaagctgagaggtgcctgggagcagaaaggtgacataaataatgctgtgtgcttgcttcctggctctgggtcccctaccactaattctaaacagctcagtccattctcagttgtttaggagctgctaaccagatccttggcttctctttccctctactgccttttcccctaactttctactgttcattagcacctgtaccagaaggtgggcaagggaaagaaaatgaggtgaaataaaatctgtagttttagctactgaacagccttgtttgtatttttaaaaaattgggttagatactaaagtaaaattgagattgttctgtatttagcccatggcttttttttttttttttttttttttaaatgggtagtagggaattgagtgcaccttcctaaagaacagtcagctgggtggtgactttgaatatccatgtaaaactatcatgcggtacataagtgagtgaggaaggagttcctactcttgagtattagtgattgatgacaccagagagaagtgtctttgtatgttcctgtctctaaaaacagttgattttagtgccttactgtttttcgagtacttggccccatgatccacagagacagccattctctttatcaaaacaaattaatatgtattttttaaaaagctgcaaataagctcggccgca

SEQ ID NO: 18973 - DNA, 1002 bp, Homo sapiens
caacactctgtctctaaaaaaaaaaaaaaattaggctgaatgcagaggctcccacctgtgatcccagcattttgggaggccaaggtgggaggatcacttgaagtcaggtgttcaaccccaacctcggcaacagagcaagacccaggctctacaaaaatgaaaataaaagccagatgtggtggcatgtgcctgtagtctcagctatttgaagctgaggcaggaggattgcttgagccaaggagtttgaggcctcagtgaactaggatcatgccactgaactctagcctggcaacagagaccatgtctttagcaaaaaaaaaaaaaaaaagaataactggggcagaaaaatctatatttaagagaatttatctggcggtaaagtactgtttggattggaattggaaaacctggaaaccaggtaaaagcaattatagtaacgtaggcaggagatgattagggctccgtagaaatagtggtgagggagaaggtacaaacctgcaaaagagtgagaagcaacagtccgcagacctgatggtgtttgctgtggatggagaatatggggaagaagcaaaggcgatctcaaattatgtcacccttctgcttcttccaagttttaatttttttaggtgattatgggtcttggtggacttagtagtcccttaataaatgagtcaatggcatagatctctgaactgctgacccatgagcagcaaagtaaaaggagcagataaagtcagggcaggcacagttgcaagcttatcacctttgcagttttaactgtttctggaacagaaaacttgggtttgttttagatctatgcagagctctccaagagtatattctgagccaagcttaattcgtcatcctgcccaaggattttaagtgtatgtgccatttgctattgaggtgagccaagtaactcttggggaagcataggcttatggggttgtaataccttgtgctgccatcctggcagctctgaagacaagagatggttcctag

SEQ ID NO: 18974 - DNA, 1199 bp, Homo sapiens
tacagtgtggatgtaccttatttaaccaatcctgccttgatggaaatttaagttgtccccattcttttgttttacaaacggcattgacatgaagatcctttacacctaagctttggaggaaaaatcaccaaaagtgtattgctgggtgaggttgtctttgtgtttgaaatttgataaatattgctgacttgtcttggcccccactgaggtggcaccagttgtcttgccatccctgtatgagagtgaaagatgtaatttcagttcattatggtcggtgtcatgttgaagcccacaaggagtgaggagctctgagggtggggaagggggaactgcattaggcttcacagagttggggaccttttcgaggagtcaggagcattctagatagaggaaatggtgtgtgtgaagacatggaactgttatgtggagagaaaagggtgagtttgggtttggctgaggcagagggtgggtgggtggctgtggatggtgaggtggggacagtaagtcagctaggttagggccaggtgatgaaatggtttaatcacccctggtggtcaggtagcaaagaccctgggcggcagtggtgatggggcttgcaggtgaaagatacttgagagagaatgtacgaccagtctttttagcaatctttttttacccccgaaaaactttctagacttgttagaaccagaatcacaaagctgggaagggctttagtgcagggcttttctggtgctctgtaggcccatagggattcttggaggtgtcacagacactaggtttgggagtacagacaggcatttgagaccccctcctctacccttattaattaagcagtttctcatttagtctgctttatatggtggggttctatgcaatatttctttctttaaaaagaaaaaaagtgtttgctgctagaatcatgagtctagtcccaaactcttactgtcctgaacacagatggaggcctgtgggacacgttttcattcttacattcttcgtttgcagcagtgagaggtgatttgtatataaaaatgaaagtgaaaaggcatttggcattcttgggatgtttttgagcatttagctaattttttatgtaggatttttattttgttcctttttttttaagctcattgactcaccagtgaaatatctagtgaaatagttttgctcatttatggatgagggtgctaagggattta

SEQ ID NO: 18975 - DNA, 1031 bp, Homo sapiens
agcccttggtaagtactggatcacctagcctgtggttgagcacctcgaggagtggagctgttctcctcagtttcacccattttacccctgccaagttagtggtataatagagaaagggacatagctgcatcttttgtgatacagaccttaaggcctgtggaattttcgaaacattcaaggggcctgtgggtagtgtgtaggtcctgagatatggagcttacaaccagctgggtaaagtacaccattaatgctgagcagcaccgtacagtatatgctatacgtatagtgtatgtgttttatttttatttgttttgagacagggtcttgctttgtttcctaggctggagtgcagtggcacgttcatggctcactgcagcctcgacctcctgggctcaagcagtcctcccaccttagcctcccaagtagctggggctgcaggcaagtgccaccatgcctggctaattttttgtggagatgaggtctcaccacgttccccaggctggtcttgaacctgagctcaagtgatccgtcctcctcagcctcccaaagtgctgggattacaggcgtgagccaccgtgcacagctgagtctatgtattttaacatatatattacacagtatgaattgtggcaaatcagttaagctctcagttccaatttcctcaactatgaaatttggggataggatttctctaaagagtaatctagaggtatgaggtataacatttagtggctaatgaaagtagcactcattccttccttcatttattctttcagtaatgctttttttttttttttttttgagatggagttcagctgttgttgcccaggctggagtgcagtggtgcagtctcagctcacggcaacttctgcctcccgggttcaagtgattctcctgcctcagcctcccgagtagctgggattataggcatgcgccaccatgcccggctaaattttgtatttttagtagagatggggtttcaccatgttggtcaggctggtcttgaattcctgacctcaggtgatccaccc

SEQ ID NO: 18976 - DNA, 1051 bp, Homo sapiens
tcaataaatcatttgcacatctggcccaccttgcctgcttctcagaggatggaaccaacacaacacatctgaagagaggcacagaagtggtgactttgggaggccaaggtgggcagatcacctgagtttgggagttcaagaccagcctgggccaacatggcgaaaccccatctctactaaaaatacaaaaattagctgggcatggtggcacgcacctgtagtctcagctactcgggaagctgaggcccaagaatcacttgaactggagaggcagaggttgccatgagccaagattgtgccattgcgctccagtctgagcaacggagtgaaactctgtctttcaaaacaaagcaaacaaaaccaaaaacaaacaaacaaaaacaaaaaaagaagtagcagcctgcaatggtgcagtcctttgtccctgacgcctagggataagccactcttgccagctcaaaggtgccacctctccagagagggtcttgatgggtataatttggatagcggaacacaaagaaaaaacttagccatgattttattttccttctttcttcttttttttttttttttgagatggagtcttgctctgtcacccaggctggagagcaatggcacaatctcggctcactgcagcctccgcctcccaggttcgagcagttctcttgcctcagcctcccaagtggctgggattacaggcacgtgccaccatgcccagctaatttttttttttttgtatttttagtagagatggggtttcaccatattggtcaggctggtctcaaactcctgactttgggtgatctgcccacctcggcctcccaaagtgctgggatgacaggcgtgagctacctagtccagtctcttttctttttttaatttaatttttatttatttatttagttttatttatttatttatttcttgagatgtagtcttgctcttctcccccaggctggaatgcaatgatgcgatctcggctcactgcaacctccacctctcggcttcaagcaattctcctgcctcagcctcccgggtagctggtactaca

SEQ ID NO: 18977 - DNA, 1051 bp, Homo sapiens
aggtcaccttcctctccctcactgccttctaccccaggtaagcaggtggagcagggagtgtggggagaggctgtcccatggtcagcctaggtcctcctgaatgttcctgtgttctccttcccagggccgtgatctcctggtggtcctcagggactgggggagctgggctgctgggggccctgtcctacctgggcctcacccaggccggcctctcccctcagcagaccctgctgtccatgctgggtatccctgccctgctgctggccaggtgagctgccctgagccgggagggagaggggtccaaggagagaaaacttggccatggctgggtgtggtggctcacgcctgtaatcccagcactttgggaggccaaggagggcagatcgcctaaggtcaggaaaccagcctggccaacatggtgaaaccccgtctctactaaaaatacaacaattagccaggtgtggtggcgggtgcctgtagtcccaactactcaggaggctaaggcaggagaatcgcttgaaccccggaggcagtggtggcagtgagccgagatcgtgccattgcactccagcccgggcgacagagttagactctgtctcaggaagaaaaaaaaaaaaagaaagaaaagaaaacttgattatgattgcaatcttcaagtccctaccttgctgtgaagggaggcggaatctggactctgatagccccaggtgtgagtcctggagctgccactttttagctttgtagcgttgaacaagttactccacctctctgaaccctcagtttccccatatctcaaatggcagttgttcttgctttccttggaggtgatgagggtaatgcattcagcacagtgtggttcccaaggtgattagaagtaggatgagggtggactttatttgattagttccttttttttttttttttttttttaatcagtgttgaccaggttggcctcgaatgtgtagccttgcctgcctgagtgccagggcaacaggcctgaaccatggcgactcccttttttttttttttttttttttttttttgagacgga

SEQ ID NO: 18978 - DNA, 1032 bp, Homo sapiens
gttaaggtgagggttgctgggacactggagacagggccagaagctgcctcttgtcaggataaatgttaggcttgtggggaggagattaagatattcagtgtttgggtatgagatggcaggtttgtggtcttggccacgcagaatgggtggtgaggagatggtagagaaaggtgggcctgagtttctaactgctacacttggctatatggatgtgaactgaagagctcgttgaacttggctgtttcctttccttctcctctccagaatatgatcacaggcactgcacccctcgacggctgcatcctggtggtagcagccaatgacggccccatgccccagacccgagagcacttattactggccagacaggtactcagagcctgggtaaggatgcaaaagggaagagtggggagttgggcccctctgtatattgtccctgtctctctggcatctacagattggggtggagcatgtggtggtgtatgtgaacaaggctgacgctgtccaggactctgagatggtggaactggtggaactggagatccgggagctgctcaccgagtttggctataaaggggaggagaccccagtcatcgtaggctctgctctctgtgcccttgaggtgaacgcggggtcaggcagggcagctgctgcagagggtggggctggatgggcacccagagctctgctttgtgtctgggaagtggctcttgataatcgagggaagtagaatggggatttcagagtcctggcacttcccctcaacagggtcgggaccctgagttaggcctgaagtctgtgcagaagctactggatgctgtggacacttacatcccagtgcccgcccgggacctggagaagcctttcctgctgcctgtggaggcggtgtactccgtccctggtgaggactctgtctgttcccacgcactctctctagcagaagcctagctcggggtccctgatatcctgtcttattccctcccaggccgtggcaccgtggtgacaggtacactagagcgtggcattttaaag

SEQ ID NO: 18979 - DNA, 1031 bp, Homo sapiens
ccacatgagtccgacctcgggggcctgttgtgcattgtgcgtcttaggagacgtgggaagcacctgcagggttaagcaacggagaagcctcccggctccaggctttcaaaagctcacttggggccaggtgcagtggctcacgcgtgtaatctcagcactttgggacactgaagcgggcagaatgctggagcccaggagtttgagaccagcctgggcaacatgatgaaaccctgtcctacaaaaaaacacaaaaaagtagctgggcacagtggcacatgcctatgatccaggctacttcgagaggttgagatgagaggattgcttgagcccaggaggtcgatgctgcagtgagctgagatcgtgcgccactgcactccagcctgggtcacagagtgagaccccatctcaaaaaaaaaaaaaaaaaaaagaaagaaagaaagcttacttggggctgtgttggggtaggggacacaggagaagctgagaggctgggactgtggtgtacaggaaggtggtaccttggaccaggggatggccgcagagacaggaagaaatgggtggatgtggaatccactttttttttttttgagatggagtctcgctgtgtcacccaggctggagtgcagtggtgtggttctcggctcactgctagctccacctaccgggttcatgccatactcctgcctcagccttccgagtagctgggactacaggcgcctgccaccacacctggctaattttttgtgtttatagtagagacggggtttcaccatgttagccaggatggtctcgatctcctgacctcgtgatccgcccacctcggcctcccaaagtgctgggattacaggtgcgagccaccatgcccggctggaatccactttttttaagatggagtcctgtcctgtcacccaggctggagtgcagtggcctgatcttggctcactgcaacctctgtctttcaggttcaagcgattctcctgcctcagcctccccagtagctgggattacaggggcccgccaccacgtccaac

SEQ ID NO: 18980 - DNA, 1056 bp, Homo sapiens
tttttttttgagaccatctcactctgttgcccaggctggagtgcctcttcatttttatttctttattcagcaagtattgatcaaatgtgctttgtaccaggtactgagctctacgttgggatataatggtgatcaaggagattgtagattctggcagggaaaactgacatcaaacacggcgacccgacatagtgagaccctgtctctactagaagaattttaaaaatcacctaggtgtgggccgggcacggtggctaacgcctgtaatcccagcactttgagatgctgaggcgggtggatcacgaggtcaggagatcaagaccatcctggataacacggagaaaccccgtctctactaaaaatacaaaaaaattagctgggcatgggggcgggcatctgtagtcccaactactcgggaggctgcagcaggagaatggcatgaacccgggaggcggatcttgcattgagccaagatcacgccactgcactccagcctgggtgacagagtgagactccatctcaaaaaaaaaaaagaaaccaaggatatagaataaaacaagagtgtagatttgggcattgaggccttcaaattggattgttcccaatgtccagaagaaaaaaaaaatttagaagagacccaaatcagaaaacaaaagttgggctgaattcaacgcgaattattttctagctcaatattactgcttatgtcagctgaatttcagcctttcaataacagctagtcaagtatttttttagttggttcctattgatcatcatcttattttagtggaatccattatattgaagatgtcaagttcctcatttcccatacaaagaatgtgagattcatctttcttgaatcttagctgctaagtgtttaaggggacttttggcatcttttcaggaggactataattgggccctctaactaaaaagtctcctatgccccttacataaatgagattttttttttttgaccttgtacccaccaacattggtgggaggctcagaagggactgtgtttgtaactttgtagcactttctaaacagtgacct

SEQ ID NO: 18981 - DNA, 1056 bp, Homo sapiens; identical to SEQ ID NO: 18980

SEQ ID NO: 18982 - DNA, 1084 bp, Homo sapiens
ggaatgtcatcagttaaggctatttttacttcttgtgtggatcttcagttacttcaggccatctggatgtatacgtgcaagtcacaggggatgcaatggcttggcttgggctcagaggcctgacagtgtgatcttggctcactgcaaactctgcctcctgggttcaagcaatttttgtgcctcagcttcccgagtagctgggattacaggtgcccgccaccatgcccagctaatttttgtatttttagtagagacatagagtttcaccagattggccaggctggtctcgaactcctgtctcacgtgtctgtgtgaagagaccaccaaacatgctttgtgtgagcaacatggctgtttatttcacctgggtgcaggcgggctgagtccaaaaaaggagtcagcaaagggtggtgtgattatcactggttcttataggtttggggataggcggtggagttaagagcagtgttttgggggcaggaggtggatctcataaagtacattgtcaagggtgaggagaattacaaagaaacttcttaagggtgggggagatgataaagaaccttcttaagagtggggcagattacaaagtacattgatcagttagggtggggcagaaacaaatgacaatggtggaatgtcttcagttaaggctgttttcacttctgtggatcttcagttgcttcaggccatctggatgtatacgtgcaggtcactgggatatgatggcttagcttggactcagaggcctgacattcctgtcttcttatgttaataagaaaaataaaacaaaatagtggtaaagtgttggggtggcgaaaatttgtgggggtgatatggagagataatgggcgatgtttctcagggctgcttcgagcgggattaggggcggcctgggaacctacagtgggagagattcaactgaagaaagattttggggtaagggctgatactgtggggttgttagaaggagcatttgtcatatagaattattggtgatggcctgaatacggttttgtatgaattgagaaactaaacagaagacacacagtccgaataagagaaggagaaaaacaggtattaa

SEQ ID NO: 18983 - DNA, 1033 bp, Homo sapiens
cattttggaaatttcctattgacagttttcatttatagtactctttatttgtgataaaacttaatagatttgaaatagcttactgatctgtgtcagttttctgattggttttttaaaaattaaaatattaagtgctacggacagtgaattgatcaatcttaaatttatttgtatcatcagcactaatacagatagtgatttattttccatataattttagaagatttattttccatttatcacttccttgaattttttgtttttcaggttgttgctgtagcccatgctgtttatcaagcaatgctcagcttgaagaatattcctgttttggagactgcctataagttaatattgggagaaatgacttgtgccctaaacaacctcctgcacagtctgcaacttcctgaggcctgttctgaaataaaacatgaggcttttaagaatcatgtgttcaatgtagacaatgcaaaatttgtagttaaatttgacctcagtgccctgactacaactggaaatgccaaaaactcgagtctttaattgtaatgactttgttttatccacagttaagccttttctcattacatatttatgtatttcactgtcatgtcaacatgtctgcagaatcactgtatgtaacaaacagccatatttaagacatgcctggataaataaaattggtaggaatgttttcttgccattatatttaacgtttcttctttttccttgacaaatcttgataagtttttttatattagttttattttctagaaaacgtcttatgaatttctcccatttgctctagcatgcttatagaaaatgtcagtgtttcttacagctcaaatttgtatagttgttttaaaatgcggtctctttcttcccctggtacttttttctttctgtctactgaagttagttcttatacatggtcttatattttggctgtctttttttccctaggaacattcatacaggttgaatattccttatctgaaatacttgggactggaagtgtttttgattttggagtttggaa

SEQ ID NO: 18984 - DNA, 1067 bp, Homo sapiens
gggtacaacgtaatgtttatatatatgtgtgtaatgtagtatgattaaatcatactaattaacatactatcgccttactttgcttacttatattttgtggtgaggcatttgaaatttactcttaattgtttgaaatacattattattattgctattgttatctctgtcttctctttgcaaataaataatcattatttactatggccaccctgttgtgcaaagatttcaaaaactattctcctatgtgaaatttgttcccttttctttttcaaaaaaaaaaaaaaaaaaacacccgctgtcttagcattggtgaagttaaaaatagaaccagtgtgttttagattcctctctaagtgtctttatttttaagaatatatatattttttttttttgagacggcatcttgctctgttgcccagcctggagtgcagttggcaccatcttggctcactgcaatctccacctcccgggttcaggcgattctcctgcctcagcctcccatgtagctgggattacaggtgcatgccactatgcctggctaatttttgtatttttagtagagacgggtttcaccgtgttggccaggctggtctcaaactcctgacctcaggtgatacctccgcctcagcctcccaaagttctgggattacagatgtgagccaccgtgcccagctagaatgtgtgtattttaaaaagttgatccttcacagatatttatcttaagagaggctggtgtcatgaaaaaagctatggactaagaatgggaagacaaagatcttttgtattggcactaccagctgtgtccctctgagggggtaatttttgccttttgaagatgttgggagggttaaagttcaggaaattatttttaaaactgtttcagtgaatatttagaaaaatattagtggagatagaattaattgctctgcagtggagtggctctctttctacattttcttttttttcttttctttttttttttttttgagacggagtctcgctctgtcccccaggctggagtgcaatggtgcgatctcagctcactgcaacctccgccacctggatta

SEQ ID NO: 18985 - DNA, 1359 bp, Homo sapiens
ccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatgagttggtttctcagagtgtggtccttagaccacctgtggtatatttctatttctcttttttgcttttctttctttttttttttttttttttttagagacagagtcctactctgtcgtccaagctggagtgcagtggtgcaatcatagctcactgcagccccaaactcctgacctcaagtgatcctcccaccttagcctctcaaagtgctgggattacaggcatgagccacaaagcctggctggatatttctttaaaatgcaaattcaagccaggtgtggtggctcatgcctgtaatcccagcattttggaaggccaaggttgggtggatttagtacaggagttcgaggccagcctgaccaacatggtgaaaccccatctctacaaaaaataacaaaaatagccaaatgtggtggcacatgcctgtgg

SEQ ID NO: 18986 - DNA, 1796 bp, Homo sapiens
ggctttgcagcctatcttaatatctggcagggtcggcctttcctctttgctcttatttttaaaaactgacctaagtttgggaggatggcttgagcccaggaggtcaaggctgctgtaagctgtggtcatgccactgcactcagcctggatgacagcaagaccctgtctcaaaaaaaaaaaaaaaaaaaaaatggcctcagtaattgtagacttttattattctctgttaattttagagagtcttatgagtttctgcaaaaaacaaatctggaatttgtattagaattgcgcattgagttttcaaggttgggagaagtgagagggattttggcatgaagattctagaagacagaagagaaagaagcccatgggtttgcttcagatttctttctccaacgtcatcccacccaatgaagttcattcactcaacaaatatgttcattcattcaacaaatacagagcatcagctgtatactaggtagttattcctaggtgggaagagacagatcataaacaaatacaaaaagttagaaaaagtcagacactaactgctgtgtagaaaatgaactgataggcctggtgcagtggctcacgcctgtaatcccagcactttgggaggctgaggcgggctgatcacctgagttcgggagttcatgaccagcctgaccaacatggagaaacctcgtctctactaaaaatacaaaattagctgggtgtggtggcacatgcctgtaatcccagctactcaggaggctgaggcaggagaattgctttaacccgggaggtggaggttgcagtgagccgagatggcgccattgcactccagcctgggcaacaagcgaaactctgtctcaaaaaaagaaaaagaaaactgataacacaaaaggcaggatgtagaggaggctgttttagccaggggggctggggagggctggccctgaggaggcactgtgtgacctgcgatctgaatggcatgacggacacgccacgctgacagctgagcaaagaagcatcccgggcaggggcacagccagtggccggggcaggcacaagctggatgtgtgaagcagcaaggtgtccgtgggaccaaggcccagcaagcaaagggagagtggcagagaggctggcggagcttggagcctgcagagccctgcggaccactgaggagtctggagttgttcccaaccagcttttgaaggcttttaagtgggggagtacgtggcctttggttgtgctgttaaccaccttccgcttcttccccagcaaaaaagggagacgctgtccccgctgtgcctcatccccatggtgacatctccccgggaggagcagcagctcctggccagcacctccaaggtgaggcccccaagccctgcagggtggaggctcactgggggggcctctccctgcagcctcacccctctcgtccatcctctctcccccgccagcccgtggtgaagctcctgcacaaccgcagtaacaacaagtactcctacaccaggtgaccgccggggtgcggggcactgggcgggaccctgggatgcagcacagccctgcttctgcccaaggcgagggccacggccacacggggggcctacaagaacatctgtgcctgctcgcagattcggcttcgcctcttacccctgacgctctaggcaggtcctttctgcttctcagcttcagctcagtcatcagtaaatgggtttgggtgaggacaaagtgatagtggcgagcctatcccaagtgctctcattctaggaactggcagagtcctcccccttgaggtcagtactgttgtg

SEQ ID NO: 18987 - DNA, 1044 bp, Homo sapiens
tatccttatggtcttgtttaaaaatgtttttctgattttctgttacctgtgagctttgtagttttatttttattttttgaggcagagtcttgatctgtcacccaggttagagttcaatggtgtcatctcggctcactgcaacctccacctcccaggttcaaacaattttcatgtctcagcctcccgagtagctgcgattacaggcgtgcaccatgacacctggctgattttttattttttatttttctaaatggagtctcactctattgcccagactggagtgcagtggcatgatctcggctcactgcaacctctgcctcccgggttcaagcgattctcctgccctaacctcctgagtagctgggattacaggcgtgcaccaccatgcctggctaatttttgtattttagcagagatggggtttcacgacgttggccagactggtctcgaactcctgacctcgtgatccgcccgccttggtctcccaaagtgctgggattacaagcatgagccaccacacccgtctaatttttgtattttttgtagaaagggggttttgccatgttggtcaagctggtctcaaactcctgagctcaagcgatctgcccacttcggcctcccaaagtgctgggattacaggtgtgatccgctatacctgacctatagttttaaatatggatttttttcatatatgggtattttaatctaaatggaactcacttttgtaaatatgattgtgaagggatttagctcatttttgtcttccatagggtgaggtagttttcccagtgccaggtattaaacagtccagaggtagccagcacccaagacagccaccaggggttcttgcctcctggtttccaggctcttgttcagtcccctcccacaccaaatagggcagaccttttcagatcctcaccaaggagacccttgtgtatgaccaataggacattgcagaaatgacagcatgtgactttgaagctaggtcataaaagacattacagcttctgcctctctttgagatcactcactctatgtgaatgc

SEQ ID NO: 18988 - DNA, 1068 bp, Homo sapiens
gattgtcaccggaggtatagctgtgcccactgccgcgctcacctggccaaccacgacgacctcatctccaaggtaaccaaccaggccacagtggggctggaacctataggggctgcctggcagctccccaccggcagccctgaccccctcctctcttcccaccctctcaccctttagtccttccagggcagtcaggggcgtgcctacctcttcaactcagtgtgagtatctggcctcccttcttgctttccctgacctctgttgtgacctgtgacccctggcatcctgctgagactcccagagttccccggtgcaggcaggaaattgtgagcatcatttcttggatgctgaggacagacacagtgcttgagggggtgggccctgtgatggcaggaccctccctgggactaccccatgtccccacagggtgaacgtgggctgcgggccagccgaggagcgggtgctgctgaccggcctccatgctgtcgccgacatccactgcgagaactgcaagaccactttgggctggaaatatgtgagtcacccacctctgaccccaggctagcctttgacctgaccttccaacacctcctcctgacaagctgtcaccctatagcctttcagattgcataggccgagctcacacaagtcagcatccctgaccacattctctttatcttgcaccttgcaaggggtgtagaacttttctcttaacccatcccttctctcccaggcacttggatccccattagagagttaggatataatcagagtcaccatttatggaatgtttatgtgccttgcactgttgtgtgcctggcgtctattatctcattcaatcattgcagtgatcctctaggtagaagctattattatctctacagaagaagacagggaggcccagagatgttaggtaacttgcccaagatcacccaactggtaagtaacagaatagggaccagaatctgagttggttggttggtttttttttttcactccaaacccttggtcaccagcttatattgtcatttagagtatcagaaaaattgccccagactctgcaacaac

SEQ ID NO: 18989 - DNA, 1044 bp, Homo sapiens
ccccatgccaggcctgagccttgctgtctctaccaccccagccagtggccgaggagcccttcaccttcgccatggagctggatgacctacctaaggagcggctgaaggagctcatcttccaggagacagcacgcttccagcccggagtgctggaggccccctagcccagacagacatctctgcaccctggggcctggtgagtgtctccatggcccacacatggacaccctgatactaaatatctatatctgtatatctatatctatatctatctgtacatgcctccatacagcagcaagcttaccccacacccatggtcaatgtgtctggtgacaacagaagtgcccagggggctgggtgtggtggctcatgcctggaatcccagcactttgggagactgagactgagaggagtggatcacctgagggtcaggagtttgagaccagcctggcctgcatggtgaaatcccatctatactaaaaatacaaaaattagccgggcacagtgggtcactctggtaatcccagcactttgggaggctgaggcaagtggatcacctgaggtcaggagtccgagaccagcctgcctggccaacgtggtgaaaccctgtctctactaaaaatacaaaaattagccgggcacgtaggcatgcgcttctagtcccagctactcaggaggctgtggtgggaggactgcttgaacctgggaggcggaggttgcaccactgtactccagcctgggcaacagtgagactctctcaaaaaaaaaaaaaaaagggctgggcacagtggctcatgcctgtaatcccagcactttgggaggccgaggtgggtggatcacaaggtcaagagttgagaccagcctggccaacatggtgaaacccggtctctactgtaaagaatacaaaaatgagctgggtgtggtggcacatgcctataatcccagctactcaggaggctgaggcaggagaattgcttgaacccaggaggcagaggttgcagtgagccgagatcgcaccactgcactccagcctggactacagag

SEQ ID NO: 18990 - DNA, 1031 bp, Homo sapiens
tcgagaagacattgggaccctgttgggggtgagcatggaaccctcttactctcgcttcaccctctcaagctccttagatgctgggcagaagtgggatgagtggcccaagaccgagatccctaaggttctgagagccagtgtcttccctaatctggctttcctctatccttgccgtcgttcccacagcccttcagtgaagtgcaaactcagtggccaagtgtgggccaagtgtgcattgtactggcacagagaggggcagtgactcactggagatcacaggaatcaaagggctggcccagacccagtgggctcctttcccagacctttcttggcacaaagcctttgctgcctggccttggaggccctgcggcctacattctctggaccccactatgtgcctggcacagggctagtgccttgaggaaactgaggtagctgggttggtccccttccaggaattcagagtctggtggcaggggcatgggaaatagacagatgtaattctatagcctgggcctggcaccctccacctccacgccccaccagcattgccttacgcctcccttgccccacgttagatggtttcttccggttttgcactctggctgccccttggagtctcctggggagctgtaatatctctttggagattcagattgagctggtctaggttgtggcccaggcattgggcattttggaagcccccaggtgttttcagcttgcagccaggccgagagagagcccctgagtcagatccccatggtttaggcacacctagcgggaggggtggctcctggaccccaccgtggttggagagctgagcatgtgtgtggctttagtggggtctgttagttatgggggtctgggcactggagctgcaggacacttgggatcccaggtcagaaagggccagatgagcaactaggaaagacttgggggccagggcggagtggggtcacctgacactcttgtgaggccccttctagtgcctgctcacaccggaatttcattcactccaagaagccatcagg

SEQ ID NO: 18991 - DNA, 1494 bp, Homo sapiens
ccctttcagtgtgccttgggatgcccaagtggccagacatcctgatgtttggcagctcacagactatccagtttctcgtttgagcttggggaggtggcttgcctcagttccccctgcaatgcaggttttacactattgctactgaccccttccgtgctcccccgaccctgcagagagagctccattcccgtggacgtggctcggcagcgggagctcaaatggctggacatgttcagtaactgggataagtggctgtcacggcgattccagaaggtttgagggctgaatggtgggcagggcaatgcacaagttgggaggggtagcatgtgctccagggaagcccaggaagccgataatatctgccctctggaccacactggggatagatgggccctggcgggggaatggctttaaaaatagaagtccaggccaggtccagtggaatcaagcctatgggatgtcggaggagtatccagggagtttgtggactgctggggaaaggttggaggctgtgccagcccttgaagctgtccccctcctgccactttgccttaggtgaagctgcgctgccggaaggggatcccctcctctctcagagccaaagcctggcagtacctgtctaatagcaaggaacttctggagcagaacccaggaaagtttgaggtgcgtgcagctccaaggtgtggggacatgtggccctgtctgtgcaaggggtatcagttcccccagatgctgaggtaatccccactgtcccactgcaggagctggaacgggctcctggggaccccaagtggctggatgtgattgagaaggacctgcaccgccagttccctttccacgagatgtttgctgctcgaggggggcatgggtaaggtggccggaccatgggggtcagtcagcaaacattggctggaggatccaccttttagctaggtggatacaagactgagtcgaaagtggtttttgcccttcaggacttgtagaagagctatctgtaatggactaagtgtcaagccatgtcaaaggaactgtcctgggaaggagacttgactcaggttgtgtgtgggggcacgtcatgggctccttgaagagcttgcatttgggctgggttttggaggggtgggagctacagcagtggggcagggttttcctgcctgggggttatggaaaagatcaccagggacccttaaatgctatgccaaagcatttggaattttgttctatagaccaagcttcctccagatgtcagtatatactcttctctagtagtatgcaagatgatcatcttagggagttctctgatggacttttttttgttttgttttttgagatggagtctccctttgttgcccaggctggagtgcagtggtgtgatctcagcccactgcaacctctgcctcccaggtacaagcaattctcatgcctcagcctcctgagtagctgggattataggtgcacaccatcgtgcccagctcatttttgtgtttttagcag

SEQ ID NO: 18992 - DNA, 1394 bp, Homo sapiens
aacaaaggaaactaacatttaacgagccccttctatttaacagatgtttatatgcagtttctcaatagtcttctcataactttgtgatgtaggtggtggtggtgttttttttgttttgttttgttttgttttgtttttgagacggagttttgctcttgttgcccaggctggagtgcaatggtgcgatcttggctcactgcaacctccgcctcccaggttcaagcaattctcctgcctcagcctcccgagtatcggattgaagacatgtgccaccacacccggctgagtttgcatttttagtagagacagggtttcaccatgttggccaggctggtcttgaactctcgacctcaggtgatccgcttctcacttctgacacctccgcctcccaaagtgctgggattacaggcatgagccaccatgcccggcccggtggtgtctttttataattgaggaagggactcaggtcatcccttgacaaagctccctattgtctcagagacagaactgaaatttgaacttaggtaggtttgattcttaagacccaagctttcttccgttctactcacctcctagtactggctcctacaagtaagtgtttgaagaatgatggggcaccatgagtatgaacctctgacagaacagtgagtaaatagggcagggagtcctttatttgcctggggtgatttcagggaggaggaggtagagtaaattgcaggtgacccaagggatcttaaacatttgataggacaaaactcagatggttgcgtctaaagagacagaagtacatttgttctgtattttattttattattattatttttttttttgatggagtctcgctctgtcatctgggctggagtgcagtggcacaatcttgactcactgcaccctccgcctcccgggttcaagcgattctcatgcctcagcttcgcgaatagctgggatttcaagcacgtgccaccatgcctggctaatttttgtatttatagtagagacagggttttaccatgttgtccaggctggtctcaaactcctgacctcaagtcatccgcctgcctcggcctcccaaagtgctgggattacaggtgggagccaccatgcccggcctattttattattttatttttattttttgtagagacagaatctcgttatgttgcccaggctggccttgaactcctggcctcaagtgatcctcttgcctctgcttcccaaagtgctgggattacaggcatgagctaccatgcctggccctctagggtattttattttatggatagtaaggtattacttaatgggcacttcgctgtgtgttatttcgtataaaccccttcgggtagatattgttactttctccaccttacagatgaggaaattgggcttagcaaaat

SEQ ID NO: 18993 - DNA, 1154 bp, Homo sapiens
ccaccaaggtctctctctccttcagcttttctggggcgggttgactcgtgcgccaccttatcacaggggcatattggggtcagaagaggaaccttggcagtagaagatacctttgtaccagttttttttttttttaatgttttgtttttgagatggagtctctctctgatgcccaggctggagtgcagtggcacgatcttggctcactgcaacctctgcctcctgggttcaagtgattctcctgtctcggcctcccgagtagctgggattacaggtgtgcgccaccacacctgaccagtttttgtatttttaatagagatgaggtttcaccatgttggccaggctggtcttgaactcctgaccccaagtgatctgcctgccttgacctcccaaagtgctgggattacaggcatgagccactgcacctggctattttttgtatttttagtagagatggggtttcaccatgttggtcaggctggtctccatttcctgacctcacatgatccgcccgcctcagccttccaaagtgctggcattacaggcgtaagccactgcacccggcttttgtaccaggttttaattcctagtgtacaacctagttccctcccctaaccctcagcacagcctccgggaggcccagcttgcaacaccagttctcagcccagactgacagccagatcttggccctcagcttgccacttaaaggtgctatgattattatctagagatctctgagtgctttgaagtttgtaaagcttatttagggcctagaaaccagacctgactcctctgcttcctgccctcatgacccaactttccagcatctcatcaattttttttagtgtcatgaaacccttcagcctcagccccaccccattctcagctcctcatttcttttttcttttttcttttttttttttttttttgagacggagtttcgctattgttgcccaggctggagtgcaatggcacaatctcggctcactgcatcctccgcctcccgggttcaagcaattctcctgcctcagcctcccgagtaactgggattacaggcatgcgccaccacgcctggctattttttgtatttttagtagagatggggtttcaccatgttggtcaggctggtctccatttcctgaactcaggtgatc

SEQ ID NO: 18994 - DNA, 1046 bp, Homo sapiens
gcctagaaaggctcctgtgaaggagagtcctgaagtgctggtggaacgcaaccctgacccagctattagcgtggccccggcacgggcacagccacccaaaaatgctgcctgggacccgaccacaggagcacagcccccggcacccatacccagcatggatgctcaggccggccagcggcgccacgtgtgcacggactgcggccgccgcttcacctacccctcactgctggtcagccacaggcgcatgcactcgggggagcggcctttcccctgccccgagtgtggcatgcgcttcaagaggaagttcgcagtggaagcgcaccagtggatccaccgctcctgctccggggggcggcggggccggaggcctgggatccgggctgtgcctcgggcccccgtccgaggtgaccgggacccgcctgtgctcttccggcactacccagacatcttcgaggagtgcggctgagcggcaccgcaggctggagttgagcctgaccttggcacgaaggactgacggatccctgaggtgggccactgagtcggggactccggaactgaaattcatgccctgggctttcctcaaggatccctcaagtttccaacttgtaaaaagaaaagtgcctgtaaagattcgaatagattagacttgccacccatctccccagtcttttgtttaacaaaaaaaaaaaaaaaaaaaaaaaaaaagaagagagtgagaccctggactcatttcaaagtgttatctgaagatcaggtgcaacagagacctttatatcatctcaggaactagccactccttatctatttcagatgcagatgctgagggggaccagggcctggggaggggacctacatggagggcgtggtcaaaccctggctaattgtcatcagcaggggacccagacactggagtggatgggagtagaatagatgcaggtggcacaaatccagcctctgttgggagaccaaggagggaggatcgtttgagtccaggagttcagaccagcctgagcaacaggctatctagcgatatctagatatctagg

SEQ ID NO: 18995 - DNA, 1026 bp, Homo sapiens
agctttccaatccactgcttccttatctagaaattaaggatacagcacacattttacaggactgttctgagaaataatatatgcaaatatatgcatagtgcacaataacacctgctttagaatgtttaatagctcttgcttcagaatgtttaatagctgaaatgatctatttcttggtttattcccctagaatataagcttcgtaagggcaggaccttgtctgtcttgttcagtgccgaaaaccatacagtgggcatatagtgggtattcagtatttgttacatgagttaaggaaacaagccagtgctgaaacccagatctgtctgcttctgaagctcatggtcataaacagctgttgagtgaagtgaatgaatggataccagagagggcctcactgctgcatcttgctttccctaccagcaacccccttgggcaacgtggaggagtgctaccgctacttcaccagtgtccttttttgccatggagtcagggtcagttcccctggaacattctggaaactttacccatccccagacaaggtctcacccagtctctctcacattcatcacccttatcttcttgtgaagaccccagtgggctctccttgctcctgttgctgggcttttggaggcaaagccagggctccggaaggtagtcagggttctaattccgagtcaccaccacagcggcctcctttcagcatcgacctcttcaaagaggaacagctgctggccttggaagactacgtggtcaacacttacttccgccacttcaagctctataaatacgtcttcacaccccaggtagggggtggtggaccatgaggagccaccctcaaccgcccctcccctcagcacaggtgcactcctttcagcctccctctgccttgcttcccaggtgcggctggatctgtctttgacttacatggggctacagccacccaaactgtggccagagagtgagacgggtaagggagagtgccagggcagggctgggctgggccaggcctggggccacagtctcttc

SEQ ID NO: 18996 - DNA, 1043 bp, Homo sapiens
gtttacagtccaagctcttaacctcaccagcctgcctcaaccaccaggggccagactgctgatcttgaacaaggaagaagaaaatccaaatggtttcagtgcctaaatgtcctcctttcttgcctttggtaacaactttttctgtctctgaatatcattgctacttctctggacactgcttctctgcttccagggctgtttttcttgcttagccctaagtcagcctcgtttgggccctgtccttagactctttcttctgcacgggtctgtgaaagatctcctttatgtgcgcagctccagctgttggtcctttctcagtagtctaacccagactgcccctctgagcgccagcctgagcagccagctgcctccttgacatcccctctctgggtctcattcgtgatgtctcccctaacacggcttgcttccaaagtgccacctcctccctgccatggcctcttagttccaaattgtggcatagtggtggggaatttagaaaggcttcaaagacgaagcctcttgaatgagttctcagggctagagatagaccacagagtgtgttctctgagcgctaccaacagtctgggggtgaatttggagagtggaattcaccatttaatcagtcagctggctatggaatgcccagctgcatgccaggtccagccgctggggtggaaagatgcattcatgagtagaacaaacaggattcctggcttcagggagcatccaggctgttggagaagacagacgtcatgcaatcccccaaaatacactcttataaactgtgataagtgtcatgaaggaaaagttcttggtgccatgaaagcatattgtagatctaaattagattaagatggtcaaagaaggtcattgtgagaaagtgacaattactgtctccctgagatctgaattggggaggagaattccatagacaagcaagagtaggcacaaaagacccaagggtgggaaagagcttggtatggtggggaaactgaaaggcaatccttatagtgggagctgagcatgcaggggcttgggctgag

SEQ ID NO: 18997 - DNA, 1032 bp, Homo sapiens
atgccaggtttcaacgctttgaagaacaggataacagtcttccttgggggacaatgttgtaggctacaaattgaaaccctctgtgatctggcacagtgagaaccacagggccttgaagcacatcagtaagcacacatggccagtgtactacaggagcaataagaagtcatggatgacctagctcctcttccaagatgcaatcctgaattgttttgccagagaaatgcagaaatactgtttggagaataatatatttttcaagattttgcttattgttgataaggctcccatacatcctccttttactggtgatattcatcccaatatctaagtggtgttttcccctccaaacaccacctctttgtttcaaccaatggatcatggaggtatagcagcttttaaggcctattacctgaggagacctttgcccaggtgattgctgcagctgaggaagacactgagaagccactgagacaattctggaaggattgcaacacatctgtgacttcatcaagaaccctgcttagacttggggtgatgtcaccatgcggtatgaatgccatctggaggaagacactcaaaaggttggtccatgacttaaaagtatttgtcaaggatgaggaggtttcaaaaatcaataaagctgtggttgaggtggcaaataattttaacctgggtgtggatgaggatgacatggtagagcgcctagaggtaattcttgaggaattgactaataaggagctgttggaactggaacaggaatacatagctgaagaagaggcaagagaaaaaagaaactgcaggagaagaaaaacccagaagaaaattcacagtgaagggtttagcagaagctgctgcagacctcaacaaactccttaaaacgttgaaaacacggacccccatactgaacggttttcattaatagagatatgttcatggtgcattatctgtttacaagcaaatgtatgattaaaataaaagaaagaaagaagccaagcaaacctccatggacattttttgaaagagtgatag

SEQ ID NO: 18998 - DNA, 1043 bp, Homo sapiens
aggataacttgaaactaggagttcaagaccagccaaggcaacatagtgaggccccatctttacaaaaatacaaaaattagctggacgtgtagtcccagctacttaggaggctgaggggcaaggattgcttgaggctgagagattgagcctgcagtgagctatgacgatgccactcgctgcattcaagtctagatgacagagcaagaccctgctcctggacatactactaagtgctttcagcatttcatgtggtcctcataaaaatcttgagggccgggcatggtggctcacgcctgtaatctcagcactttgggaggccaaggcaggtgggtcacctggggtcaggagttcgagaccagcctgaccaatatggtgaaaccccatctctactaaaaatagaaaaattagccaggtgtagtggtgtgcacctgtagtcccagctcttcaggaggctgagaaaagagaattgtttgaacctggaaggcggaggttgcagtgagccaagatcacagcactgcactgctgcctgggcgacagcgagactctatctcaaaaaaaaaaaaacccacacaaccttatgaggtagaattccattttagagacgaggaaactgggaccctcaattatgcagaatggatgagtggtaccgccaaaattcaaaccccagactcccgaactcatgctcagaactattacaacatgcagaaacaacaaatccagtcatgtgtgcatttaatttggcatagcaacaacaacacatttctcaggcaaaatggatttccagcttctcttgaaaagtcctgaaatctagtccaggaccgtggattgtatttaaaaaaataaaaatagaagaagaaaaggccgggcatggtggctcatgcctgtaatcccaacactttgggaggctaaggcagctggatcacttgaggccaggagttcaagaccagcctggcaaacatggtgaaaccccgtctctattaaaaatacaaaaattagctgggcgtggtggcgtgcacctgtagtcccagctactcaggatcctg

SEQ ID NO: 18999 - DNA, 1237 bp, Homo sapiens
atctgccataatcctcttcccttcatcccccagggaggatgagctggtgttaagactaatacagccattaatcctgtttcctcccaaccatgatccccaggagcagctgggtggagggcgtctgggttctggaccagaaagtagggatctcagctagagctggtatcccaggaggccatgttagatcagatacatcagttatgactcagaaagaggcttccagctgctagcaatggctcaggctgccttgagtgattctccattaccagagttgtgggaacaggccaacaagattccagagcagagagtggacagattccagtctggggcggaggcccgtacagctgtgcaaggccagaattctgtgtgaacagttgctgtctctgaggactaaccatccagaggaggaaagaaaacacaaatgctggggacctgtcacttccagacagtgccagctaccagatttagcccattggctcagcccttttctggtcccaggtctgtcttttctgggcgcttggagaccttcaggccaggcccacgtctgggtacactctttatcctggcatagttcttggacactgagctgaagaaggaagatggtgagacagatggaacctgggcctctgggaatgccacagtgtttggaaaagcccgttgggggcggggggggacgtgtaggtgaatcttttgtgaccctcagcctcctttcttagtggctctgcggacacttggtccaactcctttcttcaatgagcagatcagggaggaaacgaacgcaggatgtcagagccaggaatgctgggcaggaaggatgtgtgggttccgaggtgagaaatgcagatgagatagggttctctctgaggctttcaggagtggcgaaggtatgtggctttggtctaactttgcttctcttgcagagaaaccccgttcaccaaggccatggaagtggaggctgcagaggcccggtccccagcccccggctacaagcgctcgggccgccgctacaagtgcgtgtcctgtaccaagacatttccaaacgcgcccagggcagcgcgccacgctgccacacatgggccggcagactgctctgaagaggtggccgaggtgaagccaaagccagagacagaagctaaggcagaggaagccagtggggagaaggtgtcaggctccgcggccaagcctaggccctatgcgtgtccgctatgccccaaggcctacaagacggcacccgagc

SEQ ID NO: 19000 - DNA, 1626 bp, Homo sapiens
atgacctgagctcagggttctggtcactgtggggctggcggaggcagcagacaagcgtaagaggccccagaccactgagcaagaccccagcaacttaaggcaaattaaacacctggactgaagtcccagctgcttaggttacccattgtgggaccatgggcaagtcacttaactcttggaacctcgatttattcctctgtaaagtagggacaagaatccctatctcagaaaggtataagacattaaattaaataaaccagcacacccagcaatgtgtctggctctaagaagacgctttgataattgaggacagtaattatttttgactcattcattcctcacccaactctgtcaggtaagtactgtcattatctccatttttcagattagaaaactgaggttctaagacatgcagtacattacacacggtcacatcagctgggaagtgatggaggcaaaatctgaagccagacagtttggcttcagggactgggcacttaacaaaatactgaaccatttctctggaccttggttcccttatctgtgaaaatggaataatagaactttcctcatggggttgccatgaagggtaactgagctaatacacataaggagtttaggatactgcctggtatttggcgagtgctcagtaaatgtgaactatcttttttatcatttatttatttatttatttttgagatggggtctcactctgttgccaggctggagtgcagtggcaccatcttggcttactgcaacctcagtctccttaggctcaagcatttctcctacctcagccttctggagtagctgggagtacaggcatgctccaccatgcctggctaatttttgtattttttgtagaaatgggattttgctatatcgcccaggctggtcttgaactcctgggctcaagggatccacccgccttgtcttgaactcctgggctcaagcgatccacccgccttggtctcccaaagtgctagtgtgagccactgaacctggcccaagctatcatttttattaaggaggaacattatcaggcagactctccagaaaccgtctggaagaggtagtgagtacctcatccagaaatagggagggatcccttggaaactgtaggaagaattcaagtcatcagaaaggttagaattcagtccctttaacttatcttcaagccccaggattgattattgattgattgattgattgagacagtgtcttgccctgtctcccaggctggagtgcagtggtacagccttgaactcctgggctcaagcagtcctcccaccccagcctctcaagtaggcagtactacaggcacatgccaccacatctgctaatttttatttttagtagagatggggtctcaccaggttgcccaggctggagcgcagtggtacgatcatagttccctgcagcctcgaacccctgggttcacaggatcctcccgcctcagcctcccacgtagctgggacttaaggcgcatgccaccacacctggctaagccctaggatttagtgggaaaagtgaaataaccaagtgagaataagatggagttttgtgggattggggccaaacccaaaggggagatgcttgaggatcctcctggtggaagtggggctc

SEQ ID NO: 19001 - DNA, 1640 bp, Homo sapiens
ccatgagaaacatgggcgtcagcttcaggtacccacacaggatgcagcccgccttgatgtgggtcaggctcttcccggccaggcagcgctgcacgatgacctacgggaggggcgttcagctgcccgcttgcgggcctcccctcggccccgccccgcgccccgttccgctctgtgccccgcctctggctcgtgagtgccccaagttcagctgcacgcttggagtagatggagccttctgtctggtttagcaccaacccgaggggttcccgcccctcagactgcgccttagaccgttgtggggaaggcggggagggactcaggctccgcccgtctcggctccgccccggcctcactgcaggcgcagccctatacccgcacctggtcgctgcaccagtaccagcccgagacgattgtgagtccgaggagcagcgcgggccacggcagatccccggtcacggggtgccggagcaggtggtaggagtcgggccggggtcgatagcagaagctggagatgtttcccacggctggatcctcggacaccgtcagcgaagtcgctgctcccaggtatttgtcgaagagacccgaatacccgcccacctcgtggaaggctgccgggcaaggccgtcaggggaccctccttaggaccctcagaccggagacgcgcaacggccccgcgcgcaggccgagagctccgcgaccatgccctccgcgcccctccctggtaggcgagcccctaccgtaacccatgaggatgcaggcgccccccagaatgacgaaggtctgtaccgtgtccgtgtacatcagcgcggccagccctcctgcaacaggccggggtcaggggacagcccagctgtttatgttacaggctggccttagcaataaggcgtctttgtgggaatttgaaagagttccccttcctggagaataaatttcaaaacgatagcctgttctcggggctcatgcacgcaggcaccaacaagcagggcttggcgggcagagtgtggctgagttttagggccaggcgcctacttgcaggacccccactagcagccccctctaggccccagttttgtttgtttttgtttttgtttttgagatggagtcttgccctgtcgcccaggctggagtgcaatggtggatctcagctcactgcaacttccgcctgcccggttcaagcaattctcctgcctcagcctcccgagtagctgggattacaggggcgggccaccacgtccagctaattttttgtatctttagtagagacggggtttcaccatgttggccaggctggtctcaaactcctgaccgcgtgatccgcccgccttggcctcccaaagtgctgggattacaggcgtgagccgctcccagccggccccagttttttctgcgtcatcgtaggagaggatgattgtctaaggtcctatactcagttccgttccttctggaggtgggtccctcaagcgggccttggcaccaagccctgcctactctggtccgcatctgacctcaggccccaccccaggtccctatgaaccatactgggttttgccagagatcttggagactcgtcaggtgtgctctcccaggtgttcaaggcaggcaagagctgctaaatcttccttttctcaaagtcctcactc

SEQ ID NO: 19002 - DNA, 1433 bp, Homo sapiens
gcaggctcctcacccccacttcctgtgaggctgtggcttatggtgtccaacgcagttggtcttaggcatagaagccccagaggaacacggccactgccatcatgagcagggcattgaggttgaccacacgggcccagctcgggtcctcgctgatgtcctccagccgcctggctgctgccgctgcctcctcctgggtaaggggcggaggactgcccaccccacctctgctcattccacaaaaccagagcaggcactggcggaagaggcttggtgccggggcctggggctctgagggaaattgaggccctgcagttagtttgcgggaactcagctcctccagccccacctcccagcatggtgccctaccattcatctccatggcactctctgggcacccattctgtacagggagtgaggagccttgctgctcatcagcatccaggtcctcccgttcctccttgctatgccggagactgaagaccaggcggtggagctggggagggtgggagcacgaacgaggtgggagttctgtccccccatgcctggccctaaagtctcttgcacaccagctcgtcactgcctgccctacccacctctgtccagtctacacacccagcccaggcttaactcatgccaactccaccctacatggctgccctgtgccctcgggataaaccccaagcccctgagcttgtgtttaaagccgttggccttgctcccccagctttgtcagctcaggtctgtctacacccagatggtagcgcttgtgacactggcctggcagtcctgctcacagtgttctgtgcctgtgtgctcccaccctttcctcctgctgctgcagaaacccggccatccttccacacccagatctcttgtcctgtcctcaccccaccctgccaccatcagccctgcctggagccacctgccctttggcaacaaaaccaaacctttttgtgggcgttcaagatggtattgtgcccaccagtcagatcctgtgttttgagtcccaaaggccatgccaaggattggctttgggaggctttaatcaccaacccatcaacatcaagcctcccccaggccggttcaaataaatgtatttaaataaaaattcttgctcggcaattgcaactgcagctggacccccagcccattcccaaccctcagtcgagaaattcaggtcctcccagctgggcactccaggaagcagagggtaggtgctgtgtcccacagtgcttgcctggggcacctggccactcacgtgctttctggggatgggcgcggtgcacagggagaccgtgagggtgaggaggccagagcagaagaacagcacaatggcgaagtagaggtagtgcacgccgcagaggaaagctgggcacgccgagggctgcacacagctgcccgagccgaaggagaactcgggaatcaggcgtgcc

SEQ ID NO: 19003 - DNA, 1050 bp, Homo sapiens
cctccccgagagcgagccccggccgcggcgaccaccagccgcactaaccgccgaccaaccgccaccgaggcgcatgagcgagagcagaggaggaggaggcatgagcgaggcgggcgaggccaccatcatcaccaccaccctccagcaggctcctgcggtggcggccgccgcggctccccaggaccccgcgaccaagagccgggtgggcagcggtgcaccccaagccgcggccccggcgcccgccgccctcgtcgcaggaaacccgggtggggacggggcccccgcagccacgggcaccgcggccgccgcctctttagccaccgccgccgacagcgaagacgcggagaaaaaagttctcgccaccaaagtccttggcactgtcaaatggttcaacgtcagaaatggatatggatttataaatcgaaatgacaccaaagaagatctatttatacatcagactgccatcaagaagaataacccacagaaatatctgcgcagtgtaggagatggagaaactgtagagtttgatgtggtttaaggagagaagggtgcagaagcagccagtgtgactggccggggtggagttcctgtggagggcagtcgttacgcgctgattggcgccgttacagacgtggctactatggaaggcgccatggccctccccgggattacgctgggaggaggaggaagaagggagcggcagcagtgaaggatttgacccccctaccactgataggcagttctctggggcccggaatcggctgcgccgcccccagtatcgcccccagtacaggcagcagcggttcccgccttaccacgtgggacagacgtttgaccgtcgctcaccggtcttaccccatcccaacagaatacaggctgttgagattggagagctgaaggatggagtcccagaaggagcacaacttcagggaccatttcatcgaaatccaacttaccgcccaaggtaccatagcaggggacctcctcgcccacgacctgccccagcagttggagaggctgaagataaagaaaatcagcaagcctccagtg

SEQ ID NO: 19004 - DNA, 1083 bp, Homo sapiens
gcctggtgatgggtccctgaggcgtggcaaagcaggaccccttcgtggcagtgcgtcggtgtcgcgactccaccctgacgtctccaggagctcgagagggatggtctccggacgccaggagtcgcggagggccgaccaggatgaagaaacttcaggcggagtcccaggagagcagcgcgggatcccagcctcagcctgcccagacggtgtgtgggcaagtctccccgcaactcgcgccccctctgatctacaggacaggcctgcagtatgcccgtgggctgctctcttacccgattgtcgttctcgcggagagcagaacccggcagcctcaagggctacctggggttgggtgtttctgtgccgctgctgtatgtctgtgtgtgtgtatgtctttctttcactccttcctctctctctcctctctccctctgtggctgtgtgtgcccatgtgcgtgtgtgttttgggatgaatgtgccctgtgcgctggagggctgtttcttgcatgtcggtctgtatttggtgagactctttctgtgtctctgcctgggacgtctgaccagttgttggtctttttcccggcggttccagtttgggtttgtgaaggccttggcaatgcgggtagctgcgatggacccgcaggggttgaaatctactccccatcctgagaggcctcttttctaggatcaagacggtctcaccacacccaaggatagtatttaaaaaagcatcagcggagctcattgttcttctgcaggagaggtgcagaccgacctccaagaagatggttctaactcctcccgccctctcttcccattgagaaatggagccccaccgcgacacaggcttggagaagaagtcgagaacgggatgtggcaaggatctctgtcactccaacgctggcctttctggccaagtcacccgtttggcactccttcccggaagcccatggcggtggcattgtgctgtatcccgcctgggctctgacctctacactgtcctccctcttgctctgtctgccatgtttctgacgggcctggatgcttcttggtctggctcagtgtcttccacagagaacacttttg

SEQ ID NO: 19005 - DNA, 1031 bp, Homo sapiens
gttttggtgataagaactctgcctagccatagatcctgattttctcctattttttttctaaaatttttatagcgttatattttacataaggttgtgatccattttctagttaattttggtataaggtgtgaggtttaggtcatggttcatttcttttcctattctgtttcactaatctgtgtagccatccctccaccaatacctgtagctatacattaagtcttaaaatcaggtagagtgatttctcctactttgtttttttcaaaattgtttcagctaccctggttcctttgcttttcaatacaaatgttaaaataattttgtctatatccacgaaagatcatgctgagattttgataggaactttaataaacccatatgtcaatttgggaaggattaacgccttccaatctttgaaaacaatgtatttctccatttatttaaaatctctgatttctttttttttttgagatagggactagggacttgttctgtcactcaggctggaatgcggtggcatgaacacggcttatggcatagcttcagtctcctgggctcaagccatcttcccaactctgcctctcaagtagctgggactaaaggtgcatggcacaacactgagctaacattttttactttattttttgtagagatggggtcttgccatgttgcctaggctgttctccaactcctaggctcaagcagtcctcctgcttcagtctcccgaagtgctgggattataaacatgagcccccacacccagccaaatctttgttttctttcatcagcattgtgtactcttcagcatacaaatgttgtatgtgttttgttagatttgtacctaattatttcacttttttgagtgattatggtattaatttcagtgtccatacattcattgctagtatatagaaatataatttatttttatatgtttatgctatatcctatgactttgttgaaccacacttataggaatgtttttgtagattccttgggattttctatatagagagtaatgttatctgcaa

SEQ ID NO: 19006 - DNA, 1101 bp, Homo sapiens
aggtaaacttggtaaagcagaggcagactttgatgggattgactccaattttgaaaaaccttctactgtgtgtaaagtgctatcaaacaagatcacatgctacagagaaatcctttcatgaaaggaagagtcaatcaatgtggcaaacttcattgttgtcttatttttaaaaattgccatagccaccttaaccttcagcaaacaccattctgatcagtaagcagccatcaacattgaggtaagaccctccaccagcaaaaagattatgtcttgctgaaggctcagaggattgttagcatgttttagcaaaacaaagtatcttaaattaagatgtatatattgttaaaaaacataatgcctttgtacacttaatagatgcattataaacatagtactcattagtataaactcatatgctcattagtataaacacaacttttatttttttttgtttttagagacagtctcactgtcatctaggctagagtgcaatagcatgatcatagctctctgtagcctcaaactcctgggctcaagcaattctgcctttgccccccaagtagctgggactacaggcgtgtgccatcacgtcttgctaatttttgtattttttagagatggggtttcacgatgttgcccaggctggtctcagactcctggccttaagtgatccacccaccccagactcccataaacatttgtatgcactgggaaaccaaaaaaattgtgtgactcactttaattgtgatatttcctttattgtggtggtttggaactcaacctgcaatatctctggagtatgagtgtgtatggaagactgattatttatgaagctgggcgtggtggctcacgcctgcaatcccagcactttgggcagccgaggagggtggatcacctgaggtcaggagtttgagaccagcctggcgaacatggtggaaccctgtctctactaaaaatacaaaaactagccaggtgtggtgatacacgcctatgatgccatctactctggaggctgaagcaggagaattccttgaacctgggaagcagaggttgcagtgagccaagatcgcaccactgcactccagcccaggcaacagagca

SEQ ID NO: 19007 - DNA, 1027 bp, Homo sapiens
cccacttggtgaaaccccgcccctactaaaaatacaaaattagctgggtgtggtggtgggcacctgtaatcccagctactcgggaggctgaggcaggagaatcacttgaatccaggagacggaggttgcagtgagccaagattgtgccactgcactccagcctgggcaacaagagcaaaactctgtctcaaaaagaaaaaacaaataccaaatacattaacattgcaaaggcaatttaacctcaaatgatgttttgagaagacatcctgcttgatttacttgtttgccctataactgaaacagagaaggaaaatgacaggaaaactgtgcacacaacttacagtattttgttctattaaaatggatatcctggaacaagttaattttgaatttaaggtaacttaaaatgttttttcttgttttaggatgacaaatgggaaaagaaatgccagaagattttttcatttgcccaccagactatcagtgctttgatcaaagcagagctggcagaattgcccttaagactttttcttcaaggagcactagctgctggggaaattggttttgaaaatcatgagacagtcgcatatgaattcatgtcccaggtgatgatctgttctttctgcgttgtcatgtcagctctgctgggttcagttgcttgtttgcaggcatggtggtaatgcacatgaatttactcttcttttactgaatgtgtaactaccaccttcccaccatcatggaacctgttaatattattgttgtaattgactggtgttgatcatttgctgatgaaatctaagatttccaagtgggtcatggtaaaaatgtttcatggaacataaaattcgggaaatgcactcaattcccaaaatccagtttgggaaccctgggttaaacaaagttgaaagaagtttctttattgcaactttttagcgtttttaccatctcagttgtgtcctgtggctctcaagagagggtgcagcatgttctgatatgaaggctgcagaagtctcacaggatggaggtt

SEQ ID NO: 19008 - DNA, 1035 bp, Homo sapiens
aggctgaggtggaaggaggatagcctgagctcagcaggtggaggtttcattgagtggagagtgcgtgactgcactccagcctgggcgacagagcgagactctgtctcaaaacaaaacaaaacaaaacaaaaaaaacaaaaaccttttgggctcatacaaaatatagaaaagcaataaagaataagatgtcatccatgatctcactacccaaaccctgtatcttttaaaataaaggggtgttttttttttttttagattagctttatttgctcaccgtgaagatggacctggaatcccagcggatattaaactttttgatatattttcacagcaggtggctacagtgatacaggtttgtgtagcatttctcctaagttctcaaaactttgaaacttctctgccttccttttacaattgtttaaaataaattgtgtggttttctaaacattccagtctagacaagacatgccttcagaggatgttgtatctttacaagtctctctgattaatcttgccatgaaatgttaccctgatcgtgtggactatgttgataaagttctagaaacaacagtggagatattcaataagctcaaccttgaacagtaagtcagttacatttttgtaaaaatcctcaaagatatttttgtcctagatttgcttttctttctcaattgttttttgaactgctggcatttgtcttgttttaatcatgcattaagattgtcatgcttagcactactaggggcagaaagtagtgaccaattacttgtttttttatattaaggaaattgtggtacctatggaccataggcagtcttcagggaccagtgtctccaatttggatccctttctgtgtgtcaggggcatccaatcttttggcttccctgggctgcactggaagaagcattttcttgggccacacataaaatacactaacactaacaatagctgatgagcttaaaaaaaaaatcccaaaaaaactcataatgttttaagaaagtttacgaatttgtgttgggccgcattcaaagccat

SEQ ID NO: 19009 - DNA, 1030 bp, Homo sapiens
acatcatcataataatatatctttataaagtcataaaaacaaatcattaaacaatttttggttagtctaatgtaagtcttcgttttatatataagggtattctggatattataatatagaagtgacattttgactgattaaaatatgttaggcagttctgaacatcatattaatgaacttaagaatgaatgggtcaggcgtggtggctcacgcctgtaatcccagcactgtgggaggccgaggctggtggatcatgaggtcaagagatcaagaccatcctggccaacatggtgaaaccccgtctctactaaaaatacaaaaaaaattagccgggcgtggtggtgcgtgcctctagtcccagctacttgggaggctgaggcaggagaatcagttgagcccaggaggcggaggttgcagtgagctgagatcgcgtcactgtgctccagcctggagacagagcgagactccgtctcaaaaaaaaaaaaaaaaaaaaatgaatgtagacttcaagctgaagattgtggattgaagaaacacatctagctctaaactcctttggggaaatctaagaaagaaactgatttttattacacagttacctaaaagtcaggaatttgtgtatcagttatgtctggaagtagaagtgaaattgaggctaaaaatgagaggattgtttgcaagtctttttatgagtagcccaccaggactgtttaccctcttatcccccaggtttatcctttgaaaaaggtaaataatacagtctttggtctcaggaacaccaggtgtctgttgacggccaggataccatgttaagatcaggaagcctaggtgaaaattggacatagtaaatgctgagttcttgagtttggcttattagcgtccaggtaaaaaaagtaaaaaagtttgaacatatcttctctagagaatccgaaggacccaagagaaaaggccccaaataaagatactctcattagagattcacagagaagtggcctaattggatcatcctaatctgatgactacagtcaag

SEQ ID NO: 19010 - DNA, 1038 bp, Homo sapiens
tccatttatggaacaacatgctcttatatcagaaattaccttatctgtggctaaagtgaaaattactcacttgcctagggtttttatatttgttatggatgctttctgtttgatttttattgtaaccttaatacgttatctctaagatcagttttgcttttgcatatttcacatattttaatctttaactcaggtagagggcaaaagggcatgcagtttttttcctttcttaatatttcactatttttagcttggaaacaggaagaaaaaggcagaaaggttgctatggaattgtgtgaacttgtagaggctgaaatttaagctgccaaatgaagaaacttgttttctcttccaagattcctcctacttcatgtgttattgtgatctgaattctattgaatttctttttttcttatgagggtgtgggggagacatatatgttatggttgtagttctatgaaatatgccaggaagcatactctagtgctatttagaaagaaaaaggaagacaatgagaacttgggcaaacagttcttgctaagccctaaaatatatcacttttattcatccatacagaaaacaagcatgaggccaagaggaggcgaacagagagagttaggagagagaagataaattctacagtaaataaagatttagaaaacagaaagaggtctcgaagtaacagccattcagatcatatcagacgaggaagaggaagacctaaaagtgcatctgccaaaaaacatgaggaagaaagaggtatgaacaaatcaagcagtttttttttcaagtattaaattgatctgggatcttaattaggtagtagtgaagaaagtggaggcattgagctcctggacttaaaaatcacaactcatattttagtttgaaagcatttcctctgtggtagatgcttattatttttttaatcacaggaatttaattcttattggaaacctgaaggcttagttaggtaaaatttaccttgctataaactgatgataatagagttcaaagataatttgtatatgacatcctgaa

SEQ ID NO: 19011 - DNA, 1050 bp, Homo sapiens
tagctagtaatgtttaattgactgttggtgtgatacaaatgaaggacttggtttatcagtgtaggtaagtttaatgaataccctacactgttttaaacgtctgttttgacaaaaggtctcttcagtgtataattgggagtttagtggcaggaggtgagcaggcagtacactggtgaattcccttattgccaaaataaggcaggcttcattctggggtggaatgtgaaatctcttacagtatttcattcctgtgaggagctggctttttcctatattatggaggtttgaagttctcttgcacattgctctgttcctgagagcttccttatgtcagttgctctgtatacataggcccaactgtactgcaatagtctctagttattttgatgatcaccttggtggcctgctctcccttactgtactttttgtcctgccctgggattatccttgagaatcctcctttgggaggaacagctctccgttctatagcagctatcacttactcctatttttggattgtagtttattttattcttgtttcttatcagaaccatcaggttgccagtttgctgaaattctgtaattttgggtcattaatagtacctttttcttgtttccagcaccacagatatattttcctttttctccttcccctcttcccatgtttcttctcattcaatgggattttgagaaggtggtaaggtaaatgtgtgtcctatccgattttatttattcaacagtctgtgtaagtaatgttctgggttctgcaaataaggtaggccaaggattcccaagtttcataaagcctatattttgatggaggagacgcattgagcatataagtaaataaataacagattatagctgtagtagattacaggaagtaacttgggctgggagaatcagagcaagtgacctgtatatggatatctgaagagaaaaaaaggcttatcttatgaagagccgtgggaagagagctctaggcagaaggattagcgtatacatagactcagcggaggaaggagctcgttttattaaaagaaaggcacg

SEQ ID NO: 19012 - DNA, 1035 bp, Homo sapiens
ccacagtgcccagcctagtgtatgttattttgattttaacattgcacttgtatatttttaatgtccatattgtatactgtagaccctactcaaagaataaatctggaactattcatgaaaaacccctccagtaatcacctaaattcttgaatgttagaagcacttgataggactctagctttgtacttgatcacatttactcatgtgttcctctgaaaatcattacatcacaggttaaccacctttttagtttgccctaaaattttctcctatgcataagcccaatgaacacggagaaatggtaaatttgtattatgttcagtgaaaggttattctttttaattctaaaaaggtgggcaagctgattatcatttataatttaaaggttatatttgataaagaaggagatcgtccttctgtggtgatcatttcttcaaatagagtaaattttaaaaatcactttaagaatccaatagagaacaacaaagccatattgagatgcaggttttaggaatttggtagtaatccctcacaaggtcagacttgatctcctggacaatcagggcatgctagtcagctttcatgactcagcaaagctacaaattatgtattttggctttttgtggaaattgccaaccctacagatagcaaacgtctcctcggttgtcaaaaagtaagagtagtttttagaattctgcctttgggtcttgtagaatgaaatatttacaagatttgctatttgttaacattttagctacttccttgttccttcagtcttgctgctgtgcacaccaccataccaggaatatgagggagaaagctagcaagacagctaaataattggaaattctgcttggaggttagactgtgttgtaaaatggtacagacagtgcctgggcattttcattgatagaatccttggagtcgtttggggttcgttgtcaaatgatgtctggcagtgcagcagcatgataggaagtgaagaaggaatgcttatttgcagaggaaggatgacttttttttggtttgaggcat

SEQ ID NO: 19013 - DNA, 1710 bp, Homo sapiens
ctaattgctctaaccagaacttccagtatatattcaatagaagtgaaattgggtatctgtcttattcttgatcttagtggagctctgtccttcactactgattatgatgttagctttgggtttttcatatatggcctttgtcatgtgaaggaaattttttttctattcatagttaattgaatgttcttatgaaagcctgttgaattttgtcaaatgcttttttaaaaattcattgagttcatcatgtagtttttttcccttactgtaaatgtgatgtattaaattggtggacttttgtatattgaaccactcatgcattctgggaataattcccacttgttcttggtgtataatcattttatatgttgctgaattctgaagtaataattttcttgaggatttttatattaatattcataagggatattggtctttaggtttttttgtgtatctttttctagctttggtatcagagtaattctggcctcatagaatgagtaactagttctggcctcatagaatgagtaagtagtgtttgttcttcaactttttcaaagagtttgaggattagtgttaatttttttttattattacaatacttgaagttctgggatacatgtgcagaacatgcaggtttgttacataggtatacacctgccatgctggtttgctgcatccatcaacccatcatccacatttctcctaatattatcactaccctaggccctcatcccccaacaggccccggtgtgtgacgttccttcccctccctgtgcccacgtgttcttatatttcagctcccacttatgagtgagaacatgcagtgtttggttttcttttcctatgttagtttgctgagaatgatgatttccagcttcatccatgtccgtgcaaaggacatgaactcatccttttttatggctgcatagtattccatggtatatatgtgccacattttctttatccagtctatcattgatgagcatttgggttggttccaagtctttgctattatgaatagtgctacaataaacatgtgtgtgcatgtgcctttatagcagcatgatttgtaatcctttggatatatatccagtaatgagattgctgggtcaaatggtatttctggttctagatccttgaggagtctccatactcttctacgatggttgaactaatttacactcccaccaacagtataaaagagctcctgtttatccacatcctctccagcatctgttgttttctgactttttagtgatagccattctaactggtgtgagatggtagctcattgtggttttgatttgcatttctctaatgaccgtgatgatgagctttttttcatgtctttcttggctgcatagatgtcttcttttgagaagcatatgttcatatccttcacccactttttgatggggttgtttttttttttttttcttgtaaatttgtttaagttccttatagattctggatattagccctttgtcagatggatagattgcaaaaattttctccgattctgtaggttgcctgttcactgtgataatagtttcttttgctgtgcagaagctctttagtttagttagatccatttgtcaattttggcttttgttgccattgcttttggtgttttagtcatgaagtctttgcccatgcctatctcctgaatggtattgcctaggttttcttctagggtttttatggttttag

SEQ ID NO: 19014 - DNA, 1064 bp, Homo sapiens
aagcccaaattaatgtgggttttttttgttgttgtttttggtgtgatatccaagaaatcattgtcaaaaccaatgtcatgaagcttttctcatatgtttgcttctgagagttttatagttttagctcttgtaatacatttaagtctttgatgtatttggagttaatttttgtatatagtgtaagttaaggctccaacttcattctttttcatgtggatatccagctttcccaggatcattttttgaaaacactgtcctttcctattgaatggtcttggcacccctgtcaaaaatcaattagatctgggcacagtggcatacacctgtagtcccagctatacaggaggctgaggcaggaggattgcttgagtccaggagtttgagaccagcctaggcaggagttcaagaccagcctggtcaacatagcaaaaccccatctctatttttctttaaaaaagtaaaaaaaagaaaaaaaaaaaggccaggcacagtggctcatgcctgttatccgagcactttgggaggccaaggtgggtggaacacctgaggtcaggagtttgagaccagcctggccaacatgacaaaaccccatctctactaaaagtacaaaatttagccaggcgtggtggcacacgcctgtaatcctagcttctcaggaggctgaggcaggacagtcacttgaacctgggaggcagaggtcacagcgagccgagatcgtgccactgcactccagcctgggcaacagagctagactctgtccaaaaaaaaaagaaattatgtgaagatttatttctggcctcttaattccattggtctatatgtctgttgttatgccagtagcaactgttttgataactgtagatttgtagtaagttttgaaatcaggaagtatgagtcctccaacttttttcttgtttttcaaaactggattggctattcatggttcattgagatttcatgaactttaggatgactttttctatttctgcagaaacactgttgggattttgatagggatcattttaaatctgtgggtcactttgagtaatattgtcatcttaact

SEQ ID NO: 19015 - DNA, 1049 bp, Homo sapiens
aataattttttaaagatacctgtgtttataatttctaaaactttatttttattgtggtaaaaaatatacataacaaaatttaccctttaacctttttttttttaagactcattttgtcacctaggctgaagggcaatagtgctgtctctgctgtctgcagcctcaacctcctgggctcaaaagatcctcccaggtcagcttcccaagtagctggcactacaggcatgagccaccatgcctagctctctttaaccatttttaagtgtgtaattcagtggcgttaagtacattcacagtattatgcaactattaccaccatccatttaagccgaagtttagaagacaaattgtaatatgattcagcagaaaggaacttcattcctttttaaggccaaataatattctggtatattgtatatgtgatgttccgtttacctgttcaactctgacagttgatgtgagtttgcaagtagcataaataaattattcactatggaatcaaaaatataaacgtgattaaataaatgtcaatcctgtaagcgagctcctaaatgaccaatgatatgtagttttcaccaatgaaagcttctcttaccttgctatgaaatggaacgttagatgtaatgtaagacatcgaggattaaagtaactatctcagtaccaatgactttcttcttttttctgttacagatccagactttacttacctaggaggtattttaaatcccattccaggtttagtatattaccacttgttcctcttggcatttttgattagtcttatgttcctttgaacacctttcatgtattccttccagattgtcagttcgagctctcgggagctgatggaatagtgcgctctagtcaggtagaacaagaggagaaaacaaaaccaggccaagccgttgattgcatctggaccattaaagccactccaaaagctaaggtattattatgtattgagtcgcttcagagaagaacatcatgataaggcatgatttgcaaaatgtgtaattttggtttgtgtaaatatttattgactacataaa

SEQ ID NO: 19016 - DNA, 1172 bp, Homo sapiens
tacattagtatgtatgaaaaacttctttctctgataagaaacttaaacttactggcatcccttataaggcttaattcaaatttatgtccacataagtgagttcttttcatttcttctgtttatttttctgtgtattgtggtacgttgtatcttgaactaagtattagcttcttgactcttcagtttgaatcactcaaaaatatttaatttagtagatagcatatgccaatggaaaagattactatagttctacagagtagcattatttttaatgtaagatacatttatcatgacttgtatagcaattctcactaagacctttgtctatgaagcagttagcagaacagttattctgcttttctcatttgtgtcaatacatttatattctttcttgtttgtgttgtcctgatttgcttactcttattttctagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccaggtaaagaataagttatcttttaagtggttgggcatctcactctaactctgattttagaatcttaaggttagaaaagagattaatttggtcaagttaatcaaatcaagattttaaacaaattagcaaagtcaaagggaaattagtccatgaacaaataagaagttaatagaaattggacatagaaacgtatcacttgaattttgaagcatatcagagatggtgccacattttcttagatttttttctgtcttatagcacatgctcaggctaacatttaaaatacatttaaaaataaataattttaaaaataattcaacaaattgtcttgttttcagaattcccacaaaaattgttttgtatgatttttctcatttagctgttagaattaaccactcaactgaatgaatactctagaatatattgagcaatagaaagaatactgctctgcacttggatgtcaaagatctgggtttgaattctttctctgcctcc

SEQ ID NO: 19017 - DNA, 1005 bp, Homo sapiens
acaatctaggccaggcacagtggctcacacctgtaatcccaacactttgagaggccaaagcatgaagaatgcttgaggccaggagtttgagatcagcctaggcaacacagtgagtccttgtctctacaaaaaaattagccatgtgtggtggcatgcacccgtagtcctagctactcaggaggcttaagcccaggagttcaaggctgcagtgagccatgattgtgccactgcactccagcctgtgtggtagagcaagaccctgtctcaaaaaaaaaaaaaaaaaaaaggcacagtggctcatgcttgtaatcccagcactttgggaggctgaggtaggcagatcacctgaggtcaggagtttgagactagcctggccaacatgacgaagcaccacctctactaaaaatacaaaaattagctgggtgtggtggtgtatgcctataatcccagctacttgggaggctgaggaggagaaccacttgaacccaggaggcagaggttgcagtgagctgacatcataccactgcattccagcctgggtgacagagtgagtctccatctcaaaaaaaaaaaaaaaaagataatctagatgaatcaaagatgtgcctgtaatcccagcactttgggaggctgaggcaggcgcagatcacctaaggtcaggagtttgagatcggcctggccaacatggtgaaaccctgtctctactaaaaatacaaaaattagctgggtgtggtgatgcatgcctgtaatcccagctacttgggagactgagacaggagaatcacttgaacacaggaggtaaaggttgcagtgagccaagatcacaccattgcactccagcctggacaacagagcaagactcttgtctcaaaaaaaaaaaaaagtgttccctagaaacacacacaatacaaaactgacccaagaggaaatagacaatgtcaacctacctgtaacaagtaaagagattgaatcagtaattgaaaacctcctgaaaaagaaaactca

SEQ ID NO: 19018 - DNA, 1009 bp, Homo sapiens
gtgtgatttttaagtgtgtctgtgtgtaggacaaatatataaacaaactaacgtatgttactatgattatctcttggtttttggattttatatatttctttgcatttttgtttactaaatatatattgctttttaatttaagaaaaagcttttaaaatatttcaaacatatgctgtatttcatgcataaaatgtattctaagcaaggaagtagcacttaatttaattgactgagggagtgccatcatgaaaccctgccccaaattttaaaggatgaaaattcccagtttaaatgttaagcatgttgaactccaaagaaacattactgggctaaaccgtaccttccatcccatcctaccccatcagcagagaatgttccactgtaggaagaggatgactacatttacgtatttcggaaactacagccttggttttctcctagagcagctgagagtcactcactacccattgtcgggtcataaaattaatgtagtagcttttagagtattttacttaatagaataaaagagaacagtagaaaacaatctattgatcagagtacatcccagatggtaaagtattgtttcatgaaatttttatttagttgtgcgtgcgtgtgtgtgtgtgtgtgtgtgtgtgtgtgtgtgtgtgtgttttcacactgggtaataacataggatgtagtttttattgtgggctgtgatcagaaaagtttgaaaaccactgccagagagaaataacaacaacaacataaattaatattattcagtaaaggcctggcccaattatcctattgcttacagatagattatcattcttacccattactctgcagtcttagtccatttcctagcaaagcctgaatagccaaacattattagagagttacattacagaggagtcattaattttctaaataatagttcctgtaacagatttaaaaaataaaaataaagtacatttattatgaactttttaggagcttaaactcctctggttttgaatctagg

SEQ ID NO: 19019 - DNA, 1039 bp, Homo sapiens
cagatacattgtccataatgtataaaagcttcttcagtcaatatattagcaaggtaaactggtggaaaaaattatgttttcacactccttaataacatcttcacttttattatacttagtctttccatagacttacattggtagattataaaaggttcttatgacaaaaaatgttcactttcaattcttcatatatccctattatgatggagccaactcattatccttattttttagttgaagtagcagagagattgggtgaaattacttgtgttatcttggtcagaaagtgaagtgcaaattagttaattaagttcatcttagaagacgtataaattaagaatccaattaatagtataatataaactactcctagttttttttattatatagaatagaagctgtaatacatagagagggttttttgatatattattataaagaaaaaatctggttatacatttaaataaataataaaggaaaatgtaattaagacaataaaagaaataagattgagcaaaggatgtctgcttttaacagatggctgactgactgaggttagatccaaattacagtaaatataactgtgataattccagttatctaaagaagaaaaggaatctgaatatgcttcttttaagatgcctagagttttaaccatgaagaagtataagcagagttgctgtcactcctctatttttttggccaaaaaagaaaaaggaagaactcattatatggacattgccatgttatgtaatggccttactaaatcaaatataccccagagtgagtttacttttttagctaattgcacacatttaagagtctcagttgtactgcttgcttcagcacagaaacattccatataacaaaatttttttaaaaattcaaggagaaattgacaaacacaattatactttatttatttatttatttgagacggagtctcactgtgttgcccaggctggactgcagtggcgcgatctcagctcactgcaagctccgcctcccgggttcccgccattctcctgcctcagcc

SEQ ID NO: 19020 - DNA, 1169 bp, Homo sapiens
ataacatgcatccttcctttctaaacagcaaattcagtcttatttgagctaagagtttcacctatcttcattattactgcagccacaaaatactgatacatgagtctaatcatttctatacttttaattatccatgtcctctcttttgccattttcaagaaagtattatttggctattttaaagctaaaaaaatttaaatatactgtttatttggtatgatgttaattttggagttgaagtacattccttatctctgtccttcttcaactggacacctctagataagaaggcaagaaattcttaaaacttttgctaacctaattgtgtatgtaattagaataaccaagttcagttaattgaaacaatgagtattggagtaagagtttgggatttgattccttagggataaactactaaatccaggacagtcatttaactgctgcagatttgagttcccaggggaaccaaacagaagtcacacaatttctaggatgaaaacatctcaaaaaaaaatcagtcctcccagcacttcgggaggctgaggcagggagagcacttgaagtcaggagttgaagaccagaccagccaacatggtgaaatccctgtctctataaaaaatacgaaatttagttgggcgtggtgacgcgtgactgtagtcctagctactcaggaggctgaggctggagcctgggaggcagaggttgcagtaagtcaaggtgacatcactgcactccagcctgggctatagagcaaggctctgtctcaaaaaaaaaaataaaaaaataaaataaaatcagttattttacctttgctcacgagcatcatccttcttggtgaaaagcagcgtatttttagtcttcatttattttaatatcacatttaatctctccttcatccatccatttcagaatgcttggcaagcactctgaaatctaggcttatttatttgtgtcattcacattaacatctctcttactcctagtatgctttaatgatctaagcaacttaagagcagcctctgtcttatttgtctttgattgctgggtgcctaacacagggcctggtacataggagacattcaataaatttatgtcaaataaatgtccagctatcttttgaggcatggattggctatcttgattaacagtgttcccttcttctctagtac

SEQ ID NO: 19021 - DNA, 1034 bp, Homo sapiens
tcagacaaagacatacaagtgactgacaagcatgaaaaaatattcaacattactagtcatcagagaaataagaattaaaaccacaatgaaatataccatctttcaccagtcagaacagctgttaagtcaaaaaacaacatgttggcgaggatgtggagaaaaggggccacttatttgctgtcattgggaatgaaaattaatacaacctctgtggaaaacagtatggagattcctcaaagaactaaaaatagaattaccatttgacgtagcaatcctactactgggtacttaaccaaaggcaaagaaatcattataccaaaaggatacctgtactcatatgttttttgcagcactattcatagtagcaaagctatggaatcaacctaagttccccatcaacagatgattggataaaaaaatatatatatcatatacatatacaccatggaatacgactcatctataaaaaagaatgaaatcgtgtcttttgcagcaacatggctggaactgtcttaagtgaaataactcagaaacaaagtcaaatactgcatgttctcacttgtgaatacaagctaaataatatgtacacatggacatagaggatggagtaatagtgaagactcgcaaggctgagggggtgtaagggatgagaaattacttaatgggtacaactcatgggtacagtagtatatattgtaccaatgtagtaatttctcatccctcatacccgctcagcctcatgggtacaatatatactactgtactgtacgtgggtacaataggatatattgtacccatgaggctgaggggatgtgagggatgagaaattattacattgtataactattaactatgtatacaaatagtatatattgtacccatgaagctgaggggatgtgagggatgagaaattatttaatgagtacagtatatactattgtatactaaaagcccagacttcatcactacataatatgtccatgtaacaaaactgcacttgtagcccttaaatctataaaaataaataaatagta

SEQ ID NO: 19022 - DNA, 1050 bp, Homo sapiens
aaaaataaaatagacagctgcagtagcagacttcatcagacttaagaaagaacctttaaatatgtagatctgtcatttcaaattacccagacagagataaaaagaaataagaatgcaaaagagtgagagaaatcctacaaaacttaagttacatcaataggcacacaaatagtaatcttatgggaattccagaaggtgaagagaaggaaaattacatagaaaatctggttaatgaaatagtagatgaacactttccatgtcggtggagagagatggacgtttcaattcaggaatctcaaaggtctccaaagagaatcaactgcaaatggtcctccccaaggcatattgcaattaaatggtcaaatggcagagacaggaaaaaaatttaaaaacagcaagagaatgaggagaaaaagcaaaaaagaacagcaaaacagtcaagtcacatacaaaggaatcccaattagaataacagatttcttgcagaaaccttacaggctatgaatgagtgggatgatgtattcaaagtgctgaaagaaaaaataattgttttacatgatacgaccgagaatactgtaactgtaaaaaccaaagaatactataaccaccaaagctgtagttcagcagagagagagagaaataatgtctttcctagaaaaaaatctgagagaatttataactgctagatcagccttacaagaaatagtcaaggtagtccgagatctagcaggccacaggacaatattcaccatcatgaaaacatgagaaagataatagaacagatattaaaagaaaacagagacaagaattaaaccttgtcgctgcaaaaaactgtgaaaccacattaataaacaagattggaataaagaaacaaagtatatagagaaaaaacagaaaacattcagccaagtgacaggagtaagtcttcacctatcagtaataaccttgaatgtacctgcattaaatttcccacttaaaagatacagactgactgaatggatttaaaaacaaatatggcccatctatacctactacaagatactcacttta

SEQ ID NO: 19023 - DNA, 1050 bp, Homo sapiens
tcttttttaagacagggctcactctgtcacccagtttggagtgcagtagtgagatcatggctcactgcagcctcaacctccccaggtcaagcaatcctctcacctcagcctcttaagtatttgggactacaggcacacaccagcacacccagctaacttcctttggccatgttgcccaggcttgtcttgaactcctgggctcaagcagtccacctgcttcagcctcccaaagtgctgggattacagatatgaaccgctgcacccagcctaaaatatattcattcatgtattgagaggttctttgaatgagagtaacattcatggatttcattgtatttagcaaaatcaatgattaataaaatagaacatgattaaaagccttttcacatactaacactattatttcacaactttcttactggtgggccaaaataccaatatggtaaatggtgtgccagatgatattgtgggtatctaaattgaaaggtactatttcatataaaatgaagtcatgtaaatgtggtatcacagttcattgaattttaaaatctcagttgaaaccattatatttttcagtatttaatattgcttagtaaagacctagtccatgatgaagactgttttcctgcttgaagagcaaggtaaaaagagcagttccttaaagcacgaaacgggtcttatgtccactctgcttcttttgtggattagaaaactgaccatagggaagtacggtaacatacctctagtcctaaagccaaacagctcttggtatgaatcccagctctactgcttaccaacttcatgaacttataaaagttatgtggccattttatattatggttaatacagtgcttatatacttcattaaaagaaaaattttataacgaatgtttgcttttcttatttctaaactaatcaactcaaaataaggtaaaaagtcatatttaagggcatattctccagtattgtccatttaccttcaatccagagaaaaaccatatttttcagctgcttgctaggtctctaattctggatgaacctttgacaaac

SEQ ID NO: 19024 - DNA, 1051 bp, Homo sapiens
aagagtgtacagaaacagcgggattgcttacagcttggtgtttgctttatttaaagtttgttaacagctgacttcctgtgacttgctgaaaatctgtgattggtgttaagaatagtgtgtttacacagctagttaggctgcagtttactttgtaaggggaaacctttaggccaaacttaaaatattaatatgtaaggaggcagacttaggctaaatttgtgcccaatttgcctgccttcctcttttactcaggaagagtgtgaaaggaaagtaaatctcaggacccccaaatcactaagcaaaagggaagagacaagctgggaactgcgtcacacaaacctgcctcccattttgtttccaaataagatagctacaaagacaaaaaaagctacatatctccctcacaatccccccactgagaaattccttgtgggccccaagatctttaacctgtaacagttctgttgaatttcaccccaaccatgtaaattgatagcttattctttacacatacaggacaaaggacagaactcaaagtcatccctctgctcacctgagacaaatgcatatctgatggcttcctgtacgctatatttattttatcttatgtagaaatgcagattcactaagctagatgaatgcgtcagtgactattcctctgctcccctctcacaggtgaatggctgatcaaagactcaaaagaatgcaaccgtttgtctcttgtctactcataccttttaaaatttcttcctctttccccaatatctgcccattcccctttaaatactgaagccctcacaatcatctctggagaacgttgccaaaataaacttctaaactggttgagacctgtctcagatactttctggttttcaaaagcataaaaagacatatagaatttaaacagcatcagaaatactgatcaatattctggcagaaaataatttctggtaatcactactcagatgaagctccgaggcaaactggtgagtccatggaaggacgaaaattacaattaagagctttgtagctatcaaacctcatcttctta

SEQ ID NO: 19025 - DNA, 1059 bp, Homo sapiens
ttaggaagccaaggcaagaggaaggaggatcacttaaggccaggagttcaagactagcctgggcaacacagtataaccctccatctctacaaaaaataaaaaaataagctaggtgtggtggtatgtgcctgaatttgtagctacttaggacagtgaggcagaggactgcttgggcttacaatgagctatgactgcatcactgcactccagacaaggcaacagagcgagaccctgtttcaaaataaaattaaattaaaagaaaaaaagtagctcaacaagatacaagagaaatctgaaaactaatacaaagaagtcagaaaatcagttcaggaaatgaatgagaaatttaccaaagagataggtattttaaaaagaaaaccaaacagaactcctggaaataaaaaattcattgaaggaattataaaatacatttgaaagcttcaacaacagactagaccaagcagaagaaagaacctcagaactttaagataggttttttcaattaatccagtcagacaaaaaaaaaaaagaaaaaagaattttaaaaaatgagtagagcctctgaaaagtaagggattacataagacattggaacctatgaatcataggtattcctagaggagaagaaaaagcaaaaatttcagaaaacctatttgagaaaataattgagaaaaccttccctagtctagcaaaggatctagacatccagatacaagacgctcaacaaactccagccaaatacattgcgagaaggatctcaccatggcatctagtcatcaggctgtctaaggtcaatgtgaagggaaaatccctaaatacagtaaaagtgtctagtcacttatacaggaaacttcatcaaactaacagtggacttctcagcagaaacttcagaagccagaagagacggggattctattttcaaagtgcttaaagaaaatggtcaaactcgaattttgtatcctgctagtgtaagcttcacaaatgaaggagaaataaagtgtttcccagataagcaaatgagggaattcatcaccacttgattggtcctatgagaaatat

SEQ ID NO: 19026 - DNA, 1052 bp, Homo sapiens
gagaggttccagaggacaccagtaactgtgtgaagttttccattttcattttcacctcatgttttgctaatttaagcaaattaaggtagtacattttgtgtttaacagttaataagcttgacattttagtattaactatttgcatttgggtcttcatattcttagcctatagaggtaagatctatagccatatttcttggtccattacacatttgatttatgaggcataactcttgtcctgaaattgcttgttataacgaagacttcctccatttcttatttttggtgtctttcaggaggctgtacatggggtaggtatgggagatacttattaactttgttctattgcttttatacccttaaacttgaaattgtcctatttaatcatgggccagtttggtgtgttaatttttggggaacagtttttcctttgtgagtaatttttattgtaatatgtatgattttaagacccacctttctgcaaacttcaaacgtatgtaagtggctgtagatagcttagctcaccaaaataatagtgtgctgcctccaacccccaaaagctcttcatatttagaaacatctgcagtgattctactaatggtagaattctatttcattcacactcctgattagaagaattggtaagtaatccaaattaagaaaataatggatcaaatccaacatacctggggggtcagtctgtgactgctgcattagaatggacataaaagtaatgtcgaaactcgacagggtgaatagtgtgtgtgaactaccacgcaggactgtggtatttgtgtaggttaaacatgaaaggtacagatagagtgttacagagacccggagtttgaagctttgtcattcccctccccactcatccagtgtgcatgttcaaagcacaaaggagtatttggtagtttactgcttatgatcctaacctgaatttaccaaaagaaacgtacgtttatctaaaaatggcaccatccaaacaaaattccttatcaagcatctactaagatttggtggcaaacagtgtgggttgtagattctaactg

SEQ ID NO: 19027 - DNA, 1033 bp, Homo sapiens
taaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggcaaattaaaaaaatcttactgtgtctgctttagctctaagtttgataaaatccgaagttattttcctgtttcattccatactttaattatatagcagaaagctgtgtgttgtcatttttaagtgcggtagacttaactctaatcacagcaaataactgggtatatggcctctggattagtctttcccatgccctgcccctcttgcccacattttgattcttacaactgtcaggagaatgactaaaatgctgaccacttttcacctctttaaaaaagcacaatgatataataaattcactatttcatagcctagtggctaagagccttggttctgcaaccagacttccaggcacctaagtgccagtctcggctctaccccactaaccagctgtgtgaccttgggccccagtttcctaatgtgtaaagtggggttaaattatggtagatacttaaaacctttaaatggggtacaggtatgttacctgaaacagtgctttgctcatat

SEQ ID NO: 19028 - DNA, 1018 bp, Homo sapiens
atgacaggttaaacctctgcacgcactagctgatgcaatgcaaatctgaggcgcaggactttattggggcaagggtagtgcttgtttaaaaacaaaacaagctactctgcgtttaatgaggccatttaagatggctttcccagagtgggaagagagtataatctcttaggaggtttaagtaggagtttaatgtggcagaagtgtgcttactacttttcctgcaaagtcttttcacagtgggtaaggagagtttaaaatatagtgctgataggagtagaaatgaagtgagctagaattgaggaaatatggtagttgatgcccggtaaatagccgttgaatgaattagggagaatgttttcactctaaaaatttagagttcgcacgataaacctggagcgtagcgccagtgtggccacgcatttcccagatacgctgtagctcttagatcgaaaccataagaaactgccgatattcgactgttctgacctaccgaaaatagcgtggttccacctaattttaaactggtggaaatgctgaggaaggttcgatgtcgctggggtgggatggggtcaacggcggggtggcgggggctcccccacgcccccggcctttggctggggggcggggcttgcgggcacggccccacccttgcgcgagcaagacgggcatcgccctgtgcgccgcgcgccctgaactggccctggcgccccgggttggagtaggcgttcccaacgcaggcccagccccggccgaggctccaaatggctctcccggcaggcaggctcctgcagtaactcttgagctggctcagggagcgcacttccttctcagccagcgcgtcgccccctgcatccgtggcctccactggagctgggcaggaccctacccagtgaatctggagaaaacaaacttgggagacagacgaaagcttagggcacattggaggacagcgcagctgtggctcccatttttggagatgcagtcgaatttgagctcacagggaggtgtggttgcctcc

SEQ ID NO: 19029 - DNA, 1020 bp, Homo sapiens
atctgactacatttctccattttaaacttttataagtaatttataaaaggaaacaaagattaccacgtggaattgagaataaaagtttatctttctactgttaagtatgctaaggtggtaaagcaatggctgaatgctctgaaattactaagacaacattaaaggctgattctaaaatgtttttgtttagattgacatctacttaaactatataccaaactgggcttgggacgtaggctttagaaagtgtaggtaatagtgcattcttgctaagttttggatttttgccagttttggattctatgggcttgtcttaaggtacttctgtgaacttttcagctttttgtaaaactagtgtaaatattctacctagttgagaattaaggtttattgtgctaaaaattaaatggtggttgattcttggcagacatgtttgatcacctttgcaaggttaaggcatcttttggagtgtgtttcttggaatctacaaattctgagtctgtgactaattgatgacttggcaattaaatcaggtctcagctgaaaacttaaatattctggaatatgtaccatccatgatacacataaattacccatctcaatctagacaaaagccagttgaggctggaaacagtccagttttacagctcaacaactggtggagccggggtctgaatccaagtgtagatgactctagaatgcttccacttttctgacttaattaagtagaggggcctgtccatagatcagtggttttcagagtgtgctgtaaggctctgtacagatcttttggagtttggtaaacagtgaaatatcttttgcttgagaaataatcagtcatctttttgttgtatacattttggttctgtttggaagagtttctctatatgaaattttcttctctagggaaatttaagacctgtcgaatgaaaaaatattagaaaataaaaatatagactgggcacagtggctcagcactttgggaggccaaggcaggctgatggctttagcccaggagtt

SEQ ID NO: 19030 - DNA, 1051 bp, Homo sapiens
ggatttcagcttttactctaacatgggtagccagcggagggtgtagagcagagatttatgtcatctgatataaaacggagctggattaattaatctaattgctgtgctcagaacatattaggtggtgagggtgggagacatagctgggaacaatgagactggttgggaggatattgtggtaatccagatgagagatactggtggcttggactagatggtagtggtagaggtagggaggaatggttggattctgaatacattttgaagggaggtataataagatttcctgactgttttagatgtatgttgtgaaagagaagaatcaaggctgactcgaaggcgcttgacctgagtcactggaaggatggagtctctattaattgaaaaaaggaagactctgagtggagagactttgggaggtgataaggagtttctctttggccatccccctgaaggggcaattggatttacaaatctggggtttcagacaaatctggagcattgtgtttatttttaaaatctgggctggagatgaaaattttgaaatccttagcatgttgatggaatttaaaactaggagactgaatgagatcaccaaagtaccagtgtacataagaaaagaacatcttagggtgtaagggtgggagacaaggatggaaacagagagactggtttggaagagattacagtaatttataggcagctacaatttcaataatttgggggagaagagcaggaataaaaggaagctgaggagtgactgagataggaaaaccaagagtatgtgaagtcggtgaacagagtttattaggcaggagcccagtgatccgtcaactctgttaggtgttgctgacagttcaaaacttgcaatttaaatacaaacaaaaccacagaaccattgaaattcaaattactgattcactaaaatattggatactgtcaggctgaattttagtcttaaaactgcacttatgggattgacttacggttatgaaattgactgttaccgggcaggttctttttgagttaagcataccttaattgccctgta

SEQ ID NO: 19031 - DNA, 1118 bp, Homo sapiens
tgtgtgattaaggagtattatttgcttatccatgacaaagttaccagctgaatagccatgtgtcccagtacttcttattttattttattataatttttatttttattagagacgagatctcactatgttgtccaggctggtctcaaactcaaaggctttagcaatcctgccgcctcggcctcccagattgttgggattacaggtgtgagctgccacacctggcccttcttttgttttttaagtcttattcttttccctgaccatctcaaatactttctgaccagtatttctagaacgattttttttttccttaaatcttcaggaggctcagcgtggcggctcacgcctgtaatcccagcactttggggaggccgaggctggtggatcacttgaggtcaggagttcaagactagcctggccaacatggtgaagccctgtccttgtctctactaaaaataaaaaaattagctgggcatggtgtcatccccctgtaattccagctactcggaggctgaggcaggagaatcacttaacccgggaggtgtaggttgcagtgagccgagatggtgccactgcacccagcctgggcaacagaacaagactctgtctcaaaaaaaaaaaaaaaaaaagtcttccagaactttaggtttaatgttacagacaagatatgaccagaataaagctggcagaaaccttccattaggtttgtggttgcccagtcatgtttgaactgacttgttttttttgttttgttttgtttttggttttttttgcttattcgtttttgttttgaacagggagtccgggcacatggaataaactagaaagagaaaaacctttggagaactaattatatttataaaacagatcttgccagtgagaaatattttcttaaggagtttaatgccagtcttgaattttgtagaaaatatttcagcgtacttggtatagttatttattagtgtcacatcgaccaccttggtctagtgatggttgatacagtaaatataagtgtatactagcttctctgcaaagactctaccttggaaagattacttcaataatttatttgacaaaatgaagtaatcctctccctgttaaaaacttcttcctggttt

SEQ ID NO: 19032 - DNA, 1058 bp, Homo sapiens
tacgaggttttcttggcatgatgtgttggtatgatgaaagtgcatagaccagaatttgtgaaatcaggtcacagatctttagtgctgggttttttctttcaatgcattttgttgttaaaaaggacaaggagatttgtatgataaattaacagactttctgagatggtggcattttggaaattgctgtggccggggatttgaatggctatatctttgtgattaaaaaaaatcaaattgattaaaatgaggtcttctcttagctagtttagatttattgatcagttcactttcaaggacttgagttaaccaacttagaaaagtgggacagtgaatacttgagtgtgtatctatggtgttaccatcacttttagaagttactgaagagcagaatgtagtgtggtggcaaatgtaatggtctggtaattttatctgggagttgttggctcaaattatggtggagaggattttaattagttgttaggaggactttagactggtagatcttgagactcaaagtagattacacaaattggttgtgtagtgtttcattctgaaaatttaaataaagatacagatttctgtaatcttggatggttagttgcgattatatccagaatttgttccccaaagtttatgccaaacagtttttttttcgttattggcatctttccaacataatttactaacatttaatattttaaactgaaatacgtataatagatgtgaaactgataacttttcaggataagtattccacaaagtacaaattcagaaacaatgttaatgcattttacatctgttaaatattaatctattccctctaagcttcgggaagttcttacgaaattgctgtagagaaatattctttcttaatatctgtaattaaaaagcatgattaggttaaattggagttatgaaggaattatctagctatgtcagtaatgacataaaataacaaataggattttcagtgagtatggtgttttgaaaacagatcttacataactagggtaacaaagtttagtaatttacagagttttaggtgactgcttaaattg

SEQ ID NO: 19033 - DNA, 1044 bp, Homo sapiens
agatggcatcgagctacctacactggtctctaactctggcctcaagcgatcctcctgcttcaacctcctaaagcactgggattacaggcatgagcaactgggccagccaaggaccctttttaaagagcagggagagaaagagagacagagacgggggtggggggtgagaggcgtggagtggagagagagtgtggaaaggcagggccagggctcctgtgcattggaacacctgatttccatggccgaggagaaatcattgcccacagcctttgtcatgttcagaattgccaagcccgagagctggggggaccctgcctcccctaaggctttgacctcctgccaaggggaacctccagagagcaaatctatagaaaaccaactgggcacagctttccaagaaaaatagagcttttttcttttctttaaaaattgtatgaaattgtcagaatcatatgcccaggtggtggagagaagtagcaaaaagaaggcagtttcatgtttgaagttggagtgctggaggaatcgcggccagctggcctgtgctcgggatgtctctgcagccctctgctccgctccctctatgggagtgtgctcctcgcctgcccgtcctgcacttggtaattgcaaccatctgttcagagtggaaactcacacttccaggcccaggcaccgctgctctctggagggtcgttatagggcagtgagggcggatgtccctccccgtgtcacccacagccatctcctctcagtcaagcacagcccagttctggttccagctctgctgtggactcccttgggcttgccccttcccttctctgggtgtcagggtccaagtgcgcgaacatacgtgagagtccccacccggctgctggatggggcggctgtgaacccatggaggactaggagagcactgtgagatttgggagaggcggtgcttcagcatcagctccaggccccctcttccaggaagtctcccgtggagccccacctgagtacatcagcctctggcagcttgtactgtccctccgtgcagctgtcattttt

SEQ ID NO: 19034 - DNA, 1056 bp, Homo sapiens
tgggaggctgaggcaggagaatcacttgaacctgggaggcggaggttgcagtgagccgagatcgtgccactacactccagcctgggttacagagcaagactctgtctcaaaaacaaacaaaaaaacaaagctagttttccaagctggtggtcacttactggcgaatactacttaggttcatcatgtatgtgtgagagctctccctctgaatcacgagtgcctgatggggtcattttgtatgtgtgagtgtctttttacattcactttctaaagtcatttgctttgaacatgttatgcttatattaatttccttactgcttaggaatcactgcctgggggaactgaccattactttctaccttcactgaatggaaaagccagtattcaatatttatctgaaaatgatttggtagtttaggttttctttgttgtagttggggtttgttttgtttttaggacaccttgttagtggttgtttctgttttcataattcttaggtaacagacattaactaaagattcctgtgaacctaacagggagatcatatgaccccatgactgatgtttactctttttaaaaactaaaccaggctgcacttctgtgcattcccagctggtatttgcatgggggtgtgatggggggtctaagctgagaggaagacacacagctctctcagcatttttaggcagtcacactttccagctgatcttttccatttgcaacaggaaccactgggagctgtaggtttggattcagtggtaggtggtgatgggtttctttttttacatggtggtctcttctacctaggagaccactacaatttcaactccctggtcttgtgaatcatttctcttttgagcctttgggttttatgacacagacgaggacttaattcccaaatgccatgcttttctacccacatgaagagaatggcagccattttccacacctgctgtgctcatcagtccatctcattttgcttccccacatctgaacttggaaatcccctgctgggcttcaggcccgaggcctgtgtcagagcatcaatcaggtccg

SEQ ID NO: 19035 - DNA, 1066 bp, Homo sapiens
gaggaaattgaaaaagaaaataaaagattccaagaagacagagaattttcagctggtacagtgtatccagagaccaacaaaaccaaaaataaaggtgtttatagcagcacaaatgagcttacaactgattccactccaaagaaaacacaggctcacacacagcaaaatatggtagaaaaattttctcagttaccattcaaagtggaagctaaaccatgtacctcaaattgtagaattaatactttcagaacagtgccaatagaacagaaacatgaagtctggggttcaaaccagaactacatttgtaacacagaccctgaaactgatggcctttcaccttctgttgcctctccaagtcccaaagaagtcaattttgtttcaaggggagcttcaagtcaccagcccagagttccactttttcctgaaaatggtttacaccagcagccagaacccttgcttccaaataatatgaaatctgcctgtgaaaaacgtttaggatgttgtagttctcctcattctaagccaaattgctcaaccctttctccaccaatgccactgccccagctgttaccttcggttactgatgcaaggtcggcaggaccttctgatcatattgattcctcagttactggggttcaaaggtttcgagatactctaaaaataccctacaagctggaattaaaaaatgaaccagggagaacggatttgaaacacattgttatagatgggagcaatgttgcaattacgtaagtccattctctgcagattattttattttaaatagggctctaaatggtgtctcagaatcacatgtatatgggaactatacatacatgttgtatatagttgatctgtagccttagggtcggatggtggaggggaatgggaaccaactggttggaaaggttttgtcagtccatcttctggattcatgaactttacttcaccctgctgaacttaatttctaagggcaagagaggatagaaaattatcttttcacgttgcattgctcagtgatatgtagtatagtgacttttaagtcattaaattcttaatattgtgagta

SEQ ID NO: 19036 - DNA, 1033 bp, Homo sapiens
tttctggcctctaccctctagttgccaagagcatcctcttggttgtgacaaccagcaatgtctcttggcattgtcaaatgtctcttggcattgtcaaatgccccaaggaagggcaaaatctcacctagctgagaaccatagttaaatgaccaaggccagtccccactcttaatataatacatttacaatctaatagagctgtgataaatgctatagtttaaataataagatactgttacgtatagaaagcagagattaatacactttggatttcttagaaggtacttttggattagagtggaaggaagaaaagtttaaactaggttatagaaataagcacattaaagtctagactgcagggactttgaatattgttctcagaatcttgaacattaatcctacacgatgaagagctttagaaagtttttgagcaaggaagtgaaattggtacgttttcagaactttggtactgtaacagaggagtggagtgtggtaaaactgacagtaggaagaagagtttagaattagttgccatgttcacaagactcagtgcccacatcactgaaaggcaacttgggccaaggatggagtggaagagagctgtgagctctgattcagaactgttaagtttgaggcacgtgtgggataaccaggcggaagtgctcagggagtagtcttgcagcctaaaaaaatgttaatagttgcttcttctttgagaaaacatcaaatggcggatgacgccagtgtagctagggctggtgagggggcaaggggtgcaggagtgcgacccagagcccctgggggtcctgggatgaggaactgcagaggcttccgcattggcatctggggctagggcctcagccaaggacaagaaatatatgcccattaccaagctgggccacctggtcaagaacatgaagatcaagtccctggaggaaatccatctcttctccctgcccatcaaggagtctaagatcattgacttttaactgggggctctctcaaggatgaggttttgaagattatgccaatg

SEQ ID NO: 19037 - DNA, 1048 bp, Homo sapiens
acttcttattactgatttagtctcactcattattagtctcttcaggttttctattcctaattcaatcttggtaggttgtatgtgtcaaggaatttatccatttcttctgagttatccaatttgttcgtgtataattgttcataatagttttttgtgatcttctgtaaatctgcagtatcagttgtcatatctactttttcatttctgattttgtctcctcttttttcttagtctagctaaagggttatgaatttttaaaaccttttcataaacaactcattttattaatattttctatttttatagtctctgtttcatttatttctgctctaatctttcatttatttctaatctaatcttaatttccatctggattttgccatgttgcccaggctggtcttgaactgaaagtggtgtgttgatgttccttacagttattgtattatagtctatcccttcaaatctattaatatttgccttatgtatttgagtgtgtacatatatatatatatgtatgtatagttgttatactgtcatgctgaattgacccctttaatattttataatgactttgtttcttctaatagtttttgacttacagtttattttatctgatataagtatagctacgcctgctttcttttggttttccattcacatgaaatacctttttccatcccttcaccttcagtctgtgtgaccctactggtgaagtgagtctcttgcaggcagcatatacttggatctttttttttttttgtcatttttctttttctatttatattcaaggttattattggaatacagttgcttggttagatacagattggctaatatcttacagagcaacaacattgtaaccttttgggttatttttctagcagactgagatagttggcatctctactggacagaaatctacatttgaatgcatagcttcacagtctagaccctaaccaataatgaataatgtgttaggcaaaggtgtatttcctagagaattaaataatctttgagtaggcctaagagagtactcccttatatttga

SEQ ID NO: 19038 - DNA, 1034 bp, Homo sapiens
tcagcgtatgtaaggtcgggagccagctgccacccctctggacagacgcccccagtgtgccctgggaggaagatgttcatctcatgcactgagtacaaacacatggatgcccatggtcttctggtttctggccctgttggttcaggagttgacccccagtacaacttactgaggcagcctactgcagcagggaagattcacagggtctcagactctccaccctaggcttggaatagttttcctctcatgccatctggtctgtttctgccagctccatgccaggctttttgctgtttgctggggaccctgagctaaggcaaacacagctcctatcctagaggaatatccaatctgatgggagaggtagacacatagatgtgcaaattcctaagtagtatgaatgggttaggaagtgattgcctgtcctggttatgtgtgcgtgggaatagatatgtgaagatagggggtggtcagtggaagtttgaaagaggagaggcatttgagttgggtctctaaagtgatgaataagagttcaccagaagaaacagtgaaagataattcttaggtgataagtacagcaaaagttagaggcattgcaaagagcatgatgctctttgaaattctttttgctagagtcaccggtgactcctgattgtagaagttgatgacttttatagtctttccaggccattagaccctgttgactactccttagacactcttgtcctcaggcatgtctgaaaaccctcatcaatggtgtccagccctaacttccttctctctcctgttccaccccaacagccagctgcctgaaactgtcttcaccctctcccacaccagtgtcaaagccccttgtctcagtgcttctgactcagcagcagctcctagatcagctccttccacctgtccccacaacccctacccacatgtttgttggacccccgatgttcatagcctcactcttcccacctgccaagccccagctctgatccaggtctgtggcacctcaggttattttgccaaagaggcttcat

SEQ ID NO: 19039 - DNA, 1096 bp, Homo sapiens
ctggcgcggtggctcacgcctgtaatcctggcactttgggaggccgaggtgggtggatcacctgaggtcgggagttggataccagcttggccaacatggcgaaactccgcttctactaaaaatacaaaaattgctgggtacagtggctaacgcctgtaatcccagcactttgggaggccgaggtgggcggatcacctgaggttgggagttcgagaccagcctgacccacatggagaaaccccatctctactaaaaatacaaaattagccgggcttggtggcgcatgcctataatcccagctacttgggaaggctgaggcaggagaatcacttgaacctgggaggtggaggttgcggtgagccgagattgtgccattgcactccagcctgggcaacaagagcaaaactctgtctcaaaataaaataaaataaaaatacaaaaattaagccaggtatggtggtgcatacctataatgccagctacttgggaggttgaggcacaagaatcacttgaacccgtgaggcagaggcttcagtgagcccagatcgcgccaccgcactccagcttgggcaagagtgagactatgtctcagaaacaaaaacaaaaaccaaaacctgtaaggttgctgagggatccttcgcctgagctgctcggtgcagaactggggaatggaagcccagggaggggaagggactggctgtgggtctcagggtaagtggaatatggatgtgggagccagaggctgcctctgaggaccacactctcacgtcttcactaggtggacaagtatttgtaaggcttggtcatattttgcctggtttcccttagttgcagagagacatttcttcacatgaaaccagaccctattttgtgtgttggaaatgctcacaagtatttcccaaggctctccctaccctacctcaagatgctgttaggagtaatcctccaccctcagtgtggctggcggtgcctgccctggccagagggcatcagagcccttcctggatggaggagggcagggcctcccttcctttcccttggaggccagtggagttctatgtgtggtgtgtctgttgcaggagaggaaggcataggg

SEQ ID NO: 19040 - DNA, 1077 bp, Homo sapiens
aactttcatgagtatgtgctgctcctgaggctgctgtggtcccgccagggttgtctgttagggtctgtagcacctatctgtaagttgaccctgggctggctagatgtcaccctgcagccattcgctggctcttgggttgcattgcacctaggcaaggggatagcaagctttccttttttttttttctgaggtggcgtctcgccctgtcacccaggctggagtgcagtggctcgatcttggctcaccgcaacctccgcctcccgggttcaagcgattctcctgccccagcctcccgagtagctggaattacaggtgtgcaccaacacacccagctgattttttgtatttttagtagagatggggtttcaccgtgttggccaagatggtctcgaactcctggcctcgtgatctgcccgtcttggcctcccaaggtgctgggattacaggcgtgagccacagccaccatgcccagccagcaagctttccttttattatttttttaaaaatatggttttattgcaaaatgaaacacagatctagaaacccacaaagtcaatgtagaacttagtgaatttttataaggtgaacgccattgaaaccacttcccaggtctagaaatagaactttgcaagctacttcggaaggcttatccttgttccccatccctgtttctccttccagaaagaatcactagcttgacttttatggtgatcacacccttgctttgttttaaagttctgtcactcacgtgtgtaccccttgccactataatttagacttggagtgccattctttaaggaacatgagggagtaatttttttttgtagtgatgattattttactttttttggagaccactctgtcgcccaggctgggagtgcagtggtgccatcatagctcactgcagcttcaaactcctagactcaagcgatcctctcatctcagcctccctagtagctgggactgcaggtgcatgccaccatgcctggatattttttaaaatttttgtagagatggggtcttactatgtggttcaggttggtcttgaagtcctggcttcaagcgattctccctact

SEQ ID NO: 19041 - DNA, 1030 bp, Homo sapiens
ttgaggtttctttaactctttatttctgggtggtgtcattaagcataacgctttgttctcttctccccctgcctcagtcttcatgagctgtactttgaccatgtcactgctctggctctggccaggtgttccccctcacaccctgaggttgtgaaattcccctggggagagggttgcatctctgatagttggagctcctcttggcagggagcggtgcagagaaacctgcagggtcttctggaaagaggaagagcaagcagtcaggtcagaaattcaattttggtggaactggctggctgacacaggattgtatcacctgggatgcttcgagctgcaagatgtgcaatccaagttcggaaaagctcaagcatgaggggctgtgagatctcctaggatgagaagtgtggaggagtgtggctgcagagaacttagctgagcagctcagtactgtcagcagagatcgagctgccttctgtctttatgctctgtcctgctcaactcattggctggtgccctcggatttgtctcctcatgatgaagaaatggctgctgtggtgccagacatcaccccccgacacatcagtgtccaaagaccaggagagagaagctccctgacacaggcctgtctttaggggaaagatacctctcctaaatgtccccatgttccctcccttgtatctcactgtgttgacaacggcatcccttgaacatcctgcaccaatctcaggccaacatacggagctccctttggagttagtgaatctggggatgttcaagcaaaatttgaattaggccagcaagaaagaaggagggggaaaggctgctggggagcacccagcactgtctgggggagcttgtgtgagcggctgtctcttcccatgcaaggttccggagcatctccctcatgtcatgggagctctccctcacatctcatcagtcccccggcctcaactcatgtcctaggactgtgccgttctttcctctgcatggctttccccgtgactgagactcttcctctgtactagcctgc

SEQ ID NO: 19042 - DNA, 1051 bp, Homo sapiens
gcaggcttcctggaacctggggaccctggaggtttctggaccatatcgagttgcttgggtggttgcgtcccttttttttgggccatgccgggtgggggagctgggagagaagctgatgattgggtcaggcccagccaggggtggaggctgcccactggcccgcatctccccggagcagactgtgggcccccagccctgtctctgaggggtctgtggcctggcttcccttcctggctagggggcgtcgctgtttgccatttcctgccttcctcccttttattttgcaccaggtcccccaggaacgcctctgcggggatgtggggcccatgctcacccttcttcccggtgatgaggcctgacttggcctggcaccgccacagtcctgctgagtctgggcccaggatggggttgtctgtattcttctctccaccctcctcagaccccacctcccggctggacagctgggctcaaggccagggctgagccagggggccagcactgattgaaagtgctcctcacagaccccttggctgggggcccatggggtgtgggggctctggaagaggctgagggcctcagagaagagggagccccccaaggccagggggtgggagaaagtgaaggactgactttctggggcaagagccaaggctcagccaccctggtgttaatccggaggtgattctgagactccccccaaggcctcagcagcccctctgccgctcagccctggccccccaaggcgcactgcacacatggttttgcttttccaggcatcttcccctggtcccctccccctgggtgccttctcaagctccttggcccctcccccagccctcctgggccccctccttcctccttgacccactttagtcccctgttgctgggggaggggagcgcacagccggcggctctgatcctggcgctctcccccagcatcccctggggcgggctctggatggagcctgcaggctgagccggcccggccccagggactggcacacagcgtgctccgagtggcagccaccctgccccctccgtggacagacag

SEQ ID NO: 19043 - DNA, 1047 bp, Homo sapiens
ttttccccaaatatttttaattggcagttggttgaatctgcagatgtggaacccatggataagaagggtcaactgtaaaaggaacatttatctgtttttaatgtataaactactcttagttttctttttatcttgtctaaagaattaataaagatttcctgtgtgcagaagagccacaatgatcacctgataatgcgcgtagtcttcagccttggatgtggtgaagaagggctctcagcagttatgcttctggatggcagcttgactttcatgtcccctttttaattaaaaggtaaaaacaatgttgaattaagtgatgtctttttctttcagacactgaagaacctaaaaagacggatgttgctgagtgtggacctggtggaagttgaggctgcctggtatttgattatatattatgtacatactttttcattcttaacttagaaatgcttttcagaagatattaaatatttgtaaattgtgtttttaattaaactttggaacagcgaatttggatgttccagaggttggacttgtattaggtaataaagctggacctgggactcgtgaggaaggaatgtgcttggggctgttgccatacctgtgcagcattctttcaaaatagtgccttccaatgcttcttccttatgtcccacagacaggatcatcactaagaagcgttcttaaaacggccccatccagtgagattttccgttatacgaacatacttgaaataattttagaatttactactgtggttctgcccctgcatacccagtgggaatgatgcccttgtatgggtaattaggcacctcccacccacccctgacaaaagcacactgggagttttatagcactgtcacatggctagtgttcttttttggttttttccgttttttaaagaaagaggagttacttagtactatagcaaagtaataagccaaataagataaactaagtcatccttgaatagatcagggaattaccagattaccaaaaggtgacatttctactttacttactgtttatctgaaatacaaaggtcaa

SEQ ID NO: 19044 - DNA, 1027 bp, Homo sapiens
aacgatgactgctgtaaaatatccgcacttggactgctttcatcacatgacctaaaaaatgaaattttacatcaatttaaaaaatacatatttttttaccatatcctcatcaattaatctgaatgaattaatagtctaacgaaaattgaatatttttcatttggtgaatatggcaatgtgtttcaaaatgtcaagtgtctttgtccttcaatatagcagttcctcttctcagaatttattctagaaaaaatacaaaagttacatataaggttacattgtttataatttttagaaattgggaattggttaaataactcacaacctttcaaagaaagatgacatcattgattgatgtccatgatatatttgtctcttgttcctgggtgcattagctctgaagagcaagattgggaagctttcacattctctgtagcatttgattattttacagtaatcctctgctatctgagaatattgctgtgttcatgcacagtaatccctagaactccttcctgtcttctcgtcagggatttttctgataaaaacagataccatttatttacatatttataagttatttaccaaataccttcttaaacatgtatatagcttttgatcaggcatggaaataacatcaccagtaataagtaccccagctcacagaatcctctcaaaatgctaataattatatttagtcattttggcctgaaaaattatattccagtagtccatatttgtattcattttctcttgccaagaaactcctgacagttttctcttttccttgatattcgccttcatgtgttttcctaaaaagctgtttttcttcatccttatagtcattgcctgaagatgaaggccatactaggacacttgacacagcaaaagaaatggaggtgattttattttacactttacaagaaatatttaaatggaaaataaggggagtaagagaagtcttgagaatgggaaggcccattgggtaagaaggaaaaaggttagtgagtagagttgtgagggcctagct

SEQ ID NO: 19045 - DNA, 1121 bp, Homo sapiens
ccaaaccatatcacatgtactctaaagtaaagaataaattggcttgtccagaaatactaaagagaagtttaattacattttctaatttgatgaaagttaattgctctctgagttcattttggctatatttgttgagcatattttcttcagctttaagaagagtatagaaaatttacaaggacctgaaaacttataatatatatacctattatagatgaggtttttcccatttgagggagtgtcctggtgtgtgttgattccagggaaaggaaccatgtatattaaaatttactatgtattcaaccgccacaaacttaattggtttagataatatctgttttacctctactttgttttacataaccacagtagtgctcacctgacctataagggttagaccctaattggttaccctaattagttattttcctaaaaataaaataagatagtgtctttatggccaggtgtggtggcttacacctgtaatcccagcacttccggaggccgaggcaggtggatcacaaggtcaggagatcaagaccatcctgggtaacacagtgaaaccccgtctctactgaaaatacaaaaaaattggctgagtgtggtggcggatgcctgtagtcccagctactcgggaggctgaggccggagaatggcgtgaacccaggaggcagagcttgcgacagagtgagactccatctcaaaaaaaaaaaaaaaaaaaaagacagtgtctttacttagtcccttttttcatccacatattgataagcagagatttatgaagaatatcagtgtttagtgctctttactgttgagtttataggtaatattccactttctccaaagaatctgaattacattctctcttatttcgagaaatagaaacttttcccaactttttatctggtgaaaattaggctaaaaccgtttatttcagcatatttctgaccttaccattgcttaatgggaaagaatttcacagttttttgttttttgttttttttctgcatgattttcctctgatctttctcttacagtaagaagagtagaagtgtgtccccagagtgtttttaagcaggttagggtttatcataattgaaaggaattggtatcttagctct

SEQ ID NO: 19046 - DNA, 1798 bp, Homo sapiens
caagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtgtctgtgtttttagagtgcatttccatttagccaggccccaaatgcgttttaacatttccccaggcagcagtcaattgtgtatgtgagtgtgtatccctctttaaatgaggaattgtaaaaggcataacaaacggctttgcatgggcctgcgttttcttttattttgaaatttggaggccctagatattttcccagtatctatgatttatttaggaatggattttatagactccactcgctacccaccccacccccaagaaaagcaaaacaacgaaatgacataaaaagatgttgttggaggttttaacccaacaggtaagtttcttttaagcaagatatttatgccgatttag

SEQ ID NO: 19047 - DNA, 1066 bp, Homo sapiens
gtttaatacagtcagccctgtagcatataatagactgatatatgagtcactccttggcaatgtgtttcttaaatttatatagattgaacaactggttggtaatgtacttagttacagttgtacaaacaataactattagcagggctgaaacaggcctagaaaggctgcactgggctggtgtttgtgaggatcccgaagtattgctgattttcagaataattcccctttgaggctaagggagactctatttcataaacatgagtgtgcttttttagcaaagtagcaataaaagttttatgttacagttttctgtttctcattttctatttgcttaaaattgaattggggaacctaatttccttcaaaaattaaacttaacatccgtctacattaggggcaagataatttgattgcaggggttttgtttttgtttttaaacacttgctttttttttttaacaaataaataacataggtataaatatgtattttctgtttttttttccccaggttagactgccgtgggcactaactgttcatgggttgaaagaaatctttctgagcaacaaagatcttttcttaagggaaaagcttgtgctccaagttcagttcatgtttatttaaaagattaaaatcattagaccagatctcacttttttgtccaaaagaaaattgattttgcttcccataaaagtgggatctgaaagaggatattcaggaatacgcaaatagaggcaatgtcgaaatctgtttgtgcagctgaacaaagcaattctgtttttaccgctgaacatttacttagccttggtgtgaaaatttctgaacagaattgtcacctgtctttagaaagtacttcttttgtaaggcaaagaggatcattttgatctgaaatgttttaatgctttttctttttaaacttctgccaactggagcatttataaaataacgtaccctgtaaatattgaacaatacaaagacatctttcataacagtttatagtatgttgcgtgtgctcagtggaagccaggcagcagttagtggcaaatgatatgccaatcaaaaattat

SEQ ID NO: 19048 - DNA, 1059 bp, Homo sapiens
taaggccatagtcaccaaaacagcatggtacttgtataaaaataggcacatagaccagtggaacagaatagagaacccagaaatgaagccaaatacttacagccaactgatcttcgacaatgcaaacaaaaacaaagtggggaaaggacactattcaacaaatggtgctgggataattggcaaaacacatgtagaagaattaaactggatcgtcatctctcaccttatacaaataattaactcaagatggatcaaagactttaagacctgaaacaataaagattctagaatataacattgggaaaaacccttctagctgttggcttaagcaaagacttcatgaccaagaacccaaaagcaaacacaacaaaacaaagataaataggtgagacttaaactaaagagcttttgcatggcgaaaggaacagtcagcagagtaaacagacaacccctagagtgggagaaaatcttcgcaatctatacatctaacaaaggactaatatccagaatctacaaggaactcaaatcagcaagaaaaacacaatcccatcaaaaagtgggctaacgacatgaatagacaattctcaaaagaaaatgtacaaatggccaacaaacctatgaaaaaatctcaacatcactaataatcagggaaatgcaaatcaaaaccacaatgcagtgccaccctactcctacaaaaatggccatgatcaaaaaataatagctgttgctatggatgtggtggaaaaaggaccacttttaaactgcagatgggaatgtaaactaatacaaccactatggaaaacagtatggagaatccttaaagaactaaaaatagaactaccatttgatccaccagttgcactactgggtatccacccagagaaaaagaacccattataggaaaaagatacttgtacacacacaattcacaagatagcagcacaattcacaattgtgaaaatatggaaccagcccgaatgccgatcaattaaggagtggataaagaaattgtggggtgtgtgtgtgtgtatgtgtgtgtgcctgtattgtatgtgtaca

SEQ ID NO: 19049 - DNA, 1050 bp, Homo sapiens
attctgtctataccactgggcctccctgtcctggggcctgccatctccgagaagaatcttgctctcatccaactctgcaaatcttcataacaactcgttcctctggaaccttctggagaccacaaacatctgcagactaaacctctccagtcctagtaaacaaccacatgtttgttgtcacttcggctggctctgagctcatttttttggcccctttttctagctttctttggctttatgcagttacagtgtcattaaggcccataatattccctgcagtaatttaaaacagccagattataccctgggattaactgagtggtttttgagacatttattgtggtattctcccaggaggtttgtattattgttgtaaaatgttacatcccaaactaaataacccttctgcagggagaagaaccagattgcactgacttcttaggatcattaagtggaaaggaaaagtttttcttagaaaacttatgggacccagtcacctgtatggaatgtatatctcagacaagatgagagaaacagccatgtttctgtcacattgtttactgtcatattaaagatatctagttttaaaatattcagtttcaaactattgcgaattttcacaacactcattttcatagctaattgctgctgacacattttgaagtggcgaggtagtattgaacgctgtcatgtggatacttcagttgggtttcataatctgtttgagaattttgtttgttttatcttgtggtaactggaggccattgaaaagcttaccaccttttgggttaaagagcagtggatttctcttggtgagccaaactggatccattgaagagggcttggcgtcaggggccaccagcagtggccttgccacacagataccagcttaaggtgttgctggtgtgaacatacacttcttggtgtaactagaccagtgcacgcagcacttttttgggctgtaatgcttttagtttggaaatacaaatagagatgtgatgtggtatgtgggagagtgtattttacatgtatttttgcctactgtagtag

SEQ ID NO: 19050 - DNA, 1032 bp, Homo sapiens
aattgatagtggaaagtaatagtggatctttttgttcaattattttatttctttgttgttttttgtttttgctctttaaacagccatcagaaaaaattcggattgagatcatagctctaagccttaatgattctcaagtaaccatggatgacactatccaacggctgtttgttgagtgtcgattctacagtcttcctgctgaagagacacccgtgtcacttccaaaacccaagagtgggcagtgggtctactataactatagcaatggtatgtatgattcatttgtaatatagacttttatgtttgtcttttttatttatgaaagaagtggaaagaacagagagaaagtttatttctctaatattcacataaattcatggaagtcttgtcagaattgattaataaaagtcaaaccagtagcataaagattaagaaaataaagttgggccaggcacagtggctcacacctgtaatcctagcactttgggagaccgagacgggtggatcgcttgagctctggagttccagaccagcctgggctacacggcaaaacctcgtctctacaaaaaaaaatacaaaaattagccgggcatggtgttgcgctcctgtagtcccagctactcaggaggctgaggcaggaggattgcttgagcctgggagggtgagcctgcagtgagctctgatcttgccaccgcactcttgcttgagtggcaaagtgagaccctgtctcaaaaaagaagagaaagttgaagtaataccacagttaagagaaaacaaaacaatgtgaaaaaatatttctaagatggtcctgctatgtcatagttcaacagaaaaatgtcagctaggtctataattaggaatttaatttaaatatatgatatttcaaagaaatatctttcaaagaagtcattttttaatcatatgattcgaagctttcaatgttctatttattgtctacctttctgatcaatgtcatcacatggatgtttttacaatacgtgtatatatctctctcagtgtctagatgttcaa

SEQ ID NO: 19051 - DNA, 1057 bp, Homo sapiens
ctggcggggaaaggagaggacgccgagcaccacgcacggccttttgccccggggtaggggggaaccctgctgggacgcattttgtaaaaggggacgaaagtcactttttcagtcgcccctgtcggccctgcgacagctctccaggtccagcccaggcaccccaggcgcggccggagggtacagcgcttgtaccttctaggggaagccttgcgtggctgggcccacaggcccctggggcgggtggcggttctctgacgcccacctctttccagccccagacctcgggtcctgacgcctcgtgcccaccctacagttaaaccccaacacacacatctacaactggacataattttacattgcgacaccttcctgacgatcggccccaatccaagtaggatctccccgccctaggcagcctctgcgctcctgaatctcacctcttttgctactactgtctctctcttccaggccccagaaccatctggacgccgccctggtcttatcggctctctcctcatcctagttctttaaaaaaaacaaaaaaacaaaaaaaactttttttaatcgttgtaataattgtataaaaaaaatcgctctgtatagttacaacttgtaagcatgtccgtgtataaatacctaaaagcaaaactaaacaaagaaagtaagaaaaagaaataaaaccagtcctcctcagccctccccaagtcgcttctgtggcaccccgcattcgctgtgaggtttgtttgtccggttgattttggggggtggagtttcagtgagaataaacgtgtctgcctttgtgtgtgtgtatatatacagagaaatgtacatatgtgtgaaccaaattgtacgagaaagtatctatttttggctaaataaatgagctgctgccactttgactataacccgcctgtctgccccctcgacggatctgtttggtggttttttgttttttgggttttttctcccctcggttgtttgaagaattcgcgggaaaggacgagagacgaatcgggaccgagtagtcaaaggacagcaatagctgaggaggcgcaga

SEQ ID NO: 19052 - DNA, 1032 bp, Homo sapiens
cactcgcgctccctccgcgcgtgtcccttccttctccatgtgcgtacagggcgcgcagtatgagctgaaggacagccccggggtgcagcatccggccgcggctgccgcgtttccgcacccgcaccccgccttctacccgtatggccagtaccagttcggggacccgtcccgtcccaagaacgccaccagggagagcaccagcacgctgaaggcctggctcaacgagcaccgcaagaacccctaccccaccaagggcgagaagatcatgctggccatcatcaccaagatgaccctcacccaggtgtccacctggttcgccaacgcgcgccggcgcctcaagaaggagaataagatgacttgggcgcctcgcagccgcactgacgaggagggaaacgcttatgggagcgagcgcgaggaggaagacgaagaggaggacgaggaggacggcaaacgcgagctagagctggaggaggaggagctcgggggggaggaggaggacacggggggcgagggcctggctgacgacgacgaggacgaggagatcgatttggagaacttagacggcgcggccaccgagcctgagctgtccctggctggggcggcgcgcagggatggcgacctaggcctgggacccatttcggactccaaaaatagcgactcggaagatagctctgagggcttagaggaccggccactaccggtcctgagtctggctccagcgccaccaccagtggccgtggcctcgccgtctctgccgtcgccccccgtgagcctggacccctgcgctcccgcaccagcccccgcctccgccctgcagaagcccaagatctggtccctcgcggagactgccacaagcccggacaacccgcgccgctcgcctcccggcgcgggggggtctccaccgggggcagcggtcgcgccttccgccctgcagctctctccggccgccgccgccgccgccgctcacagactggtctcagcgccgctgggcaagttcccggcttggaccaaccggccgtttccaggcccacc

SEQ ID NO: 19053 - DNA, 1039 bp, Homo sapiens
ataaaactgaataatttatttttacttactatttatcatggaattactttgaataatttatttttaatggtataattggacagtaaaatttataaactcagtgcttttcataaaaatcaaagtgaagtttgtaatattttatacaaatagaattattatttaagagaaataacctgtttatgcctaattacagtttttaatcatttcagttacctatttcttttaagaataaatttagtgggaatatcagttccagtcatgggtaccaaacttttttagtgacagagtacacacaggtatgtaaaacttgtcatttctcatcaaatagaggctgctgaatataggcaggtaagaaaagctatgagaaagaattgttttgcagaatatttgtctagttgtcagagcaaggaactgaatttattgacacagaacattttattaagtaaaaaaaatggttcttataacaaaaaaaaaagctaattttacagaaggcagtagttaatatagccgccaataaaataaatgtttctctgaatactttccgaggcattacagtgatttttaactaatatgaagtgatatataataattttaaagtaacatccttgagttttcctattattaattgcttatggaaattgggtttcacgtatgactgagagctaaagcattacagtgagttagaaaacacaacacaaatgtaaagaaaatgttaggtggtgagtaatctgattcctttttgtttgcctttaagcttagttttttgttttgttttactttgttttaaaccatgtataaaattgttgaatttaaaagataagaggattaagtaatttcttttttcctcctaaggataaatgtaggaaaaatctaaacacataggcagattggttgagttttatatctgttatcggccacatttattaagattcatatttcatgtatattagaggtattcacatgtattaaaattcttatattccttctatataaaatagatgtagggggttcccactcttgaaaatatgaagaaaagatg

SEQ ID NO: 19054 - DNA, 1074 bp, Homo sapiens
agagtgtgggggaggcgcacagtgtgagcccgcccccacgtcgtggggtaacatctgttatcaaactgctgtcgttgttgtggaagcatgtagactgtgccagaggccagacccacgggctcatgcacccctgagccagcagggcatcttggaaaaggaactcttggttcgatacctggagcagaggaggggaaagtccagggctatagggtgtgatgaagtcacccctttctgtcccactacatctgggactgactttccgagcctccagtccaaagccggcttgatttccgtgaactctggtgctcctgcatctcatgagtgtgccccatgggtcccctcccctctcagcatttccttgtcccgtctggacctggggagtggttaggcagcaagctttggtttatggttttcattcattggtgaagtaaattaggcagtgctaaagcctgtgggtttggtccttgaacaagatgtgggccttgcaagatgggagagtaaaccttgaagggctttattaaagaaataaaaaagaacttttgtatcttttatcctgggagcactgcgttttcctagctgtgttattcctggtttaattcagcagagaaggtaaggtgtgaacctacctgccttggagagggcccaggtcccaaatctcttcaaattcttcacatgtttaactttaaggatttgaaccatgaagtcataggttacagacctcagttttatgccccattggattactttttttttttttttttttttttttttttttactctttgaaagctttgttttgtggtagtccttttgggaagaatccagtattatccacaattattggcaaagtttaaatgtattttacataacggaaagtttttagaatgttgaaaagtaattgaaaaaggtgataggtaaatttttaggcaaagataatttatttcaataaatctttcaaaagccttaccttgaaatgctgttagtaaatttctgtgatttttttttttaatttgttttgctgagagcatagctatttgtttttattgtaaaacaataataataataaaaagcaaact

SEQ ID NO: 19055 - DNA, 1049 bp, Homo sapiens
cagacactcaacgccagtctgtgaaagcagccgggagggaggctgtaccctgcacagccacaggggtggagctgcccaagaccacggaaacccgtctcttgcatcagcgtgacccagatgcgagacatggattcagcggagatcattttggagctttaagatttgactgccctaccttattttggacttgcatgtggcctgtagcccctttgttttggccaatttctcccatttggaacagctgtatttacccaatgcctatacccctattgtatctaggaagtaactaactagctgttgattttacaggctcatagacgttagggacttgccttatctcagatgagatgttgtactttggacttttgaattaatgctgaaataagactttgggggactgttgggaaggcatgattggttctgaaacataaggacatgagatttgggaggggccggggcggaatgatatggtttgactgtgtccccaccccaatctcatcttgaattcccacgttttgtgggagggacctggtaggaggtagttgaatcatgggggcaggtctttctcctgctgttctcgtgatagtgaataagtctcacgagatatgatggttttaaaaagaggagttcacctgcacaagctctctctctttgcctgccaccatccatgtaagatgtgacttgctcctccttgccttctgccatggtcgtgaggcctcctcagccatgtggaactgtaagttgattaaacctctttcttttgtaaattgccagtctcggatatatctttatcagcaatgagaaaacgacaaatacaaatgctaaacagcatgattgctaggtcaaatggtaaaattgtttagttttgttagaagctgccgaatcatcctccagagtggctgtatcatcttgcgttctcaccagcagtgaatgagagttcctgttactccacatcctctccagcatttggttttgtcagtgttccagattttggctattctaatatatatgtagtggtgtcttgttttaatttgcatttatctaatgac

SEQ ID NO: 19056 - DNA, 1080 bp, Homo sapiens
ccactgtccatctacagaactcttttcatcttgcacaatcgaaactttgtaccaagcctgtccaacctgcaggctgcatgtggcccaggacagctttgaatgcagcccaacacaaatttgtaaactttcttaaaactatgagatttttttgcctttttttttttttttttttttttttagctcatcagctatcgttagtgttagtatttttatgtgtggctcaagacaattcttcttccagtgtggcccagggaagccaaaatattggatacccttgctctatacccattaaacaattaactactaattctcccctccctctagcctttggcaaccattatgctacttgctttctctatgagtttaactacgtaggtacctcatataagtagaattctacaatatttgtcattttgtgactggcttatttcacttagcataatgtcatcatggttcatccacgttgtagcacaagtcagaattttcttcctttttaaggctgagtaatatttcattgtatgcatataccacattttatttatctattaatctgtcgttggacactcacattgcttccacattttagctatcgtgaataatgctactgtgaacatgagtaggcatatatttctttgagaccctgcttctaattcttttgaatactcatgagtcttttttgtttgtttttaagactaattttttagagcagttttaggcttacagcaaaattaagaagaaggtacagagattttctgtatgcctcctgtgcccacacacacacagccttccccattatcaacatccctcagcagagggtatgtttgatagagttgataaacctgtgttggcacatcataatcacccaaagtccataatttacatttgtgttccctctataggattggacaaatatatagtgacacgtatccacatgatacagtcttttcactgccctaaagattctgtatgcactctgcctttcctttcctccccctagcctctagcaaccactgatctttttactatcttcatagctttgcctattccagaatgtcatacaggtggaatcctgcagtatgt

SEQ ID NO: 19057 - DNA, 1029 bp, Homo sapiens
agagacagggtttcaccattttggctaagatggtcttgatctcctgaccttgtgatctgcccgccttagcctcccaaagtgctggattacaggcgtgagccactgctcctggccacacttgattttctgttccatgcatcagtgtttctttgtgaaggaatgaaaagcagccttaaatgtgtagcttgataattgggttgttttacagccaattcttggtgctgttgtatcttaggctcctgttttcttcgggaaataacagaagcagcagacttcttggtgctgttagtctacaagcctttttgtagaatagaacaatttaaaaagaattttgaatcagaaaaccacggcttttaagattaaagaaaaaatacttcctaaaagtaaatgtgaaaatgcctccaagtgagtagtcatttgtgtagcttgtgaaagaggagccaaagctcatgtgttgtagaagctttagagccttgaaaagcttcctcatctcccaggctgagcgtgtgagggcgctgggctgggctgcatccagcccccctggaaagcaggattgctcagcagtgaagggttctagagcttgcctgtctggcttcacatcttggccatcatagttaaactgtgtgatcttggacaagtcccctaacttctaagtgcctcagagaccaaagaccaagggtactagtgctatatctttgagaaggatactataagaatgataataggaggtaccatgtggagtgtagtgaggattaaatgagctagtccacgtgaaacacttggcatgagaagcctgccatacaagaagccctcagtgaacaccagccattacagtggctaccgtgagagcagatgacgggggaaagagtcagggctctgaaacttacactggattcttgtttgtttcagggtctcggattgcgagctggctgccgagtttttcggttgaagtgatgcacaccaccaacattcttggcattacgcaggccagcaactcccagctcaatgcaatggtaaggtctgctagct

SEQ ID NO: 19058 - DNA, 1095 bp, Homo sapiens
gctaacggcctcgctgcagcctgagccgccggcgcccgcccggccgagcgccgggggaccccgggcccgcgatgtggcccagtacctgctctcagacagcctcttcgtgtgggtgagcgaggcggccgggcccgcggggcaggggcggggtccgctgcgtcaccctttatccgcgggggcgtggtgggcctaggggcccctccgccagggacccccgagggcgagcgcctggggggcgcggccttgctcgcgggagcgctgctgagggagagtggtgaggcgcggggagggggagggggccgcgggcgggaggaacatcgcgtggggttgcgaggaggaggccccgaggggcaggccagcgttgagggctccgggaagggggtcggggaggcggcgggtgatggtctgcgctggggcgcggacggggcctggggcaggggaaggggttaaggggcagtggggaggaacgggctgggttttctgagggaccctcgggagaaactagaagatctcagagggcaggttcaaggggaggtcgggatctgggagtgcgttatcccgagggttggacgaagtagagtgaagttgaaagcttttcccacttggtcaggcatgggattgttagcggattttcttccgacgaagaggagagggcagaggggagaattcagacgttgagtatgggggaattttcggcactcaggtgtctttggacattccggttggagagaggccgtctcccacaacttttttgccgcttagtattcgattgtcccctttgggagctgtgtaatgaaacaaacaccaaactgtgcttccttttctgctgcctttacctgatgttcatgacagttttcctttgatgtctgaacgcagcaaaacattcacagtgtcaagaggcagcccatcattttaactgaatgtttcttatttgaggatctattctaacacagtttccaggttgtctgcccctgcgagataagcagcattgataaggcacacatgctggtttcgttcattagaacagataatttcagactgatcagatcaacggtattttggctagagaattttgctttcatcttggccttgaat

SEQ ID NO: 19059 - DNA, 1021 bp, Homo sapiens
atggtttgggaacttttattgtatgtgatccacagatctcttagcttgtgctattcaggccactttctctgtgactgttaatgtatctggttttcatgacagtttaaggaacctccaaagcctgggacaattgcctcaattcattgtaccctagggatggctctgatatataattattctaactggaatactggttaggtgccaatgagtaacacagtgggaaataacataggcttttataattagataagagttgaatagatacagttaaatcttggcttcacaacttggctgagtaatcttgggaaagatacttagcctctcttagcatgtgattctgtgtaaattgaggatgatgctaatacctccttttggcagcttctgcttttatctcactttccccttatatctgttttcagcaattttaaattccccagctctcagatacaactccaacagcaaaagtagatttctgaatgtattgtggagagatttatacaagaattgtataacccttagactttttttttgttctgtgtcagaatttttccttcccgggtagcaacttccctctctaattctcttcatccctttaaattctctaaaatatacatatatattatatatatatttttatatttgtttcctcgagtaatttggctttgcccatctggcaaaacttcacttagactgctcttctggtattcctgaagcatgcaccttggcatacggggaggtttgaggttggggctggaaggaggagcaagaagcatcttgtcaaatgcctcacagcttatatttgaatttttaatgtaaacaggtctacaacaggattctagactgtttaacttactgatcatatatatatatatatatatatatatatatatatatatataatttttttttttttttgggagacagagtctcactctgttgcccaggctggagtgcagtggcatagtctcggctcactgcaagctctgcctcccaggttcacgccattctcctgcctcagcct

SEQ ID NO: 19060 - DNA, 1022 bp, Homo sapiens
tttgatccgtaactatttgactagattataccaaaaagaaaagtctccaatacttagatgacgttcttgaaaaagtttcccattctttaggcctaaagaatgtgatccattcctctctgagcatttctagactccattatcatcagatagctcccagagaggagattgggatggactggtggttagcaattttgtttatgtttgtgctatgttatatattctgtttgtttaaaactagggtttatgtgatgggtacatatggacataaagttggaaaaaataaacactgtatactccaaaggtggggagggtgagggggaggcgagggttgaaatacttcctattggatgttatgttcactgtttcagtgatgggttcactagaagcctaaaccttagcattacacaatatacctatgtaacaaacttgtacatgtacccgttgaatctacaataaaataaaaataaatatatacgaagaggaaaaaaacctagggtttgtatactgttagtctggggaattgacatgaattcaagcatattctcccccttcactttgatacttgttttgattgccttattatgctgaaatatgttcttagtgacttggtagaaataacaattattgtgttatttgttatctccaaattgtattaagttgaaagctgaaattcttaacttttatacagacctggtggtgaacttaacccaggagaagatgaagttgaaggactaaaacgcttaatgacagaggtatttttctgtttaaccactttgaataccatcaacttactagttatttggcttttaatgtcttgtaaaaaggatgcttattttggaatatttagttttcaataaatacaacttaaactccagaaggttagtacaatgttgatttttttttacaagttgaagttacacttatttcaatttttaaaatgttaaactgtgtcacagcaatggtaaattaaaactgacatttaagtattactgtgctagacactgttctgagtgctttacatg

SEQ ID NO: 19061 - DNA, 1049 bp, Homo sapiens
ccgcctgcctcggcctcacaaagtgctggcattacaggcgtgagccactgtgcccggcctcataatcttcattttaagtgatggtcacttattatcacttttgagatgcatttgtttctgatcagtcatttatttatttgttctctctcttggaaatgggagacttagaggataggagagctctctaaagtatctgaatagtttttatgtggaagaggaactcttaacagggttgttgtaaaaggttgcatggtggaagactgggctaactccgtagtttctgaacttcagattcaacatactttatacatttatatataataaagatacaatttttatatagagctaacatttattacgtacttctgtgtgtcaggccctgttgatatatgttaacttcattaggcctcagttatacccaatgggatatagtactgttaatttctccatgttctggttattgaaccccagatgaaaagaccaagcacagaatggttaagaaacttgcaagatgctgtggatagtacgtggcagagctagattctgaacctgagcggtttggccattaagcccatgcccttttgcactgtgctgtgtgtactatatgtactggctcttagcagacccgtttcttcaagtgaagcattgtgtgaaggcctatgaaaaacagcttttatttaaaaagaaggaagcacagctggttgaggctctttagggtccctcttggccccagcagtcataggtatctcctgagaagttgtagggcttcatagaatactcttgaaaactgctagactaaatgacctttaaagctgatttttatttttaaattttgtggtttttaaacatgtagcataagcaacttttaaatttgtgttttatttgtaggttgatgctcgaagtgaccgaactggggaggtcatctttaaggacaatttttcttctgcaattgccggtgtggtagagggagattaccggatggatggccacatacagttaatctgctgctcagtggatggggaaagtaaattgggatgagaaaaatcctt

SEQ ID NO: 19062 - DNA, 1038 bp, Homo sapiens
gtaactgggattacaggcacgcgtcaccacacccagctaattttttgtacttttagtagagatgggatttcactgtgttggccagtgaactcctgacctcaagtgatccacccaccttgggtggtcttgacctcctgacctcaagtgatccacccaacttggcctcccaaagtgtgggattacaggcatgagccacctcacttggcactgtctaatttttcaaaacattttctcgtagagatagggcctcactatgtttcccaggctggtcttaaactcctgacctcaagtggtcctcctatctcagcctcccaaagtgccaggattatacgcataagccaccatgcccagccaagccctgcattgtctagattgaggtctttgtcattgaggtggcagagtaactgtgggtttcctgtaagaaaaagagtcccagctcctagatgacattctgcatggccttaaaatgttacctgacaggcttcagttttctcatttgtaaaagaacacaactggaaagcaaaggttgtgttaaattggtttctgaattgctcctctctcccacttgggaaaagcggcccttcttaataaagaacgttattctggtgagtccttctgagcctattctagtccagggggctacccgattttttaaaatgtttaaaaagaaaagaatgttattttgtagctgatgtttggccttaaaattgtatctgtgctagctggcttattggtcagtaaataagaaatggtgtaatacgctgagaacttaatggaattgttaatattgctcacagtgtctctcttaatctgttttcagattctcacggctgtgtgagcacagggaaatcaaagcactctaggctacactccagagtagcttgttctccaactcggatttgatggggaacaagagagtgtagtcaggctctggggttaaaaagaccttgattcaagtctcagctctgcccctttactttcagaagtcctttcacctcctggagcctcccttcctccttcagtttccccatctctaaa

SEQ ID NO: 19063 - DNA, 1023 bp, Homo sapiens
ttggcaaccagccatatgttttgaagggagtgtattgatgcagtcttgtggtttggcacaccacccatctgctgcagatgttcttaggaacactgcctacatgtaaaaatgtcatgctggtatagcaacagaggggaggagttatcctgagaagggctcgctacccaaaccatgaattattcctttcaagttctcacataagctttcctgcaagactagggactcgcaggatttggacctgggtcagttttactggaatatgccaagggagggctctccaggtgatcaatttgttatcccttgagactgctcttggtggtcgcagaatgggtgttgtaactgtttcccttagttcttagatcacctttagaaaaggctctgtagtagcgtatttggtgacctgcatataaccccttttgggttttgaaacaacatcatttaatgtttctttgtgtagtaaggtagtctcctggggcaggagttcctaatctgtccgaccctgagtttattggaatcacctgggagtttgttaataatttatattcgcaggccttgcactaattctggttcagtaagtttgaagtgaagtctgggagtcgtagttttcaaagttccatgagtgattctgctgcctggtgaaggtctggaagccattggcatgtatatgtcatgaagcataagaccaaaacaagcagcaatttcttaccttcttcaaaggaatattctttactctcttctagtttattcttttatttattgttagaaaaaactgtcagatacctagttcatgaatgtgcagtctttttagttatgagcatctgaagctataaattttccttaactttcattgtatatgagttttatatttccttctaagtattttaaaatatccattatgatttcttctttgactcaggaattatttagaaatgtattttttaaatctccatattgaggtaacaaccatatttcagtgaggggaaagataagccttccccctcgccacacacgttttaacacctt

SEQ ID NO: 19064 - DNA, 1030 bp, Homo sapiens
tttatttatttattttgagacggagtctcgctctgtcaccaggctggagtgcagcggcacgatcttggctcactgcaacctccatctcccaggttcaagcgattctccttcctcagcctcgtgagtagctgggattacaggcatgcaccaccacacccagctaatttttgtatttttagtagagatggggtttcaccatgttggccaggctggtctcaaactcctgggctcaggcaattcgcctggctcggcttcctaaagtgctgaaattacaggtgtgagccactgtgcccagccgaagtcaacattttaaaagaaacaagagtgtagtgacttcgcttgaattcagtctgtatctgtggtggcatgattgccactgagttggccacctctgcagaagtctgaagtgttcaacataaaactaatccattttgactcctctaccacaaattgtttgtttcatttatttgagctattttaaattggaaactggtgtcattaatgtttaagaaagaaaggagaaactgagtagagtactatctcttgacctaatttctttgtgagcatattatatactcacctaagtatcaagtggaagaggaagttgatccctggagggaaatttccataggttaaaagcatgggatttacagtcagatgaatttgggttcaaatcccagctctcactttatccatgtagcactcactagctgtgtgacttgggcaacgtaaattgcctcagtttccagactgtaaaatggtaataatatctagtttaaggctgttctgagattcagttgagataatgtttagaagatgctttgaacaatgtagctaatattaaatggtacagacatagtaagtattcttgatcactgcagattcagtggaattaaattttcatattttgatgaaagggaaaataaccagtattcagtttgcaaatttaaatgtgttgtttctttttaaaaacattgaatctgtggttgggttatttctgtcaatttatttgccttccttgccaagtcac

SEQ ID NO: 19065 - DNA, 1043 bp, Homo sapiens
ccggataagctaggtaaccgtggcttcctcatggggtgcacacccccttccccctataagagccttggctgccacagctttcctgcaaggcagattgggagcaggggtggacacaggttctgagtgtgccctgaccactggcagacccatctccacaggctgacttgccagagaccaccccaagtggaaaattctgggggctgggccagggtggatctagggctcggaggacctggagtatgtaccatctgggggcccttttaaagagagagaacataaaattacatagacacaggcaggtacaggactttgggaggggctcgtgtagtgaggggtcctgagggtgggctgccgttgggtgggcccagggggcatcggggtggccttggttgcacttgccctctgggctttcctgaagagctggggttggctctgtcctgtggagggagagggtgcgggaggctgtcagcaccagcccaggtttctctcacctgaagtcccaggtgtgatgggatgcttgaacataggggaacctaaggccacagccttagaagaagccacagccacatcagtcatccctggtgctgggcaggaggcctgggtgtaggctggagctgaggactgaggctcaccttgctcctgactctgtgcccacaggtagaacacctgaaggagaagctcattagccaggcccaggaagtgagccgactgcgatctgagctggtgaggccacaaggctgtcctggggtagcgcagggcctggcctgccttgtgcagatgggccctgccaggggcaggggtgcgaccctctctctcctgagcccgcatatcccaccctgtctcagaaacacaccgagagccttatccccacctcctagtaccctcagaggccttgtggctccagggggtgggaggttccttctctgttgctgacattaaacgggagtgtgaaccctggtataaatatgtctctccttgtgactttcacactcagaatagggtgggggcagcagggagagcaggctctgggtcaccacccttct

SEQ ID NO: 19066 - DNA, 1047 bp, Homo sapiens
gggaggcggagcttgcagtgagctgagattgcgccactgtgctccagcctgggccacggagtgagactccgtctcaaaaaaaaaaaaaaaaaaagccagtttttatttttcttttaacttcttaacataattttggacttaaaaaaagttgcaggaattcccatatctgtttcacccagactcctcaaatgttaacatttgttttatccttctctttctctctcatatacacacacatttgtgtacatatacacacacctatataatgacatttatgttatgtatttcttcctgacgtgcttgagagtaaatcgtagtcatccctaaatactttggtatgcatttcctaaaaatagtttcttacataaccctacaatgccatattaaaaaattagaaggtaaccattgatgcattgctgttacctaatctacagctctcattcacatttgccagctatccttataatgttctttatagcaaaggaaaatcccagattacatgatgatattcagctgtagtcatgtgttacattcagttgtcacattttaaaagtctggatcagtttgtttcatgaatgacattgacgtgtttgatcttacaggccggttattttgtagtgtgtccttccctggctattttttaatcagattgtacagtgcttttttcccccaaagtttcgagctccctcgttaatgaaaaagggactaaggagtaaggtttctaagtggagtcggggaacatgcacagcagccacatctgctctcctgggaaccctggcacagcgggcggagagcgggtgtcatcatggcagctggctcacaaggacgcagcgagagcccagcctgtcagttgagccccctgttataggtgatgcaagtgctcttgtttcatagtcctctccttctctgttttgttatgtgttcaaagctgtatcttagtgaccaacaaaagatgaaggtttctctggcatgtgtgtatgttatattttccccctcccctccccttccccaccccacacacaggcaaaaaaagtcttgctttattat

SEQ ID NO: 19067 - DNA, 1113 bp, Homo sapiens
gggggtgatgtgtgtagaggaaatacgcatataggtgtcctctcagcctcagaacacccgccacaacccttcccccgtccacagccctgcatgttttcactgctctctcccgttttggggtttgtgattattgatttagggtctgagacaaatggctctggtttctgggccgcaagatgctatggggtaaggtgagtggatggaaagcatacaacgcagtcctgggcttcaggggacagcaggaggctggggtgtaggggaagcctttctcttctacctgacccttgttcatgtccagaaccttcagcccccagtaagccccagcccaggcggctatggggtgtgggactgtagaagcctcgctgccttgggccagttgactaaataaactctctcttccttagtgatgcgtccgggacacactggcacagcctggccagagctctgcctgaaacaccacactgctactgatggcgttgccctctggggaacctgggggcaaaaaaggggtctccaggaactcagctacccctgcctctggccacctgcgggctcccaaaggcagtcaccacgaagttctcaggggcacacacaccacacatgggctctctcctccttctccctcacccccagtcaggtcactgtggggacagaggaccaggcaacttctgcctcggggaggccttggctcagaattgggacagggccaggaggtggcagagtgtgggctggaagggacagtctgtggggttcctgccctgacggttctccatgttctgtcttccttgggcagagaaaccccttgacgcccctgcctgcgtggccctacagcaccagctgggcccagagagcaccaggaaagtggctgcctggtccgagcgcccccttgtggctgttgtccagatgattgtcacatgtgctatgagacagaaacaggtgtgcttggtggagggtgggggaaggggtctcccagggctcccacgccagtgcctgagctggccccgcacccctgtggcccagcacccaccctctcgaagcctctctcatctccaaacatgcctgcccaagggctcacccaggaatggcctggatccgtagcgaatctccctccct

SEQ ID NO: 19068 - DNA, 1869 bp, Homo sapiens
gaaactttaaaaggtagccctttagaggggtgtgtgtgtctgtgtgtgtgtgtgtgtgtgtgtgtgtaagagacagggtctctctctgtcaggcttgagtgcagtgatgtgatcatgggcttaagtgaacctcccacatcaccttctcgagtagctggtattacaggtgctcactgccaagccaagctaatttttaatttttttgtagagacaggtcttgctttgttgtccaggtcgttctcaatctcctgggctcaagtggccctccctcctgagcctcccaaagcgctaggattatagacatgagccactgagcccagctgccctttagattttgagggacaagttgatccaataatttggatcagggtaggtagggagccctggattttaactacagcagagccttttatgacaatgaagagcacagaatgaacttaaatcagatagaatttagagtgtgtgtgataggcaactgaaagggatgtttggagagtggaaaggacagggaggctttggaaggtatttggtacttggcattgagatttggtttctggctgtgatagttgggccaagcactgtatttttcatggttttgaacgctttctttctcccataggctgtagagggcttactagatgccacaagtggtgctgatgctgaccttctgctgcgctacagggaatgccacctcttggtcctaaaagctctgcaggatggccgggcatatgggtctccatggtgcaacaaacagatcacaaggtcagtagccatcttcgaaaagtagtgagtattggactgcgactgccttttgacatagatagtactgtttatgtccaggggtttcccttttttctagtaggtaggtcggacacttagacttcctacttctgagaggtgagaattgttaagtagttgttttccatctggtctctaccttctccccatgttggatatagaaaaccagtaccttgttttggggaataaattgtaggtcattgttttaaaaggttacagtgatttctcagaagtggtattcgtgtataagtattttaatgtcttaaatggaatactctgtatcctaggatttgaaaggaaagcttgggctatctgttctatttcattactggctgtttttaaatttggacactgatttggagttgaatctcaaggcattcttagtttggagcaaatttccattgagtaaaatgggcccttttacagtatggttaagcctatatgagtaaagatattgaactttttctaggtgcctaattgaatgtcgagatgaatataaatataatgtggaggctgtggagctgctaattcgcaatcatttggttaatatgcagcagtatgatcttcacctagcgcaggtatggaaggaatttacttgcacggacaaaaggactcagggaagtacgtttgctcttaagtgttttccctctcacattatgttttctgtgttgccagtcaatggagaatggcttaaactacatggctgtggcatttgctatgcagttagtaaaaatcctgctggtggatgaaaggagtgttgctcatgttactgaggcagatctgttccacaccattgaaaccctcatgaggattaatgctcattccagaggcaatgctccagaagggtgaggatgaaatgctttgagatccctgtgcatttagtagtcttctaatatctttaggaatgaatatgcagacttactaacattacttgttataactgctttaccaaccacatatgggtgggtagctttggtaagggctaatattgtcacttgaagtatgaaagcctaattgactgccaagtcttcttggcacagagcagtacatacggtaccagacttagtgtca

SEQ ID NO: 19069 - DNA, 1028 bp, Homo sapiens
ttaattttaatagtttttgtaagaagtcttttttctataaactttattctttttacattttcccaagctagtggagaagttgctttcttttaagagcacttgagccacaaattttaaataagccagcagtgtgtctttaagtagttaatgcatattgtaatgaacagtttgtccattaaacttggatttaaaaaaaagacatatctattattgtgtatcacagggtatactgaatacatttccctgtatggagctcagtttctgttacccgaattttccattggttaactttaagtagaaactggtagtttttggttaatcttgatttacaaaatcatgaatgtgattgccagtaggaattggattgtcttatttaaacaaggtgttgactttgtcctccccaaccccccagattcccttgtttcaggcccatccacagttgaagcagtgtgtgcgtcaggcaattgaacgggctgtccaggagctggtccatcctgtggtggatcgatcaattaagattgccatgactacttgtgagcaaatagtcaggaaggattttgccctggattcggaggaatctcgaatgcgaatagcagctcatcacatgatgcgtaacttgacagctggaatggctatgattacatgcagggaacctttgctcatgagcatatctaccaacttaaaaaacagttttgcctcagcccttcgtgtaagttggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacacgatgtttgacagatagtagatacccaaatatttgttggtttaaataaattaagatttaaaaaggaaatgtgatatctgacaatctcatttctgttaaccaggaagg

SEQ ID NO: 19070 - DNA, 1012 bp, Homo sapiens
gcaaggactagacattatgttgattcctgttttggggataagcttggcaaaatacttttctttggttttgttataccattttggggggtatattccccgcttttgaaagtatttttcttattctaggacttggatgtgaaatcattgctgctagaggcttatgttaaaggacaacaagaattgctctatgtagtgccctttgttgccaaagtcttagaatctagcattcgtagtgtggtgagtagattttaatattttatttatgactaatttctaagcattgctttgttttagcatgaggtcaagagattatattcttagttcttgtgaggtaaagctagttaagtctgttttcctctatggcacttggatttccaatttgagaggctgggtgaaataagaaagattataatggttggctttggtttttggttttttgttttgttttgtttttgaaatgtgatataggtgagaaggctaggggttttgttatggctacagaggtataagtgtttaactatgtttaactgtttttggttattttttaatccttgttttttgttttttatttgtttgactcccccctacccccttatgttgtattgaattgttttaaataatccaaattaaagggcacattttgggccagcttaacataatagcttttctttaggtttttaggccaccaaacccttggacaatggcaattatgaatgtattagctgagctacatcaggagcatgacttaaaggtaatttactgcttccttgtcctctggaacattctttgccttcacattattaaaacttacagtgaaggcagggtatttcgggggaagtactataataactgaaagtagagtatattatgagtaaaactaaagttttcttttaaaaattctaatccaactctggaactgtgcagttaaacttgaagtttgaaatcgaggttctctgcaagaaccttgcattagacatcaatgagctaaaacctggaaacctcctaaaggata

SEQ ID NO: 19071 - DNA, 1213 bp, Homo sapiens
ctccacctcccaggttcaagcagttctcttacttcagcctcccgagtagctgggattatagttgtaccgccatgcccagctaatttttatatttttagtagagacggggtttaatcatattggccaggctggtcccgaactcctgaccttaggtgatccaccctcctcggcctcccagagttctgggattacaggcctgagccactgtgcccggccagtcctcttttttaaaaaacagaaaaatatagtcttgtagaaaaccattgtatgtatttgtattgctgctgggcatttgtgttgttaatcacttaaactattataaacaatgctgtcctgaatgttttcgtttgtatcttgtagtattcaagtgcaagatatctttagactctaaatctgtttgtggaatagctgttgtctaggagtctgtgcagtttaaggtcaaattctactgagctgaggcttattcaacaaaattcaagtattttaatttctaaaccatcatttatttcttaggaggaaaaacttctagaaccagcatacagctgtggtcattctttgctcaataacttgggtcattggcttaggaaccagcactatatttaaacctgtggatgggaatattccccattcttggttacgctgtagtgcaaaagaattcctggctctctgttgcacagctgacttgtgccattctgctgttgctgtatagagttaaggaacatggctctatttcgtttttattatctgatagcaagggtggttgggatacataaaagtttccacatactctgtagcaaagtttcaagaccatgttttttaaacagaagtttaaatatagccctaagtcaagaggtaccacagagtagatgggtatatacatgtgtgcatacctgcagccaaaacactctcctatgttagttctgcccccccttagaaaaacagtaaccggagaatcagttaaatggtttgggttttttagaaatttgaaaagaagtatataaacagtattatactatatctcagaaagttatcttggttggctgcagagatttgttaatgacctgggtatactgaagattgcaataggaggctaatttgattatattcctttgtatgcttgctgcctttaaggacttaagcatggctatcatcctcatttaaattaatttagcacttcaaaatagctttgtagttaggtctctgctttaaacct

SEQ ID NO: 19072 - DNA, 1030 bp, Homo sapiens
ggactgttgaaatagcttcaggatccttatcactctaaattgtggggatgggctatgtaaagtgagttttttttttttcgtaataacagctttattgtgataataactcatactaccatggtttttgttttgttttttaaggcctttggtttctcattgctgcctaattagaaaacagatgagtttcctgtatgaattattaagacttttaaagtttgcgtttttaaagaagtttaaaggcatttatatgcaggtatctggggctgcttctttagaagttgttttgctgtagttctctcataaatactaagattttatcgctgaagttcatggaatctacttatgtattagtgccagggtatggggcaaagagtatgtgagctagatgaaccaaaagagcactcagacatgttttttaccctctcagaaaagagggacgtataatccagacttagcaattaaggttaactctttttcctctccctacccttttagtatattgagtatggacagcagtctagagatcctcctgtgaaaatgcaaggctctatcacaacccctggaagtattgcactggctcaggcccaggctcaggcccaggttccagcaaaagctcctcttgctggtcaagttagcactatggtaaccacctcaacaactaccactgttgctaaaacggttacggtcaccaggccaactggagtcagctttaagaaagatgtgccagtaagtagatctatcttttttctcttccaggatttatgattatattgtaataatcagtggtgaacatgtattagaattttatcataacacatgcctactaaaaaagatataaaagactgacatgtcttcctttgtatctcccatccttatatttcccagaggcaaacatattaatagttcactattcttgcctacatttctaatacacagtcataccatgtgtattttttaacactaaatctgtatacattattggatttttttcagggaagcatttcaacttatttgccttatgtactttatt

SEQ ID NO: 19073 - DNA, 1057 bp, Homo sapiens
agagctataatagtctctggctggctgtgttttatggggaagtggaggaagggcttaaatgcccactgattccttttttgtttccaacagcggacttgtctcaggtgtggccagaggcaaaccagcactttagtaaagagatagatgatgaagcaaacagctatttccagcgaatatataatcatccaccacatccaaccatgtctgttgatgaggtgagtgtctaggatgatctacttatttattgtttaggccagtcttaaataaatgtccttttcaatgtttttagaaatccagctcaaagtgccctgatatagcggtttgtgttttgaaaccttaatatttgtctcaagctcttttggtaaatgttctacttaatagtcttttgttaagcatatttgagaaaggctcttagtaattgtttcctttatgtgtgcgttgtttttgtcttgcttttccaggtattagaaatgctgcagagatttaaagactctactataaagagggaacgagaagtatttaactgtatgctaaggaacttgtttgaagaatatcgtttttttccccagtatcctgataaagagttacatataacagcctgcctatttggtggtataattgagaaaggactggtcacttacatggcactaggtctggctctacgatatgttcttgaagccttacgcaagccttttggatccaaaatgtattatttcgggattgctgcactagatagatttaaaaacaggtaagtggataggtttcctgtgaaggatctcttccctgaccccgcagacagggtcttaactctcatccaggctggagtgcagtggcgcaatctcggctcactgcagccttgaccttgcgggctcaagtgattctcccacttcagcctcctgagtagctgggaccacaggtgcataccaccattcccagccttttgtaatttttgtacagacagggtttcaccatggtctcaaactcccaccttggcctctgaaagtgctgggattattggtgtgagccactgtgcctggcctgaagctttttttttttt

SEQ ID NO: 19074 - DNA, 1033 bp, Homo sapiens
ttgcccaggctggagtgcagtggtacgatcttggctcactgcaacctccgcctcccaggttcaagcgattctcctgcctcagcctcccgagtagctgggattacaggtgcccgccaccatgccatgctaattttttgtatttttagtagagacagggtttcaccatattggccaggctgatctcgaattcccgacctcaggtgatccacccaccttggccccccaaagtgctgggattacaggcatgagccactgcgcttggccacattttcagtttttttcccagatattgttccatgtaactttacattgaaataaaagctatattttttttgttgttgttgttgtggttgtttgtacctacatcttcttagccccttgtaccttttatgttgacactgtaagtttgggcactaaaacctaaggacttccatgttgtcattgactctaatctagttagcgttgctactgtatgcttctagctttgattaattcatttaaataaacgtcactgaacttattaaggccttcctagcaaagctctaattattgtaagattccttttgtcggagttgagaggaataaagaagttttgagactcatggtaactttagaagatagtatcatgaaattatttgatttgaatcattgagaaaagccagccagctccttattttaactaccttgggtataggagtatgtgctttgagaatgtatacattaattttttgcacattatcaagaatataaataattccagatgctaaagaaatttggggattatccgttactgcctagtttataggctctgtaaaattgaatagatgtaataagggaattaacaaagactctgacttttaaagtaagagttactatgactttattttaaaagtctgtcttattaatatatctgagatgtgaataaaatcaagaatatgaataatgataggatttgtggctgccttcgttctctctagtaggtggtcttggcacaggcagcctgactggtataggaactggtgctcttggactc

SEQ ID NO: 19075 - DNA, 1156 bp, Homo sapiens
agcactcctcccgcctcagcctcccaagtagttatgactacaggcatgtgccaccacacctggctaatttttaaaattttttgtagagatgaagtcttggctgtgttcacaggctggtctcgaaactccttcctcaagcgatcctcccaccactgcctccctcccaaagtgctgggattacaggtgtaagccacctccacctcccagctaccatgtagagcctctttttttttttttgatacggagtctcacattctgttgcccaggctggagtacagtagtgcaatcttggctcctgggttcaagcaattctcctgcctcagcctcctgagtagctgggattagaggtgcccgccacatgcctggctagtttttgtatttttagtagagatggggtttcaccatgttggccaggctggtcttgagcttctgacctcagcttctgacctgagtttctgacttcaggtgatctgcctgcctcagcctcccagagtgctaggattataggcatgagccaccgcacccggcccgagtagagcttctgaatacaagggaccccatagttgtatgaggcaatacagattgagtatcccttctttgaaatgcttggggtcagaagtatttaggattttggtttaaaaaattttttaaaaaccatttgcattatacttacttgcttaatatacacctcaaattccaaaattcaaactccgaaatgctacaatgagcatttcctttaaacattggcattcaaaaagttttagattttgtagcgtttggtattcagattctcagatttgggatgctcaacctgtaatagcaacctaagataggaaaattggtttaattgtcaagtaaacatttaccctacttgacatttgttttagaggtcagtcactgcttcatgtgcttgttaaaggtaattactatgcatggtgtttttgtctataagtacatgtattatcttagactgtgatatactagtataaaaattgcatgcctgtttgctttgatatgtctgggtttgggcataatttttgacaaagtggttgaagctatggaatgttttctggaaaattttaatatattttggttgtactatatactagttcatttcagaggtgcaaattagtttcaagagaaagccagtactcag

SEQ ID NO: 19076 - DNA, 1027 bp, Homo sapiens
aatctgtctttgttctgtcttttaaatttattttttgccattgatttgatagagaaatacagcatttgttctctagtctaccccatgttattttcttacctgttttctcatggtgtttacttcattctctatccccatggttttcatgggctgaggatagagttagatcttcaggctcagttaaagtcaaccagtttcaacctcttggggcaaaaataattcttaaagagagtgctgtggacttcaaacttctaatattaaaacatgacaccaacttggttttgtgcttacaagctggtatcacttattttgaaaattaatctgtatacttggattttcattgataaagcatgtttcttcctttctcgttaggaagagcttggatttgattgaatctctgctgaggcttgcagaggttgggcagtatgagcaagtcaaacagctcttcagcttccctatcaaacactgtccagacatgctggtattggccttactacaaattaacacctcttggcataccttgcgccatgaacttatctccactctgatgccaattttccttggaaaccatcctaactcagctattattttgcactatgcatggcatgggcaggtaagatgtgaccgtgtgcttaccattttttcatctgaataattgatcttctttggagtgttgaggaagctcaaccagagaaatttttttttacatctctgaattattatgactttaaaagtcatactgtcataaaacttgttttatcttttagaatcatgtgagcaataaaatacaagatcccaaaagcaaggaggcaaaataatatttaataattttattttctttccttttttttttttttttgagatggtgtcttgctctgtcgcccaggctggagtgcaatggtgcagtctttctcactgcaacctccatctcctgggttcaagtgattctcctgcctcagcctcctgtggagctgggattacaggcgtgcatcaccatgcacagctaatttttgtattcttaatagaa

SEQ ID NO: 19077 - DNA, 1026 bp, Homo sapiens
cactgcacctggctctagaatggaacttttagatattaaaaggtagtgtgataagccggttgtggaggctcactcctgtaatcccagcattttgggaggccgaggcaggtggatcacatgaggccaggagtttgataccatcctggccagcatggcgaaaacctgtctctactaaaattttaaaaaattacctgggcatgttggtgtacttctgtaatcccagatacttgggaggctgaggcacgagaatctcttgaaccaaagaggcagaggtttcagtgagctgagatcatgccactgcactgcagcctgagcaacggagtgagactctgtcttaaaaaaaaaaaaagaaaaaaaaagaatgggtttcttaaaattcacattaaaaattttgtaagtagaacatctaaattgaatttcagatttaatttggccttttggataatgtatcaaaatatacacacattcattacattttaaactgctttggtcttttttagaatccaagtttgaatttcaaggaagtaacttatgaactggaccatcctggatttcaaattcgtgacagtaaaggacttcataatgtggtttatggcattcagaggggtttgggtatggaagtgttcccagtagacctcatatatagaccttggaaacatgctgaaggccaggtgagtaagtggtatttagctatagatgggggaataaaacatgacttattctttatgtagtgccatctacccattgatcgaaatattcttgtaaagtagaatttgttatacatagcacagaaaagcaaggactgtccataagtattgaaggaatattatcatagttttagtattaggcagactcctttaaggtgtaactgtcaaggtgttttcccaatagtttaatgatgttcatttccaaggcaacgttaagtttccctaattggctcagaaatgtcttttaacagtcaaggtgttttcccaatagtttaatgatgttcatttccaaggcaacgttaagtttccctaattggct

SEQ ID NO: 19078 - DNA, 1052 bp, Homo sapiens
acattcctagctgtataaatgtaacaagaaataacacttactgctctgcctgttttatttagtaaaactaaggctttcaaacaaggttcatttaatgccagaatttctcaatctcggtgttgaggctggtagcatttttctgaagttatatttctgtttcagtattgaagaatgtcgcaatataatcgtgcagtttggtgttcgggaggtcacagctgcccaggttgcaagggttttgggaatgatggctcgaactcattcaggattaacagatggcattccattacaggtgtgttgaattcagctattttaccaagtgagttaatgtcctgtcctctttatttttttttaattaaattacagtatgattgattgttctatcgaccagaagtgaacacatggagtagttgggtttgtttaattcaagttttacttctacagagtatttctgctccgggcagtgggatctggagtgatgggaaagataaaagtgatggagcacaggcacacacatggaatgtagaagtcttgattgacgttcttaaagaactggtgagtatatgtgatgatgatttttgatttgtggtatttgaatgatatagtccaaagaaagcaaatttttaagaattttccaccttcgttaactcaaaaagtaataaagtgtccaagttaattgtgtactgcaggcagtacgtaaccaaatttaaattttttcattagggttgttaccttgtaatttggggtgctacttctaagttactcttgtttatggtggataagaacagtgaaaatcataattatcttgccacttctacttcggttgcaaactgaataaaaaataaagtacctctactaaaatattgaagggcttaaataagacataaaggaattgaactctatttatttttccttttgctgtgttgcccatattggactttaactcctgggctctagttagtgatcctcccacctttgggagcaaagcgttgggattacaagcgtgagccattgtacctggcctagaatggaacttttgtttttgtttgtttttt

SEQ ID NO: 19079 - DNA, 1688 bp, Homo sapiens
aattcttttcacaacaaatctgatagtggattaacatccattctcatggttacttttatttacttcttaatgtttatagagtttaattttaatgtacattaacattctcactaatgggaaactttccacttgccagtgaaataaatagactgatattctaattgtttgtttttgatgctttctttgtatgggaagtgatagccctattgtgcaaatttaaagtaatatttagggtacgaattggtcagtagatggaatgccagtgtcaaatgttaaaggtacactgatgagcattttttgtgatataaaagtattcaaattttggaattgatgttaaagtcgtaacttcggctagtaggctggaaaaatgaaataagcttggctttgaatatgaacttgtgagagaattgggtttgaggggattttggatagagcaaaagaggattgtttgtttttaattagtatagcagttgtaacctttttcctctctcagattttccccaagaacgctgtcccgtggtgctcgcaccacttttataccctgaaaaacgggacattctaatggacaggatcctgcctgattccggaggggtagctaaaaccatgatggagagctctttggctgatttcatgcaagaagtaggctatggcttttgtgcaaggttggtagtaaaatgtgttaagcttctgattattcttgtgccaaacatgatgtaattctttaaaaaaagtctctaaaattccttaaagttaatcatcttttcttctcaagaggcatgcttctaaattttaatcttccacgaactagtgtgtgtgacagctgtaaacatcctgggtgttaaatgtttatctccttcccctcaccagtttctcaaaattaggagccagaggtttccaggctagttgccacaataggcatattttggcttttggaaggaagagagagcattgaagcaagttagtgtttatggaacttgtatcgctttacacttaatgtgactaattttctcctctctgacccccacccctctaatttcttcattctgccttcttctgtggcttccttccttttctgcctcttgcgtatttttctcacttgcttagggcaccaaaggatattgtttcacactgttagtagcacttaagactgtgatacactggattattaatatttttctaaaagcaaattattaaggggattaatgtgctttgctttgacttaaaaatccttatgttttaaaaactctcagacaaatcacattctcactgaggtttgaaatagtgcatttgtgagtgttgtacttgtgcctggcatataatttttgttaatcaaactgaataagatgcatagtgaaaagttaggatgcaggctgggcacggtggctcatacctgtaatcccagcactttgggaggccgaggtgggcggatcacctgatgtcaggagttcaagaccagcctgaccaacatggtgaagaccctgtctatactaaaaatacaaaaattagctaggtgtggtggcacgtgcctataatcccagctactcaggaggctgaggcaggagaatcacttgaacccaggaggtggagattgcagtgagccaagatcgtgccactgcactctagcctgggcaacaaagcgagacttcgtcaaaaaaaagcgagactaacaaaaaaaagttaggatggat

SEQ ID NO: 19080 - DNA, 1049 bp, Homo sapiens
actttttccaaaaatatcacgaagtgagactttaaaatacgtgggtttttaatcatgaggctctgtgatttagacttagagagtaagataatctgaaattaatttctctttatctgtggtaaaaaacatgtaatataaatgttaccctcataaccactttaagtgtacagttccatagggataattgtattcaggttgtgtaacatctctctggaactttattttgccaaacagaactatgcccatcaacaactctctattttcccctccccactgccagtccctggccattggtttctttatacctgtcagctagagaaagcattagagagatgggtgaactggtgaatgagaagggtgattatctgcattttgatggtatatgactttttaacccattgtggtgcaaaagtaacttgcggtttttggtttacctgacttctagctgcccagtttatcaaacagaagcttccagatcttctgcgttcttacattgacgcagacgtcagtggaaatcaagaaggtggcttccaagatatagcaatagaggtcctacacctcctcctctcccatctcctctttgggcagaagggagcctttggagttggacaagaacagatagacgcttttcttaagacgctgcgcagaggtaagggagtctttgtagcctacagtgggtggttttcttggatgaccacagacacatcacaaaagcattcccccctcccctcccctcaccctcccctcctccctgccctcccctcccctcctccctgccctcccctcccctccctcccctgccctccctccccctccccctgccctcccctccccctccctccccctcccctccccttcccctctccctctcctccccttcccctcccctccccctcccccacccccacacctctcccccctccccctcccctcgcctcccctcccctccgcctctttctctttttaaaaaagagacaacatcagctgggcacagtggctcaggccaataatcccagcactttgggaagatcaggcgagcatgacaccat

SEQ ID NO: 19081 - DNA, 1525 bp, Homo sapiens
acttgaaacttttttattctttggccattgactgtgtgatgaaatgtgccttctatttttttaggttgataacacagtctcagacaagtcagtgtattcattaaccatgatctggccctctgattccctctgaccctttttctgatcttcagagttcttttctgtctctgtgcttttgcactctaggtttttccttctccctggattgttctttcttcacctgtatctatggttgtctcagctcacaggtctcaccttagaaggcttctctgaggtaaccgcctgcatcaatgttagcaagctctgttttactttctttttgttaacagataatgttgtcagaaattctttgcctgtacttctcccacaaaaattgactttgtgagaatttggaacctattagtctctgctgctgtgtttacacctagactagtacgtagcatatactcagcaagtgtaggttgaaccagattattgtattttttcaagggtgagagatctggttaattggatcatagttaattctgttcttttttgttttattttttattgagacagggtgctgctttgtccccacaaggtgggagtgcagtggcaccatcatagctcactgtaaccttgaactcctgggctcatgtgatcctcctgcctcagcctcccaaggtgtttggattacaggtgtaagccactgcacccagactctgttctatttttttttttttggagacagagtctcactccctcatccaggatggagtgcagtggtgcaatctctgctcactgcaacctccgcctcctgggttcaagcgattctcatacatcagcctctcaagtagctggaaattataggtgtatatcaccatgcctagctattttttttggtagagatggtctttcttaacttccatattttctgaatgaagagaagggaaactgaaataagctaagaacttagacagctttcatgttattatcatgatatagtgggaagatcataggctttgaagttggactataaatccagattcttcaactcatagacttggattttaggctcaaggagtctgttttaaatatgtcaaccccttatccgtggggatagatggtggtaaattttagcagtttttgaagattaagccaggaaagctcagtgcaatatgtagcccaacgtgtaggtagtatgtggctcttagcaaacgtgattactctgcacatacactgtgctcaattattttctagactagatgtgcagaagtgaacacagctatacaaaatttcaataaacaaattagcaggtagtggtaaatgctatggagaaaaagtaaagcagaataaggagtgatgctggggcaggtcatatttctgttttaggaatggtaataagacctcactgataaggtgactttagagtagaaacctaaatgaagtgaaagaacaaaccatgtatagccatctggagtttttcatttagaaagaataacaaatagaaacaaacatgggtaaatttgaggaagggcaggaaact

SEQ ID NO: 19082 - DNA, 1029 bp, Homo sapiens
gaggcaggatcactgactctgtcacccctaggagtcattagggccccttccctggaggatggcctgctttttctctggggactagtcctcatttcccttccatgatacagtggggcaggttatttttattaagcaaacatttatgagaaccccctccccaaaataaagtccccaagtaaacacaaccctgaatggttgtggactatgaattgtttctagtgaagataaatttatgcaaatatatcttaatctttccctctgtctgtcttgtgattaaggggttgctttttggtaaggaatttttttgttttgttttttagatggagtttttttttttttttttttttgagatggaaaaatagttttgatcatagagttaggcattatggaaattcaagccagatttttaaaaacctggtcatctccaaagagaaatagtgacagtaatagtggtgcggggaacaatatggtagattattgaatgaaatggattaacttgaacaaaatgctgtgacttgtctctaaaattataaaatgtgatctgacttgttttggtctggttcctcttttttttcttttttggttcctttatttttcacattaaaaaaatgaaatatccataggttgtaaaattcaccttttttgtttttttttttgacggagtctcactctgtcacccaggctagagtgcagtggcgtgatctcggctcactgtaacctccgcctcccgggttcaagcagttctctgcctcagcctcccaagtagctgagattgcaggtgcctgccaccatgcccgggtaatttttttgtatttttagtagagacggtttcaccatcttggccaggccggtcttgaactccttacctcatgatccacctgcctcagcctcccaaagtgctgggattacaggcgtgagccactgtacctagcctttttttctttttctttttcttttttttttttaatgagacagtattggtctgtttcccaggctggagtgcagtggcataatctcagctgactgcaa

SEQ ID NO: 19083 - DNA, 1038 bp, Homo sapiens
gcctgggaaacaagagcgaaactctgtctcaaaaaaataaaaaataaaaaaaataaaaggactgaagtagattactaagaaagtgaatctagagaagaaaagttcaaggactccaatattgtgaagccaaaagtcatcagagtagactagagagaccagtaaaatgccatattaggaacaaaataagtgtatccatcatctttttattatttacttaaaaatattttacttttttttttttttaatagacagggtctcgccatattgcccaggctggcctcaaactcctgggttcaagcgatcctcctgcctcagcctcccaaagtgctgggattacaggtgtttgccaccgtgcacaggcttttttttttttttttttttaaggtgggtatggagcactagcatatgtagaacctttgatttgtgtacataaaactatgtatcctttatacattaagaagctgttaactttgctttgtcttgataaaagtgtgtaacctttatacattaagaaactgttagagataaaggttttaaatggccttttaaaggggttttaatcttcctgagtttcctgcatcttacatggtgagttttgattgtaatgaaattacaagcggacttcagaacaggaagctgtggataagctcagctcctttccttcagagatttttgtgtttcagtggttcttggtgaatttcttaaaaaatgggtgttgtggctggacgcagtggctcacgcctgtaatcccagcactttgggaggccgaggcgggcggatcacaagctcaggagttaagagaccagcctggccatcatggcaaaaccctgtctctactaaaaatacaaaaactagccaggatgtgggctccatggctcatgcttgtaatcccagcattttggaaggccgaagcaggtggatcgcctgaggtcaggagttcaagaccagccaggccaacatggcgaaaccccttctttactaaaaacacaacaaattagctgggcatggtggctgttgcctgtaattccagctacttgg

SEQ ID NO: 19084 - DNA, 1049 bp, Homo sapiens
accttatctttcctttcttggtatttcccatcatcaagagtaacttctaaaaatgttcatttgatcattttgtctgttattaggcaaaacaggcctaaaacaaatccaagataacagcggcttaacagagtaaaaatgtatttcttcctcaaataattttcattgaggatgtttcattgaggatcctgtgcaataattcaagaagtctcccttcgtctgtcatctcatgacatcatcctcctctaggtcttgggggtttattcatcgggcagatagtcaaaaacagagaatcatgagtgaggttttgtgagctaggtctgaaagtgccacataccatatttgctgtatactttgtgggttaggaactaagtcttacagccaaaccaatgcaagagaagctgagaattgtattctaattctttagctgggaagaggaagcagtttggtgagcatctagcccatctctgcatctccctgtttactaaaacagacccaaaccaatcaaagtagcttcccagatcatctttgtgataagattcaaaattctgaaatggattctccatgtgctagacaggaaatccacaatttgggtcccacttacctctagaagatatttcatctctgctgggcaagcgtgttggggacagttcccaagtccacctgcaggttcagtaattcactaggagaaaagcccagggctgatttttttttttttttaaatagcaaaggatacaggcccagtgctgtggctgatgcctgtaatcccagcacgtcaggagaccgtggcgggcagatcagttgaggccaggcgttccaagaccagcctggccaacatggtgaaaccctgtctctaataaaagtacaaaaaattagacgtagtggcatatgcctgtggtcccagctactccagaagctgaggcaggaggatcgcttgagcctgggaggtagaggctgcagtgagcccagctcaggccactgcgctccatcctgggcgacagagtgagaccccgtctcaaaaaaataaaatacaataaaaagtgtttttctat

SEQ ID NO: 19085 - DNA, 1740 bp, Homo sapiens
catttttagtagagatggggtttcctcatgttggccaggctggtcctgaacccctgacctcaggtgatctgcccacctcggcctcccaaagtgttgggattacaggtttgagccaccgcacccagcctcttcgtctttttacatctggaatgtcatctctaccaaaactttatcattctagtccaaactcaggtgtactgtctataaatacctaatttccttaagcaaaattgattttttgccatccttggccagtttcacttaagtgcaccctacaatgccttttaagttttctgtcccatagtgagtaaggagtctctttccccagtgcatatatacagttgaactgtaattgaatagtgcttcatttattacagttgggtaaattgatagaatatagcattcttggaaatcgatactctggtttttctttttttcatactgcttgaatgagcaagtaacatttcagaggaaaagatctatcggtggtggttcattatgtaggtcaggattttagtttcatttgtgcattggattttagaatatcatgactatctctagtaatctacagagttaaactatttacatcttggcaatttcttgaattaattagggagatctttctttacccccaaccttttatttggatagagttttcttagttgtgaccaaagcaaataaggtttttttcccagcagttttttggacgactagaaacaagatttgaatttttcatttcctcactatgaaaatgcaaaacttggctacgcgcggtggctcacgcctgtaatcccagcactttgggaggccgaggtgggcagatcacaaagtcaggagttcaagaccagcctggtcaatatggtgaaaccccgtctctactaaaaatacaaaaattagccaggtgtggtggcgggcggctagtcccagctacttgggaggctgaggcaggagaattgcttgaacctgggaggcggaggttgcagtgagctgagatcgcgccactgcacttcagcctgggtgacagagcgagacgctgtctcaaaaaaaaaaaaagaaagaaaatgcaaaactctagtgtgaccaaaagatgctcttttacaattaatggtcagtgtaataataataaatttgcagttctgctgagactgcctaaagatgaagggacttgagttttaacaagttctttagcatcgtaaattgaattctgagatttgagagttttctcttggtgtagttctttttaaaataaaatagcttcaagaaggctactctctgttattttgttttttgagacagggtctctgttgcccaggctggagtgcagtggcacgatcatggctcactgcaaccatgacctcctgagttcaagccatcctcccacctcagtctccccagtcagtggctgggactacaggtgtgcaccactacgtccagctaattaaaaaaagtttttttatagtgatgggggtctcactatgttgctcagcctggccttgcactcccagcctcaaaaaatcctcccaccttagcctcccaaagtgctgggattacaggcgggagccaccatgcctggcgtggattagattaattcttgtaaaatatttaaggcacatacacaaggctgttaaatgttacaagttattgaaggcactgtagcattgagtgaaataaattgcttgattaatatgtgtatataaaaagcaagtcaactctttttttcatgtcagacaggtaatgtgc

SEQ ID NO: 19086 - DNA, 1046 bp, Homo sapiens
tggtcaggctggtctcgaattcttgacttcaagcgatcgacccacctcagcctcccaaagtgctgggattacagacaggcatgagccactgtacccggccaacacttaggttcaagagtttattataaaggatatggatgaggaggtgcgtaggagaagtaagggccgcggagcttccatgccctcccctggctacactgtgcctcagctatctggaagctctctgaacccagtcatttatgggcttttatggaggcttcattacagaggcacagttggttaaatcattgacctttggtggtcaccttaacccttagcaccttttccctccctggagtttggaggaggtggggctaaaagtcctaatcctctcatcttgccttgatctttcaggtgaccagcacccatgcagaaactacctagaagttgccaagctatcagtcaactcagcatacaaaaagaaacttaccattctaaggatcttagaagttgtatgccaggaaatgggatgaagaccaaatgtatatctcacaataaatattacagtaatgttgaagtaattatttgaaatataaaagtgggatggaagtattttcttttctttttttttttggaggcagagtctcgctgtatcccccaggctggagcgcgatatcggctcactgcaacctctccttcctgggttcaagcgattctcctgcctcagcctcctgagtagctgggattacaggcgcctgccaccacgcttggctaatttttgtatttttagtagagacggggttttgccatattggtcaggctggtctcgaactcctgacctcaggtgatctgcctgccttggcctccctaagtgctgggatttcaggcgtgagccactgcacccagccaaaaggattttcaaagacgctatctaacattcttttttctttttctttctttcttttttttttttttgggtcaagagtttcactcttggcgcctgggttagagtgcagtggtgcgatctcagctcactgcaacctctgcctccaggtttcaagagacga

SEQ ID NO: 19087 - DNA, 1084 bp, Homo sapiens
acctccgcctcctgggttcaagcgattctcctgccccagcctcccaagtagctgggattacaggcgcgcaccactgcacccagctaatttttgtatttttggtagagacggggtttcactatgttggtcaggctggtctcgaactcttgacctcgtgatccacccgcgtcggcctcccaaagtgctgggattacaggcatgagtgaccgtgcccagcctagtagtctgccattttgaaatgctgtattttatgaacttggtatatctttttttttttttttttttttttttgagacgcagtctcgctctgttgcccaggctggagtgcaatggtggaatcttggctcactgcaacccctgcctcgcaggttcaagcgattcttctgcctcagccttctgagtagctggattacaggtgcctgccaccacagccagctagtttttgtatttttagtagagaagaggtttcaacgtattggccaggctggtctcgaattcctgacctcaggtgatctgcctgcctcagtctcccgaagtgctgggattacaggcgtgagccatagcacccggcctgaacttggtatatacttttataaaagaaaagactttcaagtcatatatattaactgaggcatttctttaatgaccctctgaccaaactaaaacttcctgctgtgaagtttcaaaatggcatcccattgagtgactctatatatagaagaatctagcaattccttttctgtttgctcacaattttaaagatgaatctttgaaagttaaaaggggctcaacaccttctgccccccagtgtatacaatagttttttttttttttttttttgagacagggtttcacttcaatgcctaggctggagtgcagcggcacaatccctgctcactgcagccttgatattctggtctcaggtcagtctctcacctcagcccctgagtagctgggactacaggtgcatgctaaccacacgtgtcaaaaattgttttttttcttttttttttgagagagagttttgctcttctccctcaggctggagtgcagtggtatgatcttggcttgctgcaacttctgc

SEQ ID NO: 19088 - DNA, 1019 bp, Homo sapiens
ttctgtctctgctccctgatggttgcagtgggcatcggcttccgaggcctagggcttctggcgggggggaccgtgtttggagtttttgcatgtttccagttcttctccgtgtactcggagctgccactctccccgtcttacgcccccagcacgttgtcaaagccccccaggtttcgggtgtccccggatgggaagggcgggcgggagcaagcacttccttattacttgctacaggttttgttccactcgcgcgcctgggcgctcacactttctttgaagttggcccccacctactcggtccggtgtctgcagtagtggcggtcctgctcacccaggacaagtgtcccgctagtgagctgagcacttgtaggcctcaaggctgataagatccacggcaggtcttgtagaggtacttaaggccaaacacaaataatactttttcagtaccacctcctttgcagaattcacccaagagggctcacagatactaactccccgaggagtaagctttgtagattaaaaaagaatgcttgacatctgtgcgtttgaaaatgttgtatttaaaataaactttatgacaaacttttcccatgaagttaatcaaatgtcacatttcttaggactctaataaagtctgttttcttcctgaaaactgagtaacaatgcttaacctaccctgccgatttctctacaattcgatagcctgtgactacttgggtttttttttttttttaagtcagtgattgagtgaatataattatactgtttgaaacaatgccgaacgttttccttatgacagcccctttgataggaatagggaatacatggattaaaaaaatgagggaaggcaagtaaaatattaggaggaaggtcaaacagattaagaacaatttttttctataggtacttgggtttaatacttaagtgatctgtggtcccggttggtattcctacccttttaaagattggcagcagagtattttagctattaagaagacatgtggtaacagtttaaataa

SEQ ID NO: 19089 - DNA, 1025 bp, Homo sapiens
tcacccactggaaagaaccaccatctgctctaaccatgtagacttattgcggcctggtttctctgttacaataaaattactgtagacccaactactgtctactaagttatcttttttctttaatgggaggaaggggtaggagtgggtaaataaataaaggggtaggagtttggaatcgtgtagctgatcataagccagtagatgtatccactattccaaatattggctgaagattcgtcgttttcttcatgttgccattcagtttgtccagtccgaagatgctgagaatgtgggtgtaatcccttggaccttgtggggaacaagtggagtcccatgaaggatcctgtggatataggcaaagggtagaaggggtggaggagaagtgacaacttcagtggtctataggagccaagaaggtaacgtaaataaaaaagtgttgtgaactggatttaagttgatcagtggtgatcaaccctcatcctcagcattgaggagcagtagtgaagtgacaggagctgtgaggatgaacgcccaaggtggtaggtcttacatttttcaagaaaaatggaaatcttgatttctatggttgatctgttggtgcttaaaagttggcaactggttcaatttttaaaaaattatttgggccaggcatggtggctcacgcctgtaatcccagcactctgggaggctgaggtgggcagatcacctgaggtcaggagtttgagaccagcctgaccaacatggagaaaccctgtctctactaaaaatataaaattagctgggcatggtggcgcatgcctgtaatcccagttactcaggaggctgaggcaggagaatcgcttgaacccaggaggcggaggttgcagtgagccgagatcgcgccattgcactccagcctgggcaacaagagcgaaactccgtctcaaaaaaaaaaaaaaaaaaggaaaaaaaatgatttggaagcagggtgcagatggtagactgcaagtctgtgtcctctgatgtaggtcacatgcccctgtcag

SEQ ID NO: 19090 - DNA, 1033 bp, Homo sapiens
agccccaagttgttttcgtgatgaaaacacgaatgtgaggaggactgtgggagacagccaagctgagaaggtggagcagatcgtgaagcaccctggttgatactgtaagaagtcaacacttgattctccaggcaacaaggaggatggaggggtttggctaagatggctccacatctagccctgttcatgcactcaatatctttgggatccaggcctcaaagtgaatgaagctggacgatggaaactgtaggaaatttaaaatcagatgccataactggaggggccaggggctcctcagctccagccagtaattattttgctaatacagtgctatcgtttctcatttttcaagagaaactacaggtttcagcttttaggcacaagtgcccaatttaaaaacgtttcactgggtgaagtaaaacattactaggtcccatatttggtctttaattggcagtttgtgatctctcttctaaccgtgcataacatcattatacagagatggtttaggaaagtgaacacctaagaacagggagataaactgtaaatgggaatgtcattggtgagagccaagaatgtcccagagccatgggaatggagtggaaagggtagattctgaggaaggggaaggttgtattcagaatcaggtgatccccgtgcacagtcagaggactaccttctccagtccctcagacagaatttactctccttggggcttttagcatagcagtgtcctatgtgttttacattttgtggccgtattccatacttggtttacaggtttggttacaagcaccccttgcaagcttttgaaggcaaggactatgtctcagtcctcaccacctaaaatagcttggctcattgtagattcatagtacattgtctcaattgtgaagatgggaatgtatatttcatccatgtcaaaaataaggtcattttttttttttgtttaacccacagcttttaccttaatcttagtaggttttagagtgattcattcacttttctttttttttttttttttttttgagac

SEQ ID NO: 19091 - DNA, 1049 bp, Homo sapiens
gtttttttgttttttgtgtttttgtttttgagacagagttttgctcttgttgcccaggctggagtgcaatggcacaatcttggctcactgcaacctctgcttcctgggttcaagtgattcttctgcttcagcctcccaagtagctgggattacaggcatgtgctaccacgcccagctaattttgtatttttagtagagacggggtttctccatgttggtcaggctggtctcgaactcccgaccttagcacttcggcctcccaaagtactgggattacaggcgtgaaccactgcgcccagccacccattgttatctgtagttgtgacatactgttatatatgtatgtgcaggactggttttggttttgtcacttagaattatactaagcttttttacttaatattttcaatgtttttaaaaatattttcatattctctggttatgaagattttttttaatgcatgcatttcaatacacaatttgagagtctgtagtagacaaagatgccagactgtgttaatgactaccctcagggtggttataatctgatgagaaagatacacacatgactttcttgttcttgttgttgttgttgttgttgttgttcttgttgttgttttgagagaatcttgctctgtggcccaggccggagtgcagtggcacaatctcagctcactgcaacctccgcctcctgggttcaagcgattctcctgcctcaggctcccctgagctgggatcacaggcacccaccaccatgactggctaatttctgtatttttagtagagactgggtttcaccacattggccaggctggtctcaaactcctgacctcaatggatccatccacctcagcctcccaaagtgctaggattatagacgtgagccaccgcgcctggccacacatgatatttaatataagacagaatggaataaatgatgactaaagggagagctgttgattctagtggggagttagagaagatgtaatgaggactgcggcatgtgagctgtgcattaaagaggggaaagggcttttttttttgcaaag

SEQ ID NO: 19092 - DNA, 1016 bp, Homo sapiens
cctccagcctcagcctcccgagtatttgttagcactttgaaccaagttaattgatatttctctgtaagaggcagtcataatttttaaatggtagttccttttattccgtcatctccgtgttaagtagaacctgctttcccctaaaatcagtttcaaattaagtaccttacataggaaaacttccttaaaaacatcatatttttgtttgtgtcctaataattgctagcattgaatccgtatttttgcatatgtttgtattttattgtagagacagggtcttgctgtcttgcccaggctggtctcctcaaactcctgggctcaaatgatcctcccaccacagactccctaagtgctgggattgcaggtgtgagccactgcactcagcttgttttttattatctgtactatctgactctcaacatctgttctctgaattagtgttactaaatttttttgaccacaatccacataagaaatatatttaagtctgggcacagtggctcacacctgtaatcccaacactttgggaggctgaggtggaaagatcgtttgagacaagcctgggcaacatactgaaaccccatctataaaattttaaaaatatatattttacatcatgaccttgaacatattatatacttatatgtgtatataactgaaactgtcttccagactcaatactaaaggcttcatgtgctttactcgagttttttgttttgttttgttttttgtttttttttaaacagtcttgctgtgtcacccaggctagagtgcagtggcacaatcactgcaacctccacctcctaggctctagcaattctcgtgcctcagcctcccgagtagctgggatcacaggtgtgcacaacgagacccagctaatttttttttttttttttgagacggagtctcgctctgtcgcccaggctggagtgcagtggcgggatctcggctcactgcaagctccgcctcccgggttcacgccattctcctgcctcagcctcccaagtacctgggac

SEQ ID NO: 19093 - DNA, 1027 bp, Homo sapiens
catgcgccaccatgcccagctaatttttgttttagtagagacagggtctcgccatgttggccaggctggtctcgaactcctgacctcaggtgatccacccgccttggcctcctaaagttctgggattacaggcatgagccaccgcacccagcctctcagtgtctttttatatcttttatataattcacccctttttcatattgaggaggaatttttgtgttctgaaagtttcccgtgtaacatgaaatgatactgacaggccataaagaatgagcttctgaagtatgaaaggtcctggacaaagcagtggccctgggtctgggcctgtatagagagtgttgcacatcactgaccgtgggtatctctccttcagtttgtcactgtgcagaccatttctggaactggagccttaaggatcggagccagttttctggtgagtctggaagcttcttcaggaaagaattataaattccagatgacagggcttcctgttgtgtgtgtatttgactgttgatgcagaagtagatttcttctttccgtgaagtttgcagatgtcctattctcatgaaaaaatgaaaggactttgaagaaattacaggaaagatatattagtgatgatgataaattcagttcactaggaacttactatttactagggagcttttgcattttaacttgtttaatccctatgagagaggtacaattaaccccctttacaagtgaagaaagcaagacccagaaaggtccttggctacatggccagtataactgtcagagactattccaacccaggcagtcttactgctgagtcaatactgcttctcaaccatagagagaaactgggtttcagcagagaaaaatgttctctcaataaaacacatcaacatttttttgcctctcctttgttcatttttctgtttcctttcgtcccatcttttagcaaagattttttaagttcagccgagatgtctttctgcccaaaccaacctggggaaaccacacacccatcttcagggatgctggcatg

SEQ ID NO: 19094 - DNA, 1035 bp, Homo sapiens
ggcagagcccccagaacgtcacccccaacccgaccctcttggggctgtacctcatgcatgtggtccctctgcttaagcaaactcaccctatttaggtccgtggtagtcaccacatgttgcctcaagtggacagctttggatggtttctccagggcttgaccgtgttctagttgagactcacctgccatcaaagaggcagctgctgatgagccctcagcctcggcattgctgggccatgcatgcagctttggggtgtggggcaggtcagggtggaagggggacacagcctgagcctggtggcagatgtggcttctcctcccggcaggggagtgaggaggtcctcctgcttcactctctctgccgccttgattctcatattcagcaaagtccccaggcagggggagtaacagacatttctcaaggcctcctggctgtctccttttcccctgagttagtgattctctttttgttttcctttaggtgtcatctgtacggttgatggagaggtcgattcacagcgcaagatacatttttgtagaaaacctgtatagaaggtactgtagtttgaatagttgataatttattaaaccactaatttttcaaaatgaaatagaaacttgtttattcgattgacagatatggagtacccgctgttgtatcagttatccattgccatagcaatgcggtgtaacaaacagccacgaatcctcatggcagacagctatctgcattcattgcccagtcagccagggtggtcaccaggcagctctgcttaccttggctaggctcaatgagatgtctggggatcagccgatgtaggatagcctaagcaagggtgactggaggtggctcatctcttttcctcttgcctgtcactctccttctgggaccagcaaaccagcccaggtgtccacttctcacggtgacaaagggtagaagcaacagcagagatgcaaggacatatttttcaggcctctgctccaagtttgctagcattccattggccaaagcagatcacatggtcacatgagccca

SEQ ID NO: 19095 - DNA, 1046 bp, Homo sapiens
agacagcatactgctgtcacaagtgcaaacacctggaaagaaagacaagtgtcactgccctaaccatggtccccactcctgtcattcacacaagttttaagtggtctgcccaccagattcctctcttgctagggtactcggattgctccctgtgcttcatctaatactaacatggagagacttcagagatcatcttattctcctcattgctaagttttctaaatacttgcctatagaaagagaaaagataatttaagtgagcagaaaaataataaagcagtgtgggctctgaaatccatacttgtttgcttttatctcttgacctgctcttgcatgtattcttttaagccctactgaggatatttagttattaatatttctaaccccagtgttcaactctgacttctctactgacaaactctacagaagaaaaggtcaaagttaacaccagctcaatattaaatcatggggactgtagctccagaaaactggagttaataagatgatccaaagtgaactctcaaaggctaggctacatctgcttaaagggtgagattctaaatagaccttaagaaagtaaaattagataaaaacaataactaagaacacgtgggggccttcagacactctgatggctatctgagagctggtgcctggggtgggagagggggatgtcattccttgcatgctgtttggtcagcttcttccagtcatcaggaagtttggcttcctggctccagacatggctctcacagtctccttttccacccagagtctcaagccactgcctcctaggttctgaccacactgaatacctcctaccaatcttttcatgactggcactctgtacactattggctcctctacctggaaccttttccattttttttcctttattctcagcaaacagcaattccactgccagagaggtagtttcctcttttctgcaccatgcagctccctgtcaacagcttatatacagcggtttccacttgtgtctcctgtgttaagctctaagcaacttgaggacggggctcacactctag

SEQ ID NO: 19096 - DNA, 1192 bp, Homo sapiens
aaacctcactttagctctaacattttgtgtttagccctcaccaaaaagcacttactgtggcaggaagattttgcagtaacatggagaaatccccaagatcaagtgctgacaaatgttgacagctttagcagcgtactgtgtaataaataactccgagggggcggcggggggtctgtgcaagaaagcgtcaccttatggacatgtggcgtctcattccccagaaaaggacagcatctgagctcacagtgttgatcaggcaacactgctgggctgggggtcggagttggggttagcttcctgcaccaacaccttcagtacgatctgagttgggagcagtgtcccaggctatgtggctgagcaccacgtctgcctcaggggctgaccctgctagcctgttaacaactcgtctcccctctgctcccacagagagggcagccaggccagctcacagctgggtgtgctgcctgtcaggtctgttgagtgtgtttgcaaagtcaaaattgggcttatctctctttgagagttccttttaaaatagggccacaaaggctcagccttgcattaaatggggcccacttggaaggaccatcctgagctttatcagaaatctcctgctgggaatcatgttacttggcccccaaaaaaggccatctttgaagtgagattgaaaacaagaacaccattcaggtgggcttgttgcccaagttttcccagctcacttcagtaaaaccacttgatcatctggtgaaagaggggggcaggtggttggcctcctgaggatatgttgtcagctgcaagaaatagttctgaagtcactgaaactaaatgcagatgaatgaccaaaaaggatgacacgccagagagtgacttaggagttaatttgcatcttcgtgatagactcttcagaattatttatgtccctgtaactatttaatatcctttgtgccgtgaggctcctcggtggttttgtaaatgttctccttgtatttaattaactcccactagaaccggaagtggtgctatggacgctttctagttgatgtaatgtgtggttgcacatgtcatcatgtatagaccacgtggtgacgaaagttctggagggaatagggttatccaaggtgaatatgaagacgcctatatttttcttatattgcctctatatgcaaacagaagacaatcgatatctgggggc

SEQ ID NO: 19097 - DNA, 1044 bp, Homo sapiens
ctcattgaccctccctcttccaaatcccagcagcactttttgtctcgatacctccctgggcaccgagccacgcacctggttagttctttttgtgtataatagcgtgtgttggctggactggaactgagaccttaagcacagagagtctccaagtgccacaaaacgatcagggttgagggagaagttgtctggcctcaccctgtttgcctggggcgtggcctttcttatacatgtctgtgatcctgacatgtacagggattaggggccctgaaagaagccatactcaggagaggagggcagcagacgagtgccagtgagagccctgcccctgccccccatgaggagggagtcgggctctggacctgactcatgttcataggagggtgtgaacccagtgcaaggctgaggttgagcccaggcttagggagtggggaggctgctgaggacggaccatacctgctcccactgtggagtctgcaggacaccaggtgatataagtcatgattaaattgggatatactcttcaatagatttgaaatgacctgtcatggaaataatgcatatattaggaagaaaaaaaatcagggatagatagatagatagatagatagatagatagatggatagatagagagaaggaatcaagaccaaaagaaaaaagcagcatatttgctccctaaggagcttgttcaccaatgcatccctagagttaggatcgtgcctggcatgtagtagatcctcagttaattttagctgaataaagggatggtacttgcctaaatactactttaaaaaaaaaatggacttttaaaacataaaggcaaatgtccacacccacctcaggaactttttctttttttaagagacagggtctcacgctattgctgggactgtagtgcagtggctattacacagccatgatcatagctcacggtaggcagcctcaaactcctgggcacaggcgatcctcctgcctaggcctcctgggtagctaggactacaggtgtgcaccactgtgcccagcaacctcagtcactgtttaga

SEQ ID NO: 19098 - DNA, 1047 bp, Homo sapiens
gctcaactaatcactgttgactaattagtcctgctggccagcccaggtggctttagctcctgagggccatctctgcccttccagagcaggtaattttctattacttctttgctaccctcaggtcctagcttgggcactgctagagaaaagcaatgaaaccaaagatcacatgcaaacaccttggttgcagattgaataatttacacttgcaattagctcctttgtttcagaaccaaacattatttgctcattgctcgattgtcttaagggagaggagggtgatattttaagtttatcatcctcatgggatggcctcccttgggaggggaaaaaactcatggattatttttcttagaaaaattaagatattactacagctagatccctttgagaatgagcagtcatgttgtgggctttgtcagagtctcagcactggctaccccaggtcttgtattgctttccttgaagagaaatcatacatggtgatttttcccatggtgaaaggggtgggaagactctggataagtcatatgttaggcatcttatctaggagaatgaggtaggggaggaactagctttgggacctggccacacgatggaggtgctgcctgcttcctgagtcggggtgtgaggatcagagatgtttggactgtgcctggtgcagagccctgtagcttccttaccttattgatgctccctaaatggaagccgttgttattcggaggtgcctggcattgcagaactatttgcccccgtttgcagaccatataaatggcttctggcctgggaacttatgttttaaggtgatctgttgtttagcgtgtgtataaagagtggcttaaaactccccatctcaacaccgtgaaagatggtgcggagaggcttcgtgcctcttctgtagttccggctccaggagcccatcttaacatcccctgttggttgctaagagaggagctggcttcggaagcacagtccctgctttgctctctgctgccccctctggattctctgttctgcacattctgaggtcttccagcagccgttaac

SEQ ID NO: 19099 - DNA, 1051 bp, Homo sapiens
agggagccttggaagggccaagcagctgggcctcaggaatcttggggactcatgaatccaaagggactcagcttttccatctatctggtcaagtgcagcctgtggcccctgggtcccaaaggcctatgtcctcccttcgcagaccagactgtgacccaactgcatctgaaagagaacttggctctgcctagctccatgctagcctcactagcctaaagccaaccaagtgcttcctcctctgccaactgggcatgagagggatctgcccaccaagcttgtctggcaggggctgatgagcactggctgccttgctctgagaacttgggggcaaaaactggctggtggaatgcagtggccatggccccattgtggaagacagcacatggcactttgtctcagataaccaaggactggccaccattgacctcaaagaatcccacgaccaagactatttcaggacctgagcggaagttgcaaacatgcaaaggaaggtggtgttctcaataaaatgtcaatcccctgtttggttactgccaagaagagaacactggctgaggaaaatactgtgttttaaagtaagtaaactgcaaggagtatgtaaaaaacattgctgtctggcttgtttgcagtgggaaacacaatctcttgctttaaggaatgccatattaagaggccctgtggaacaaaccacatttcactgttaagtagctgcacaaaagtacagtacaacattgtgaatctgcagtgtgcacactgaggcattttctgtaaataatagtataacgtgggccgggtgcagtggcttatgtctaattccaggactttgggaggctgaggtgggtggatcccttgcatccaggagttcgagaccagcctgggcagcacagggagaccctgtctctacaaaaaataaaaaaattagctgagcatggtggtgtgagcctgtagtcccagctacttgggaggctgaggtgggaggattgcttgagcttaggaggttgaggctgcagtgagctctgattgtgccactgcactccagcctggatgacag

SEQ ID NO: 19100 - DNA, 1094 bp, Homo sapiens
gagaaaagcccacctttgaatacgtggctgaagataacagccaagaattggtctttcctaaaaatgcaacagataatgctgctagattgttattttgtttgcacttttttttgattggcattttaaaatcggtatttaaactgaagacattgtcatgttttattaatttaacaaagttgaaagtgactgctctgtacatcatgaccttaacaatgttaatgctgtaagtgaaagttcactgtcgtctgtatactaaatttattggtgtttctaacttaaaagtaagactgcagattatcccccaccagccttagtccaggggtgtggctctgtccgggtgcagtatgcagtcatgtggaaccttgctttctagtcctgggaaaaaaagatgtctctaattactggcttcaataaacacgaatccagactgcttacaagttttggtggctttctttatggtgaatcatcccactggagatacattgaattttctgctaatcatatggggtatctgatcacataactaaaaatgtttacctgtctcacttgaaattgtcagaaattctggaaagaataacattgtaaagccatatttattttatcttattttttagagctgggggttgtcaagtctggtcttgaactcctggcctccagtggttctcccgccttggcctcccaaagtgctggagttataggtgtgagccaccacacccagcctggtttttttggtttttaaaaattacaaccatcctcatgagtatgaaggtggtgggtatctcagtgactaacgatgttaaggagcatcttttgatgtgtgtattggccatttatatatctttggagaaatgtctattcagattctttgctcattttaaaattaggttatttgccttttgtgttttttgtgtttgttttgagggtcttgcttgtgtctcagcctcccaaagtgctgggattatagacatgagtcactgcacccagcctatttgactttttatcattgggttgtaagagttatttatgtattctggatactatactcttaacagatataactctttccttttgatatgctccccttaatctctgag

SEQ ID NO: 19101 - DNA, 1025 bp, Homo sapiens
acctctggttttaccataatgcaatgtgccacggaaagtttgggggaggtttttaatgtaattgcactctggttaattggctcgtaccaagccctgccttatgacttgtggaaagcttcaaggagttccactgatgcaaaagggtcttttcctagcttcctggtctgatcagtgctatgagatggacagataagtgtgaatgttttatacagaaaatggaaatgatacatttctcttgttaggtgttttcataaaatgtagcattttttttcttatggaaataagagtttcaggtgtctccccacctagggcaaattcatgcacattgtcatgttataccaccattctggaaatgatttctgtggatttgaaattgcacttttaattttatatatgacagcatttaaatgcaaacactaccatgaatttaatgtataaaatgttgtcaaaccaagggaaaaaaccacagttcaccatgtggagtttactttttttatatgaatgtttgttgtactgtgtctaagcataacttccctaatgtcattacttttacataccagatttgactgaccactaatgtagtactggggataacttaatatcctatgttgtgtcaagactctttgaagactttcttgaattgctttcgtaaaggtctgaacactgttaaggagaaagctgagtatcaacttgcctttctgatagaaatgtttcttgtgccagttttattgttgagatatactatttttttccttttttaattcagttttttaaaaaaacaaatgtattgtggcttccagttaccaggttgtctaggtaatgacagtaaactgactgtagaatgataattgtggtatagtgaccaatagatgccaaacagcttgtggcctcactaaaggtggggtcgcttagtccccgggagtaaaatgagtgacctcagaaacaagaattcctggaaaggcacatgccgaagaggaatatggtataattttaaattttaatgcaaaattttaatttgtctttat

SEQ ID NO: 19102 - DNA, 1026 bp, Homo sapiens
tcccagacctgtgttgaagcctgagcctcggactctcctttcggcatgaagtttgacagtggttaggagtattcttggcctgtggccacaaacatgtatgttgtttcacagctggtccacgacaaagagttggcagcagaagatgagcaggtgttcctaatgaagcaacaggtaagaagaccagtgaggttagaacagaggccttctcatgcatgaaatgccagtccctagggtggggttgggggtgtctgcatgtgggaagtcacaaagagcttgcagtggtagaggggttgagaccaggtctcctcattccctccttatttctaggattagttggggatggaccacctccttaggagatcacctacctgccttgcagactctcctacaggaatagtaggattcgcatcttttaagtgctctttctttggaaatgtggttttctggcataatacttcctatgttgacagttaaccaagtaacctgaccacacttccattatttcatgtagcctcacacagccctgtacataaaggcaggtgatgcctgttttgcagatgaggagagtaacttccccaagctgacagtttagaatgcagacttcccatttctgtcacccagattattgttagatgtgtcctgggtccacctatcatctgcccagtggtacaggcaggtcagcaggaagttttgatggttctttttccaactgtttccttctttttccatctttttcctttctgtcctttgcttgcttccttagcttcaaaactggttacttggagtattttttttcaccatataccaaacggctcaattaaaattttttggcatctgtggtataaaacataggacttagttgttgttaatagtgccctctagtggagtacttggagtaagtttttctctagaccttcagtgctctctgcaggccttggttaatagccagtttgtccctctctttgcagtcactccttgccaagcaaccagccactcccacgagagcttctgtgagtaccttacact

SEQ ID NO: 19103 - DNA, 1079 bp, Homo sapiens
atatgtttatgttttgtgctgtccatgatagagaggtggtgtctgtagtcttttgagtcctgttaactataaaaagccaatagcagttggtgccgtggttccacaccctggggtggaggtgagagatgagttcctgccatcttttttgggatggcccattagcctgttggcacccatccctcaaaagatgggtttaatgataaatttggtcgcatgtaggcatctgtctgggaaggaatctgtgtaccttgatactctgagagtgttttcctgggctaacctcagagccaatactttacttctcaggaagtaatctgtgggatcaagacaacaatttacacgttaaaaaataaactctacagcccactagcatcaacatagctttatgcttttgacttcattcatctgctactatgacctttttacttttttatttatttatttatttttaccagtgtgcagtatgcctatgtaatactataagcgttttagtttttaaaattgtaatgctttctgttgctcatatattgatcaaaaactgatcaacctatgagtagtactttgaggttgtatgtgttcgattttgtctcctcctgcagtgaattgatttttcttgagcagattgattagatggagctgccttgatttacacatcagtgaaagaagagaaaaacctcgacttgttgtataagtatattgttcataaaacatacggtttccacttcaccacacctgccttagttgtggaaaaggatgccgtttttatgtgagttattttgagctgatgctttgaaactcttctttttaaagtacatttgctttttacattttaccccttcaaggaaggtgccttctgtctgtgtcttctacagccagctctctcactgcaccttctctctgttcctttccggattatgaggcatctgcctgagggaagtgggtggtgtggtcaggggtgctgcctttcttcctcgagagcaagttgccaaaacctaagccagccatttttggcactcactgtcaactctggtaaaatactggctggggagggaatatagggaattgtgcttgggggatcc

SEQ ID NO: 19104 - DNA, 1057 bp, Homo sapiens
acctaaaattaagcttgataatggaatgtatgtttttccttcggttactctccgctctttcccttttccatcccctttccttttatttttctccccgctctgcacctgccagctggcccccaaggaaattaagggctcctcttctggtgtgaaatgctggctccctgaaaacatcattttaaaaagcatgttaataaagcaaagccaagtgtattatgcactgcggtcaagagcactacttcacagtctttagtcttcggaggaggagggggaaatgcaggatatttatgaggattctggggtcttccttaaggctagtctttcaatgcagggcttgagtagggttaggccaagttcatgatataatggtccaaggttggggaataaattagaagtaccgaatgttatcttctagccttgggtccttgggtgggtttcttaaattttttgagcttcaggttcctcatctgtgaaagggttagataagattcagtgagataatgtgtgactctggcacatggtgagctctagataaatggcgcttttgtgtccatcagtctcattcccaaagcctaggctttcgggtcggtcatccggctgcccgacccgcgacggcgcaggggaatcggcgagcgtggcggggtgctgcgctgcgcccctcagccggcagaggccgccagcgcgccctcggtccggacggtgcccgcccctgccaccgcctccccgcgcatggctgccccggcggctgcctgaccgccgcccgccacctcggcggcctcgcaacccgtgggagcccgtggccatcgcagacctagaggacacgttgggcggcgcagtcgccgcggcaaggtcggcgggcggcgcggcgcgagggacggcgagcggggggcggcccggcccgggtcctcgcgggtcctcggcgggcccgggggagggccctctttgtggctgcagttggcaagatggcgccggtgggggtggagaagaagctgctgctaggtcccaacgggcccgcggtggcggccgccggcgacctgaccagtgaggaggaggaagg

SEQ ID NO: 19105 - DNA, 1047 bp, Homo sapiens
caaatccaaattaaagcctgattcagaataatttattttaaactaaaaccaagtagtctcttgtgccaaagtagcaaaattttctgccaattcacagaaaagggcaaattattatttattcagatgcagtccagaatctaagaagaggtacagccagatggatggactggatgacttaactatagcagaaaaaagtataaattgaaggttttctttgtttttttttttttgttttttacttctgtgcattctgtaatcattttgcacagtgccattatatcccttcacttccttcaggttttattcaaatgctgtcttctctgcgatgccatccctgactctcctatttaaaatacaaaccccttctcttgtatttatatctcccttatttgctttttctccttagcacctatggtcagttgacatactacacattctatttatttgtaaataaattctctctctcttgctgctaaaaagtagcatgagggtaagtggatcttcttgtcttttttccttactgtatccctactgcctagaacagtatttggtgcacagtagtctcaaattctatccagtcggctgagcgcggtggctaatgcttgtaaggcctccgctttgggaggctgaggtgggcggatcacttgaggtcaggagttcaaaaccatcctggccaacatggtgaaactccatctctactaaaaatacaaaaaaattatccaggtgtggtggcaggcatctgtaatcccagctacttgggaggctgaggcaagagaatcacttgaacttgggaggaggaggttgcagtgagccgagatcacgccactgcactccagcctgggtgacagagtgagactctagtctaaaaaaaaaaaaaaattctatccagtccatgaatatttgggaaagaggaatcttcaggttatagaagatgcacaagtttttttcttagtagtttttttgttttgagtaaatatagcggtctggcgatatttaatatagatccttcctaaattacaaatgcattcagaacaaatatacctttct

SEQ ID NO: 19106 - DNA, 1040 bp, Homo sapiens
tattagccaggatggtctcgatctcctgacttcgtgatccgcccacctcggcctcccaaagtgctgggattacaggcatgagccaccacacccgccggtgtttcccaaacgtttttagccaaggaacccttttctctcagaggatcttgtgaaattcacatgctgtggtacacaatttgggaaagaaacattgatttattagcctatctttctttataagttccatctgattttcttcctccaggaaggccattacagtctgtaatcacaatatagtttgttttatactgtgaatgaaatatgcatgctattacaaacaacttttcctttatagtcagtaagctttacttttttttcctttattctgttcactttagtttcttccttcaaagaagcagtatcggcaaggtaaacaattagagaatatagttggatgtgagcatctaatgatgcccctgtgttttgattgcttgaaaagctttgactttaaaaacgtgtattatttctctgagaaaaaagttaactaatttttgtaatcttgtaaatcttcatatgtttggtagtttaagaacttagaggtgtactgtctgtgtttatacattgcatcctgtattaaagctaaatcttgagtaatgttaatattcattctggttaacaaattttttttttttgagacggagtctcgctctgtcccccaggctggagtgcagtggcgcgatctcgactcactgcaagctccacctcccaggttcacgccgttctcctccctcagtcttccgagtagctgagactacaggcgcccaccaccacgcctggctaattttttgtatttttagtagagatgggatttcaccgtgttagccaggatggtctcgatctcctgaccttgtgatccacccgcttcagcctcccaaagtgctgagattacaggcatgagccaccacgcccagcctaaaaaatcttacaaaaccatgttagtcaacttagtgaaatgacttttagcttagtgattaaccactcttgtacaggattatagatgt

SEQ ID NO: 19107 - DNA, 1030 bp, Homo sapiens
gttttggctctcaggtattggttcgtttacaattattgatggaaatcaggtcagcggagaagatgctggaaacaagtatgttctattctcttcaaatatattcacgttaaggaaggcaaggcctgagtcttagcttcacctcctcagtcagggtgactcgactctcagtggaaatcatccttatgtttgggattatggtgaggaagtgagataatataggtaaagtgctagtacagcatctggcaaatagggcattaataaatgttacccatcattactgtctttattgttattaatacaaaggagtagtcgttattcctttattcatggaatatgggcacttcctaagctcttgtattgatccgtaggtgttagcatataattaacaataatgcctgttgtttgtgatgtcttttaggcttagtctaggggtatctctctttacagtgtcaacaaaaatgctgttttaaagatggcctgtatattattctttaaagattatatttagactttcagaacatgcccaaatttggatttaaagctcaccttttcagggacttgaagtctggtatctctcattgtgtttgtcagtaacaacaacagtgagtaaatataagggaaaccagcaattagttcatatttagttttgatgccttttctttggatcgtagtgccagtttctgccaggcacagcacagcttttttattgatatataccaagaagtcttgttatctttgcttacttggtgggttagagtagaaagtgataaaaataaggtttcttcttatggagccagtgagcttataccgaaaagtggcatcctgactctgatcagcagcctcatatctgggccttgagacatgtcaagggtatgtgtgggaggaagcctgaataaatctgttacagttacgtgcaaaaacaaatggttcaatacaccgagagtggtctgtggaacaccggttctagggaacgataagagctgttaaatgggccaatgggttccatagtgaaattagtttgggaaatgga

SEQ ID NO: 19108 - DNA, 1094 bp, Homo sapiens
cagggccatcgaggcaggagaagggggtaggctaaggtcggggcatgggtcaggcccttctctgagctaacaggaagggaagcttctctcagcacctccagtggggagggatttggggaacaggccccaggcttaccctcctgcttccccctcagtccctcccagtttcttgccacccgtggccaagcggaacctccaccaccctcttccccagacactctcgccctgcctccccggatccgaccccaggtaggagggactgtgctgggcctccggtccaggtggagtgggatagaaagaagcctctaccctggcgctcgcctctgcttcttttggcgatgtggggccctcaggctcccccgtgtctctgcagaaaaagaggaagaggcgcgtgtataaagtgcgaacgtctgagacctcggatccggcgtcgggtgagcgcctctccctgtccgggtcctgctctgggaactcgagggaggggaaggcagagccacaagcgagccgcagccactgggctcatgttcccttcccttgcgcagggcctagggcccccagccgccgctccagctcgtcgacggattccgcggacgccagccctgtgcacgccgctggccctgccggcgcctaccactcggcgtcggcagagtccgtggacgagattccagtggcgcagacgcgcctgggcagcgccgctctggccgccccgcggggccggggccgacagcccacgctggcgcggcaggcgcgtgcgcccgccgttttcgtgagcccgagcagcggcgagcccagggcgccgggcggccgggaggctggtctggcttagctgggccgagaggccggagggccgagttagagcggccggcctgactctctatgcaacaccccatccttgccgcaccgagtgcactttaggggcccctacggccggcgggatcggcctccctcccccacgactcagcaatacccgccccaccggctgtgatgctccaataaacttttttatgcttttgcggacgtcgcgcttactttcttaatggcaggggccacgggccatccagaagcccgaccctggccagtggaccgggggcggg

SEQ ID NO: 19109 - DNA, 1067 bp, Homo sapiens
cagctgggattacaggtgtgcgccaccacacccgactaatttttgtatttttaatagagacaggatttcaccatgttggccagggtggtctcaaactcctggcctcaagtgatccgccctcctcggcctcccaaagtgctgggataacaggcatgagccacagcacccaccctcatcttctatttattttattttttgagataggatcttgctctgttgcccaggctggagtgcagtggcatgatcatagctcacctgcagccttgatctcctgggctcaagtgatcctcctgcctcagcctcccaagtgtctggtattacaagtgcatgccaccacacctggctaatttttttgattttttaatagaaatgaggtcttgctatgttgcccaggctggcctcaaactcctgagctaagagagcctcccacctctgcctcccaaagtgctgggattactggtgtgagccaccatgcctggccctcactcatcttgatatggaggagaaactaagtctcgagaggtggtgtgctgaggccatggacagagctcagaaacagtgatatttctgttcactttccactctgcacagggctcttcaggacccagaagtgattgaatacagatactgtcattagcagctcactggagcacctgctggggactgcagtggacaggctggcagggttacccaggcatcatggctgcctcaccagcaccagaccagccacccggggttgagaagccatattgttccagcaggtggcaccaaagggcgcagcagaggggcagagttggctagggactctgaaggcttcttggaggaagtggcttcctaaactccaacccaagatgtctgtgggcccaagctgagttttgaaggcacagggcaagggagggcctctgggcagaggaatacagacggccccacccccaccccacaagggcctctttggcctggcgggcagccggccctccactccccagctgtcttcccctggagggagatgctgaccagctggaaccttattccctcctattgaggccaaatgaggggaggaatggtgg

SEQ ID NO: 19110 - DNA, 1032 bp, Homo sapiens
ttatagtagtaaacaaaaacccagggaagtttagaaacttcccagatcatctagcagtgaagtgagagagccaagatttgagcacaggaatttctggctccaaagcttgagtccagcaccagtaattgactcttcctgggtagtcagttgtcctggggcccatccatcatgtgggacatcggccatttctttttctttttcttttttttttttttttttgagacagagtttcactctcgtcgccaaagctggcgtgcaatggcgcaatcttggctcaccgcaacctccacctcccgggttcaagtgattttcctgcctcagcctcccgagtagctgggattacaggcatgtgccaccacgcccagcgaattttgtatttttagtagagacggggtttcttcctgctagttaggctggtctcaaactcccaacctcaggtgatccacccaccttggcctcccaaagtgctgggattataggcgtgagccaccatgcccagccaagacattggccatctctatgaagttttcttagtttttgttgcaagatttattgtctgtagttactattgtttctgctgtaagctggcccctcctgagcctgtgtgaacagaatccatcttggtccatcagggtaagctgcaccctgcagtgagccatcagaaataatctgtgtcttaaccattacctcatctgaaaacattcagaaaatgtttgggggcctgagggaagatgagcaccatggttactgaagatgcacatacctggagaaggcacattcttgtgaccggttgccccaggtcacaggcatccaggcctaaggctgcccctccaaccaggaagtacctgtggagtgccagagtggagcctggatggctgtggaggagaagcccaggtgcacacattgcccagatgggcttcaactagaagggtaagcacatgaattagtccagcccaagacttggtatccagttttccacattgcatgtaggctctgtgtaatgctttcagtctcgtttcctaacccacccct

SEQ ID NO: 19111 - DNA, 1092 bp, Homo sapiens
tcgattccctccgcctcagccaccaccgccactgccgccttctgactagtgttgctataaataaggctggcttattcctgaatttcaaaaaagtggaattctacagtatgggtcttctgtgtgtgggcctgccatctttcactctacataatgtttttaagattcatacaggctaggcgaggtggttcattgtaatcccagcactttagaagactgaggcagggggatcacttgaggccagcaggttgagaccagcctgggcaacacagtgagactcacatctctacaaaaaaattaataaaatttttaaaaagaaaaaaattcattaatagttaattcctttttactgttttactgtattccattgtgtgacatcataatttatgatgtgaacatttgtttctagtgtggggccattatgaataaggctgctgtgaacatttgtataattttttttgtggacttatgtttttattttcttagataaatatctataagtggagttgctgtgattgggttgatatatgtttaactataagaaactgtcaattttccaaagtggttgtactgttttacattcccaccaagaatgtatgggagttccatttgccgcatatcctctccaaacttcaggattgtaagtcttttttttttttttttgaaatggagtttcactctgtggcccaggctggagtgcaatggcgcgatcttcactccctgcaacctccgcctcctgggttcaagcaattctcctgccttagcctcctgagtagctgggattacaggcatgcaccaccacaccaggctatttttgtattttcagtagacatggggtttcaccatgttggccaggatggtcttgaactcctgacctcaggtgatccacccatcttggcttcccacagtgctgggattacaggcgtgagccactgcgcccggacatttttttttttttttttgagatggagtctcgctctgttgcccaggctggagtgcagtggtgcgatctcggctcactgcaagctccacctcctgggtttacaccattctccttcctcagcctcccgagtagctgggactacaggtgcccac

SEQ ID NO: 19112 - DNA, 1035 bp, Homo sapiens
aggggcacttgctggccttcctctctctccagcagtaaggtctggtcttcctacgactcttagcaggtgacagtaatttgtggcacttccaaaggcagctgtggggctggggcgggtagggtggtggaatgaagatagctccatggctcaactggtctaaaccagctgtgtgtcagctggggtgcagagtgtagggaattgttcctgaactgtgagggaacctagtccttgtacatacccatcagagatccctgaggaaagttagtgccctaggggaactcatctgctactatctagggcacccccaagccagagaggtgagctttgtggggtcttctcttcttagaaaaggatggagttttctggccgggtgcggtggctcacacctgtaatcccagcactttgggaggccgaggtgggcaaatcacgaggtcaggagatcaagatcgtcctggctaacagggtgaaaccctgtctctactaaaaatacaaaaaaagttagccgggcctggttgcaggcgcctgtagtcccagctcctcgggaggctgaggcaggagaatggcctgaacccgggaggcagagtttgcagtgagctgagatcgcaccactgcacttcagcctgggcgacagagcgagcctccgtctcaaaaaaaaaaaaaaaaaaaaaaaaaagaaaaggatggagttttctgcttgcttagttcaaaaaaaaaaaaaaacagaaaaggatggagttttctgcttgcttagttcagggcatatcctcacctccagccatcccgcacctgtactccagtctctattatgagtcatcacaggcctaatcacatgcagggcctccacccaggatgctgggagcctggcctggctctgtgtgttctggttaggttctggaaggaaggaaggtttgctgactctggtggctgctttgggatcccaaacaccccagtgatgccccaggaaatgcctttgtgatcttatgggcctctgaagcccagaccatagcacccagggtcctgttaaaacctccagtc

SEQ ID NO: 19113 - DNA, 1050 bp, Homo sapiens
gtcactccttctgggaacaagcctctgctcccctggcatgattgggcactctgtcagccggtgcctgactgaggctggtagggggaagaaaccaactgattgtcaccctgtagttcaagcctatagggtgcctccaggcagccctgcctggaaaagggctcatgacacaggagggtctctgaattagctggagcagctgttcagcaccagggctgtgggaagataggttgggtttgtgtacctggtgctgccttgcccctctctgcctttctcattctgttgtttctcgttccgagagacccctggcacatggcctagatgggagtgaaggagtagacgtcccaggccttgtagttctgagcagcaacaggttttccagggccgtccagaacagagggtggtttggtatttgggccccagaggtacttagctggtgattcaagcggtggctaatggtgtaagtgctgcaggacgctgtggtccatgctgagaagcttgtttcagataatttgctctctgcttccctgccactcctccctgggctggcagcaccctcggccctatggccagcaagtgcgtgttccttttctgtgggcctcctccctgacccacaggagacctgtatcaccccggcacaccagggctgctcagcagccttttcaagcgaggcagctcagccagacctaaaaagtcttattctgggcatgggattcctcctctatactgtcctgttttcgtcttccaaatactagcccccagcctctctcacagaagtaaacattctaagactggatttttcagggcaagttaagtcctttgatagaaaaggtttcatcgacagcagagggccagttctgaaacctgagtttgtcagtgtctgaaaacagagattctcaattgtactgggtgaggctgaggccacattagggtgaagcagagcggagaccagttcccattcagtcccctgccttcctagtgccagcagaggatctgtatcccgagaccctgggaatgtggggatgccactccgggagctcctttcgagaaggg

SEQ ID NO: 19114 - DNA, 1035 bp, Homo sapiens
tccactcagattctcaagtcgaggcaggggtttgtacagaggctcccgagccatccactaataaacaccatcttacctgtggagcagagtctgtaggaaggtgttgagggctagctgctggagaagggagaggcgtctcctgtggggaggcctaagcaagttgtgttttgagcacaggtgctttagtgattccccattcccatagaatgttgtggaaccagagccctgttgcagcgaccaagcataactcttcttgagtgacctttgacctccccgtttgcacatgtgctccaaacataaacccttacctagtgtcaggaagcctatgtgctggggatgggatgacatgtggtgttgggcatagccccaggcccctctgaacagggcatggtgagtggctgttgtctaaatcagggaaagccctgactgttgcacttgtgcctgttggactgctgactgcagggcagctggggtcgtttgctgcttggtcagctgaggtactgaaggaatggagactgacttttggcagcctctgccatgtaaagtcaggaagctgattatttgggctgcagtttttctggaaaaatgtgcaagttttaatctaatgggaattctgccagcaggctaagacagcttctgctcctgatggtccttgaagctagcccctctggcaggaggaggcaggcagtttgtgtgtttctgggaatgactgagcagtcctgtccagctacaggctatattggttcatgtctttgacctttaaggatccaactctgtctcaaatgctgcttaaaacaaagcagaagacaagttcccttcgaactatgaaactccctctttgaagtgctgttccttttgctttgctcctttcccttctctacctttttccctaagccatgtgggccacgttatcagggccatatgctgggttgtttcctttccttgttcctgcccagcatgattgggatagctgatttcagaggcaggtgagtaggtcagagccttccctccctgcctgaccctttattttggtag

SEQ ID NO: 19115 - DNA, 1036 bp, Homo sapiens
gttaagggtagtgtctgtgtaccaaaggacatttgtggtgttcacacactgctatgcttgtgtgcttcagctccgtaattacacagggccatagaggtggaggttagacccctgtggggtctaatgggaactctctcaaattaagctggggcattagtggctacaccctccggttacgggcagtgcctttgggtttttgaatgtggcaggctctggaaagtcaaggtttggtacttgagactctgttagtacattagagaaggagctcagaaccaaggatgtgtaacctgcctagggccaccaataggggctgttctgccccttttgtctggtaatctctcggggtgctttgatagtgctggtgacattgggcacatgagggtctcctgacccatacacagaaccacatttctccatacgagcaccctaacttgaggcccctttgctttctggcctattctttttttttttttttgagacggagtcttgctctgttgccaggctggagtgcggtggtgtgatcttggctcactgcaacctctgactctcagttttaagcgattctcctgtctcagcctcctgagtagctgggactataggtgcgtaccaccatgcccagctaatttttgtattttgtattttatggggcttcaccatattggccaggatggtttcgatttcttttttttttttttgagatggagtctcgctctgtcacccaggctggactgcagtggcgggatctcggctcactgcaacctctgcctcccaggttcatgccattctcctgcctcagcctcccaagtagctgggactacaggcgtccgccactacgcctggctaattttttttttgtatttttttttagtagagatggggtttcaccgtgttagccaggatggtcttgatctcctgacctcgtgatccgcctgcctcggcctcccaaagtgctgggattacaggcgtgagccacggtgcctggtctagcctatattttttgaatagttctaaggcccaggtcactcatctctgtaat

SEQ ID NO: 19116 - DNA, 1050 bp, Homo sapiens
cagccccctctgtccactgttgccctcagcttatcttcagagcctgcagagcctctgttggtcaggcatccccctaggccccggaccaccggccccaggccccggcaagatccccacaaggctggactgagccactatgtgaaactctttagcttctatgccaagatgcccatggagaggaaggctcttgagatggtggagaagtggtgagtcctgggcacatggggtagggagaggaacccctcgggtcatgatcagactgttcagcctgctctatccccaccttcttgacagcctagataaatatttccagcatctttgtgatgatctggaggtatttgctgctcatgctggccgcaagactgtgaagccagaggacctggagctgctgatgcggcggtgagaaggcggaaggtgtgggggtgctggctgggggagttttggtgctgattctgcctgtcccttctcttcctccactgcaggcagggcctggtcactgaccaagtctcactgcacgtgctagtggagcggcacctgcccctggagtaccggcagctgctcatcccctgtgcatacagtggcaactctgtcttccctgcccagtagtggccaggcttcaacactttccctgtccccacctggggactcttgcccccacatatttctccaggtctcctccccacccccccagcatcaataaagtgtcataaacagaatattctgcattttggtgcatgtcctggggccagccaggcagggactgattcccccccacaactccccagcacagtctggagaatggcatggattcagacaaacacttttatattaaaagctaggggttagcaggactggagtacgcaggctgcccacaagttcctagcttgcaggctctggctctcgaggtcccacacgcctgatgtcaatcacctgaagccgctccagggcagtctggaggatttccaccacggcttcttccttctcgtcaccctcctctggcatttccgactcagggagctggaaggcctggctcatgtaggtgttcactgt

SEQ ID NO: 19117 - DNA, 1078 bp, Homo sapiens
ctcctgacctcaagtgatccaccgcctcagcctcccaaagtgctgggattacaggcgtgagccacggcgctgacctattttttatttttttttgagacggagtccccctctgtcacccaggctggagtgcagtggtgcgatctctgctcactgcaacctctgcttcctggattcaggcgatcctcctgcctcagcctccagttgctgggattacaggcacgtgccaccacgcccggctaatttttagtagagatggcgtttccccatgttggccaggctagtcatgatctcctgacctcaagtgatcccccacctcagcctcccaaagtgctgggattacaggcgtgagccactgcgcccggcctcttttaggtactcgtaaaaagaaaaccaaaacgacaagtttcactttccaaataagaaataaaaccctccttatccatcttcttgtttcagacctacattgccccaccagctgccattttttacccatcgggtgctcatgacacgtcgaatgccactttgaacaatatgcgtgtgtatgggaccattttcctgaccttcatgaccctggtggtgtttgtgggggtcaagtatgtgaacaaatttgcctcgctcttcctggcctgtgtgatcatctccatcctctccatctatgctgggggcataaagtctatatttgaccctcccgtgtttccgtaagtaacccaggaatttatctgggcattgcatggacatccctcccatgtagccagcctttgatgccccagatcccagagactgcagggtgggcacaggcaggggctttgacctgagcaggtgccggtgcttctgtccctcacagggtatgcatgctgggcaacaggaccctgtcccgggaccagtttgacatctgtgccaagacagctgtagtggacaatgagacagtggccacccagctatggagtttcttctgccacagccccaaccttacgaccgactcctgtgacccctacttcatgctcaacaatgtgaccgagatccctggcatccccggggcagctgctggtgtgctccagggtgggtcctccctcccgtc

SEQ ID NO: 19118 - DNA, 1075 bp, Homo sapiens
ctgggattacagatgtgggccactgcacccggcctttttttaaaaatgtatatttttatcatttcctttttttagtagagacggggtctcgccatgttgcccagactggtctggaactcctgagctcaagcaatccactcaccccagcctcccaaaatgctgggcttacaggcatgagccaccacgcccagccaagattgactctttgaaagaatttcttgatccctgttcccagattttcaccagagacattgtctcagcagcagatacaaccagcaacatgagatgactcttgtccccctgtgcttgtcaccctggggcctggtcatgactctctgagtcttttaagggtgttagactttgatagaagcacagattcagggcagggagccgtggacactcacctggtggcaggcactgtgcggggccttagggccaaaaggctggatgagacagtccctcctctggtctggaggagtcagactaacaaaggcacaggcctcaggagggtgaggtgggctgagataggacacacccagccagaggaggctgtgggctgtgcacagggcattggaggatggtggccagtcagccactgctgcagactagagctgctcccgcaaagcagttatttccacgggccgtgctggacattcgagtcagatggggataggatcgaatgtcagcctagatgcttacccaccgtgcagccctgggtaggtctcccagcccctctactcatccacaaacaggaaaagcagtccctgtccctctgggtggttgtgcaggcttgtcacagggagaccccttgaagaagaaccagccttgacctgtgcacactttcatttctctgctgtagctgggggctcctatttcatgatctctcgttcactggggccagaatttggaggtgctgtgggcctgtgcttctacctgggaacaacattcgcagcagccatgtacatcctgggggccatcgagatcttgctggtgagtcaggctgagccctggccaactctggccatgtccaaacagtccctttggactccaaacagaaggctcaggctgttcatcc

SEQ ID NO: 19119 - DNA, 1029 bp, Homo sapiens
ccgccattgcaggtcaggccgcgggcggggggcacgggaggctgcggggagcgagggccgagccgggattgggggcgagggcgcgagggagcgggaagctagggagccggggccgggcggggcgcgcggctcggagagaagaatggcgagccgaggggcggggagcgcgggcgggggaggggtggccgggaagggggagggcggcgggagggcggcgcggaggtgggggcaagcccggaggggcctccggggtgggagggccaggagtgtgggggaagggagcggtgtggagacggaaggcggagggaaggaagggagcgagcggggcggagcgggagaagggcggaaagggtggccgagcgcgggcggaggacggagaagggggcggcgagggccggaatctcgaggtacgtgcgggaaggggctcttcccggggttgggagggagcccagcccgctatgcttgcgggagcggagtagaactggaacctaggaagtagcgggaagagcagaaaggggagttcggggtgggggttaggaccgtgaggttttgttccaggtaacatttgtaatcgtggaggggggaggcttctgggagaggtaattggaagggtggttggagagtcattccaggttcttttgtgggagggaagccgagagacgagtggggtggggtcctggaggagtggagtacttgagaaccgggaacaatttggagaacgagggtggtagagaaaggacgtttaaagagtaatctttgggaagagggtgaacggtttggaagaccactccagtgggtggtgtggaggaaggcggtttaaagaatagtttccctgggaggcaggaaaaggggttaaaacagcttgtaatttggaggggggtggagaagaggggggaagcggattgagaagtcccagaaagtgggtgggactagaaataggaagtgtttgtagctctagcagaaagggtgggagggggccgagagggagtgggtggagaagatgggggtgggtgggaggaagagcacaga

SEQ ID NO: 19120 - DNA, 1052 bp, Homo sapiens
acaactggaaagtcaggtgtcttcacgctctaactagagcacagggatggaccatagccatgctaacctttgttaacccctaggacttgtcaaggtgtttaagcagtaggaatgaggaaacaacgttctgattcaagtaaatgtaactagaagtaaaaatttaaaaacttgtaagctcactaaagtgaagctctgcagacacggttcatatcctggtggctgagggcacataaccaagaacttacacaagcacccccaagccacaaagatcccagctgctatggttgaggggtaacctgccagcactggagccaagtgttggagctactgatccaaagttagctcacttctgcagaggctctgaaccagagcaaagaaatggcccagtgcaagcccagtgtgagccaagagttggccatgtaatcagttctggcccaaccaggtttgaaaggtagaggagcagtactgggttttggagagggaaggttggaacaaagccctttgcaggctataagcttcatttactaggccaggtctttctgtgtgaatgtgctttgactttggtctgtttatatgcatggggtaaacgtgggacagcctctgcagcttcactgcctgccggacgtgggtccagggctgccagctctgggtccttggtctgttgggggtcgcaaactgaaatggccatggggctatctgggcaggcaacacagatgagtggggatgggggaccccttctgtacagagcagcctctacttagtggccgctgacaggctgccccatgaggacgcaggcccaacattacctaatttaatcttctagaagtcagaattctgaatttttatgtcaactctcgactttttttttttttttgagacagagtcttgctctgtcgcccaggctggagtgcagtggcgcgatctcggctcactgcaagctccgtcccccgggttcacgccattctcctgcctcagcctcccaagtagctgggactgcaggcgcccaccaccacgcccggctaatttttttatttttagtgagacggggtttc

SEQ ID NO: 19121 - DNA, 1052 bp, Homo sapiens; identical to SEQ ID NO: 19120

SEQ ID NO: 19122 - DNA, 1196 bp, Homo sapiens
agaaagatgatttctcatctcagctctacagtgagctcgataacctaattaccagagttgggaaccaggttgaacgcttggtaatggaccgagatgagggacgttttccagttagaagaggagctgctgtctacatttgccatctgctgttgcctcttgtcaatgggaacagccaggaccgggggcaggggtagggaggttgaggatgatgcagttcagctgttcccactcaccagggctgtaacttcctttgcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggccatttgtgccgagttcttatttttacggagggcttgtggccttagacgccagtttgcttatggaaatgaaagagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccag

SEQ ID NO: 19123 - DNA, 1067 bp, Homo sapiens
cctgggcaacaaagcaagaccctgtctctacaaaaaattttaaaacttagccagacgtgatggtgcacgcctgtagtcccagctacttgggaggctaaggtgggagtatcccttgagcccaggagtttgaagctacagtgagctgattgtgccgctacactccagcttaggtgacagagcaaaatcctgtctctaaaaaaaaaaaaaaaaaaaccaaaaccatgtattctctctatagttttatgacactcctccactggaaccggaaactatacccgtaatgtaacaagttgggtctgaacttcacattaataaagtgacacaattgtggacaatgaccataattctgagtttaaatgagacagtaaaataatgtactgttaaattactttgttcaggaaaactggaggggcatacatttttttgcctagtttcatgcactgctgtcccagtggtgataggctgtcccagtaattgacggtgcccttgtctcttaggtaactaaaataatcctggccttccatcgcgctgaagaggctgccttcagcagcggggagcaagagctctttgtccagttctgcactgtcttcctggaagaccttgttccgtatttaaatcgctgtctccaagtcctttttccaccagctcagatagcacagactttaggtaagagaatgaaaattctgtaaactgccttactgatgtgtaattcacatactaaataattcatccatttgtgtaagtcagtgttttttagtaaatatgaatccaattttagaatatttccatcactccaaaaagatccttcatgcacgtttgtagtcattcctcgacagcatccttagtccctggcaacctactttctgttgccatagatttgcctcttctggacatttcataaaaatggaatcatacattatgtggctgtatctggctaagcggaagaagccagtcacaaaagaactacatacgtatgattccatttatgtgaaatatctagagaaatggtttttacagtcttttttttttttgaggcggagtctcgctgtgttgccaggctggagtgc

SEQ ID NO: 19124 - DNA, 1029 bp, Homo sapiens
catttccacttcatcactgttggagatcatggagctaagaagcagagccaagtccacccatgtccttggcagagatgacaggcacacagcttgtgcagtgccagaatatcattagcgtttcccttctttagtggtttgcttaaatttaaatccctggtaatctgtagaaccttctcctaggaaatggtgaagtctattaggagccacttgtgactccatgacctgttaaaaccagcaatgtgagtattatttggagtaaatttgttccacgtcaagttctggccttctgatgcaaatgcaaaggaacttagtctgttatgaacccaggttgatgacagaccagtccttgtggaataagattccctttaaaaactctttagccagtcgtgacatcaaccctagacctgtctgccttggcatttgctgtcaacatctgctgggctatgtaggcaggttaatcctccacttctcatgtggttgaaccagtgtgttttttggtaaaatggtgattgtagataagattagttccctgatcccctgccccctgtcccctgcctcttttcccaattcccttccttatgctggacttttaaagcttaaaaaaaatccgattgaatataaatgcctaatttcattctttgtgaaatggttgcttcctcctgattccctaattgtgctgtgttcgtgtcttgcactggaattcaacattcccttctccttttgtactgtgttgtgcttgctgtctctcccggacacccttaaagactgtctttttagcaaaaaatttcagtaaagtgttttctgtaatctttttttaaaaggtgagaactaattattgtccatacttgtagcattcttcattaaagtcttgcttctctcaactgtaagtagctgtttaattgcagcacagcatgtatccacagagggaggtagcaaaatgttaaactttgctgaactattttgatcaagaagctgatgtcagactttattgaatgttttaatccttggaagctatgtcaaacagatgat

SEQ ID NO: 19125 - DNA, 1034 bp, Homo sapiens
ttgtattgttgaaaagtgactaccttacaagcagaaagagacagcttccagtggttcataacacttgaacaataattgtttgtttgttttttttgagatggagttttggctcttgttgcccaggctggagtgcagtggcgcgatctcggcttactgcaacctctgcgtcccaggttcaagcaattctcctgcctcagcctcccgagtagctgggattacaggcatgcaccaccatgcctggctaattttgtatttttagtagagatggggtttctccatgttggtcaggctggtctcgaactcccgacgtcaggtgatccacccgccttggcctcccaaagtgctgggattacaggcgtgagccaccgcgcctggctttataattgttagtttttaagtacagaaatttgatatgatgtgagagagagttattttgatgtttgatattctgattacacctgtcattacaaaagtaaaaaaagatttttcccctcctttttaggctgtcattatttgtatcaaaaacaaagaatttgaaaaggcttcaaaaattttgaaaaaacatatgtccaaggaccccacaactcaggtaaatttgatacatttttgctcctgtgacttaaattcatctcattgctttttgtggggaaatagggaaagggttcttggtcaggaatattacttaaatattctcctttcaacatgtaacacctgcagcaagttatcttttatatccaagataactcactgtaagattggcttttcaaaatttagtttttattagagaaattgacataaattattcacttgccttatttctgtctagtttataacagaacattgatttaaatgatcagcaccaggtatggagctgacaaatgtaacacttctaactttatttacattaaatggtgatcctgcagatgtgaggaaacttctttggtgaggacatagcacctgtttcctggtgtcaaaagttctgttggtcccctgcttttattttttcttcttcctttttattcatttgtttattt

SEQ ID NO: 19126 - DNA, 1033 bp, Homo sapiens
gtcacggaatctgttaatgatcgggaaaattctacagacgcctaggttcagtgagccttgctcatgcatttaagctttgtaaagtgccaaaacaatttatttaaaagtatattgaatctttcgcaaagtttatcaagtaagttatttgttaagttagaaccctcagtgcatggtctagggatctctggaggtccccaggaccctttcagagaagccatgaggtcaaaactgttttcataagcagaaccaaaacattatttgactttttcaatgcattggcatttgcattgatggtacaaaagcaaggatgagtaaaatgggtgattccttagcgtgatcaagatggtagtaattgtactagtagtcattgtattcttcactgccacaattttttttaaaactaccaattttaattaagaatgttagtcacagttgtttaaaagctcagaactcccattaaaaaaaaatttaaaaaagaatgtctttggtaaagcagcaaaaactggatgaattttattaactctagagccttgagtaaacatcttttcaggattttgtgtgttgaaatagaaagtatgggccaggtgcagtagctcatacctgtaatcctagcactttgggaggctgacgtgagtggatcgcttgagcctaggagttccagaccagcctgggtaacatagtgaaaccctgtctctacaaaaatacaaaaaattagctgggtgtggtggtgtgcacctgtggtgtcagctacttgggaggctgaggcagaaggatcacctgagcctgggaggtggaggttgcagtaagctgatatcatacctctgtactcgagcctggacgacagagtgaagaccctgtcaaaaaagaaaaaaaaaaaaataagaggaagtatgactaaaatgtttctgctgcataccaaaacatgatggttaccaggaaaagcacttgtgttattattagagttgcatgctgaactagctgcttttttatggaatactattttacctgaagaacaactgacaaattacagttg

SEQ ID NO: 19127 - DNA, 1046 bp, Homo sapiens
cctattaaaaaacaactagtgtgcatgaggtgcacatattttatttatttaattaaggaccttgggcagatactacttttggtctggtaaagaaatgcttaaatattagtcatttccaaggaagaataatttcaagagtacatttttagtataggaaaatcaggtttaggttgaggggaggcatatgccagaatagacattatcaagggaggagaaattcatgcctactttcagaactgttaaggatcttttgaatgggtaccagtttagaataattcatttaacttctattaagtacacattgagtatcccttatccaaaatacttgggaacagaagcattttggatttcagattttggaatatttgcattaaatttagtttgagcatcccaaatccaaaaatctgaaatcccaaatgccctcaaatctgaaactttttgagtgccaacatggcactcaaaggaaatgctcattggagcatttcagatttcggattttcagatttaggatgctcaacctgtagcaactcctttagaacacaagggctatagatttgccatctggcccctcttctggaagagtctttgtgggctttcatctttcagctgcgtatttattattattatttaggctcatagagctccttatttgggtggttcattaggaaaaatctattagaaaaatctaagctctcagagtagccattttcttacgttgactctgttctccttttccagtctccaccacgtactagatcttatgcttattgttactgcagtgtaacaagttactccaagaataagcagctcaaaacagttaatattatctttcagtttccgaggatcaggagtctattagtgattctggctcagggtttctcatgaggttacagtcaagctgtcagctaggtttgcagtcatttcaagactcaactgcttccctactcacatagttgttaacaagactcactttcctactggctgttggctggacacttcagctcctggcctcttcacagataaggctgcttgcaacatggcagctt

SEQ ID NO: 19128 - DNA, 1033 bp, Homo sapiens
tgagcaccggagcgcctggctgcctgccaaggaagtgcaattgcataaaaacagaaagaacaacgccctggagccaatcttcaagaaaggaatttccaaaggataatatttttctaataaatgcggctgcaacctcctgtgcatttaattaaataggccaaatttttgctgcttaggtcatctcaaggctgatacttgagctgtgtgcccagagatcatgcatttagatttatatttttgccagaaaatacaaggttataataaaactaagaactaccatttctttcttttcttttaacctgttctttttttgagaatagtttctattcgtctggaaagtgcaacgtggtgagctccctgatggcctttcacctggattccccacggttccgcctcatgtttctctgcacacacagtcacaaagtatgagtcgtctaggaaaaggatattcttttgcataaccacggtagagttagcaaattcaagaaatatcacattggtacattactattatgtaacatgacagcactggaagtcaccctgtatcagttcgttcttcagctgcctaatgttccattgcgaagagctatgaaacaaactctgttaagtacttactctacattagcccatttaatccatagaacgttaatacagggtacggctgctgttatttcgagcagtcctgagctacaagaggtaagtgacacagcatgtgagtggctgggccaagatttcagcttagtccatctgtacttttttttttttgaggcagtctcgctctgtcgccaggctggagtactatggctcagtctcggctcactgcaacctctgcctcccaggctcaagagattcttctgcctcagcctcccgagtagctgggattacaggcaagtgctgctgtgcccaactaatttctgtattattattatttttttaaatagagactggttttcaccatgctgcccaggctggtcttgaactcctgacctcaggtgatccacccaccttggcctcccaaagtgcggggattaca

SEQ ID NO: 19129 - DNA, 1024 bp, Homo sapiens
gtatttttagtagagacagggtttcgccacgttggccaggctggtctccaattcctgaccttgggtgatccgcccacctcggcctcctaaagtgctgggattacaggcatgagccatcgtgcccggccaaaaaaaaaaactggatatctttaattttgataacaagaggtatatgttttttgtttttttaaaggttaaggtgagctcatcgattcagcacccagaaacacctctgcacatttctggtttccatctgccctacaaggtaatttcttagacaagccaggccgttcatgctcttttctgaaacatgtcacatctctctaagtcatctcttcacagtgaactaaatttacgcggaccaataacatagtttgtccagccctgtctgatctgacttgtatatcatatgtgatttcatctgtgacctgagaggtggctacagatgaattttcaggttttaaaattgtttcttttaatttcagcctaaacccccacaagaaacagaaaaaggacactcagcttgtgagcctgagaacctggaatttagttccttcatgttctggagaaaccctttgcccaacatcgatcatgaactgcaggagctgctggtgaggccttgacttttggtcttctgacgacagctcaacttctcctccactgctcctgtgggttgggagtttgaaaggtctgttgatgtttcagattgacagaggtgaggacgttccaagtgaggaggaggaggaggaagaaaacgggtttgaagacagaaaagatgacagcgatgacgacgggggtggctggataacccccagtaacatcaagcagatccagcaggagctggagcagtgtgacgtccccgaggacgtgcgggttggctgcctgaccacagacttcgccatgcaggtgggtagggtgggcctgggccgtgtgtcacacacgtcatcggcagtggtcctaccgaggtgtacagatgtacacggaactggtgctgtgcagcgcttcttttcctggttctggaaac

SEQ ID NO: 19130 - DNA, 1402 bp, Homo sapiens
ggcaacaggccagcagccaaaatgaaggctttgactatttggcctgaagaattttagaaaaccaggagagaagaccttcacccaacgaagccgtctttttgtgggaaatcttcctcccgacatcactgaggaagaaatgaggaaactatttgagaaatatggaaaggcaggcgaagtcttcattcataaggattaaggatttggctttatccgcttggaaacacgaaccctagcggagattgcgaaagtggagctggacaatatgccactctgtggaaagcagctgcgtgtgcgcttttcctgccatagtgcatcccttacagttcgaaaccttcctcagtatgtgtccaacgaagtgctggaagaagccttttctgtgtttggccaggtagagagggctgtagtcattgtggatgatcgaggaaggccctcaggaaaaggcattgttgagttctcagggaagccagctgctgggaaagctctggacagacgcagtgaaggctccttcctgctaaccacatttcctcgtcctgtgactatggagcccatggaccagttagatgatgaagggggacttccagagaagctggttataaaaaaccagcaatttcacaaggaacgagagcaaccacccagatttgcacagcctggctcctttgagtatgaatatgccatgcgctggaaggcactcattgagatggagaagcagcagcaggaccaagtggaccgcaacatcaaagaggctcgtgagaagccagagatggagatggaggctgcacgccataagcaccaggtcatgctaatgagacagaatttgatgaggcgccaagaagaacttcggaggatggaagagctgcacaaccaagaggtgcaaaaacgaaagcaactggagctcaggcaggaggaagagcgcaggcgccctgaagaagagatgcggcggcagcaagaagaaatgatgcagccacagcaggaaggattcaagggaaccttccctgatgtgagagagcaggagatttggatgggtcagatggctatgggaggtgctatgggcataaacagcagaggtgccttgacccctgctcctgtgccagctggtaccccagctcctccaggacctgccactatgatgccggatggaactttgggattgaccccaccaacaactgaacgctttggtcaggctgctacaatggaaggaattggggcaattggtgaaactcctcctgcattcaaccatgcagctcctggagctgaatttgctccaaacaaacgtcgccgatactaataagttgcagtgtctagtttctcaaaacccttaaaagaaggaccctttttggaccagccagaattctaccctggaaaagtgttagggattccttccaatagttagatctaccctgcc

SEQ ID NO: 19131 - DNA, 1089 bp, Homo sapiens
tagagtcatccgggagctttacacacaaccagtggccgcccagaggcgggcggatcaagaggtcaggagatccagaccatcctggctaacacggtgaaatcccgtctctactgaaaatacaaaaaattagccgggcgtggtggcgggcacctgtagtcccagctactcaggaggctgaggcaggagagtggcctgaacccaggaggtggagcttgaagtgagccaagatcgccccactgcactccaccctggctgacagagggagactctttctcaaaaaaagaaaagaaaagaaaagaaatgctaagcaaagtgttccggtgtgttttgcctgttttggtagtggaagggaagaaaatcagtctttttctttcttctcccccttaaaactatttaagaagggaactgggcacggtggctcatgcctgtaatcccaacactttgggaggtcaaggcgggaggatcacttaggtccaggaattcaagaccagcctgggccacatagtaagacctcatctctaccaaaaaataaaacattagggctgggtgcggtggcttacacctgtaatcccagcactgtggcaggctgagggagctggatcacctgaggtcaggagtttaagaccagtctggccaacatggcaaaaccctgtctctactaaatatacaaaaattagccgggcatggtggtacgcacctgtaatcccagctactccggaggctgaggcaggagaattgcttgaaccgggtaggtagaggttgcagtgagccaaaatggtgccactgcactccagcttgggggacagagcgagactctgtctcaaaataaataaatattatttttaaaaaaagatcccctgggcatgcaataagtaataccatactacttaggcaaataaagcacaattctatcatttgggaatcttaagatcggttctaccactttgtggatcttcagactcaatctctattttagagatactaacattgattgatcctactatgtgccaggcactgtctttcacaacttcacatatatgatctcattcaatcctcatttaattttggcagagaaaagttgagctcctt

SEQ ID NO: 19132 - DNA, 1030 bp, Homo sapiens
agatattcagtacagaggcacccatctttttaaatttctgaagattttttactcatgcttggtttaatccacagatgcagaacccacaggttcagagggccagctgtgctttgaaaatattagcttgcgttttattagaaagaaaactctgaggccaggcgcggtggctcacgcctgtaatcccagcactttgggaggctgaggtgggcggatcacaaggtgaggagatcaagaccattctggctaacatggtgaaaccctgtctctactaaaaatacaaaaagattagccgggcgtggtagtgagcacctgtagtcccagctcctctggaggctgaggcactgcactctagcctgggcaacagagcgagactctgtctcaaaaaaaaaaaaagaaagaaaagaaaagaaaactctgtcataaggaagatgaatatgtgctatgaaactgaaatttgttttattctgtgataatcctggcagtactaaggaattacaacagatgaaggattcagtaggagacataggactagtggcattgggtttatgctgttacttttatggagaaggaatgtttgcctaacttgagacatttatcttgagagaccctcactttcagtgttgggaaagaacttggccaagcaggagtataagtttgcccaactttattaaaggagcagtgttctgttgttctagtaaaaatctattgcctgtaattgaaattgtccctcctcctctaggagatggagcctcagcagattatagtaaaaccaaaagctagcctgactagcttttttatttttttgagatggagtcttactctgtcgcccaggctggagtgcagtggcacaatctcggctcactgcaccctccacctcctgggttcaagtgcttctcctgcctcagtctcccgagtagctgggactacaggcactcaccaccacacctggcaattagtagagacagttgtttcaccatgttagctaggctaggctcaaaactcctgacgtcaggtgatccacccgccttgg

SEQ ID NO: 19133 - DNA, 1307 bp, Homo sapiens
acccgcctcagcctcccaaagtgctgagattacaggtgtgagccaccacgcccggctgaaaagaacattcttaatgtcatggttgagaccctccagggtctcctgcaggcctctggcaggcagggagcaagtaggatgtgcagagagtaggataggggcctgggggattgagttcaaggcttttctgcccagctgaattgggccttcaaacgagtcccactttgcctgattacctgtttgctcataccctttagactacaggaaacagctttcaaaaactttataccaagggttgggtatgttgcctcatgcctttaatcccagcacttagggaggctgaggcaggcagatcacttgaggtcaggagttcaagaccagcctgtgcaacatggtgaaaacctgtctgtactaaaaatacaaaaattaggagtggtggcgggcacctgtatccaagctacttgggtggctgaggcaagagaatcatttgaaactgggaggcagaggttgtggtgagccaagatcacaccattgcactccagcctgaacaacagaacaggactctgtctcaaaacaaacaaacaaaaaaaactatactatcttcaaagaatgaggatgaattaatgaacatttgaggttctctgaactgagaaataaagcctgtttaaggggttgtggtaagattttaaaagtaatcctccaaaattgtcacctagtgagcagaatacaaaaatggagcttaagttccactacaagaccaaaactgtcacgtagagcctaagggtaagactgtattggatattagggaccacaaagcactttcatgtttacctcatttgattttcacagcaactgtgtggggagaatcatccccatttgagaactgagaacactcaggctcagcgagctggtgtcccgcttggtgtcagaatactctcaagcccaggctttccctgactgtcaacccattcctgcttctcttgtccgctagtgtgaccccccagccaagggctgccagggcctctttcactatggactttgtgttctgccattcaggcacctgcggaactcgagtcatgcaggagcttttgtgatcgtgacggaagaagccattgccaagggtatccggaggattgtggctgtcacaggtgccgaggcccagaaggtgagcaggtcaggctggtttgtggcttatctgaagaaggcaagaggagcccagtctgcgaatccatagagcaaacactgctctgcgtggctgctgcagtcagagtgaaagtacaggctgggccactccccctgccccagtgtcc

SEQ ID NO: 19134 - DNA, 1035 bp, Homo sapiens
gcattgacacagggatgggcctggaacgactggtatctgtgctgcagaataagatgtccaactatgacactgacctttttgtcccttactttgaagccattcagaaggtactggtgctattgcaaacattgtaaacttctgtggagttttccaggctgtactcttaacagtgctgtcaaagaaaaaatgaccatatgctttgccagccaagggtacccatttccatctgcctacttcattgttaataatgtgaggctccacaaattggtgttctaaatgtcttaagaacctaattaaatagctgactacaaaaaaaaaataataatgtgaggctctagacctgagacagtataatttttgagtgtaggggctggctggagtctctctacttccccaatgtcacgttcttggggttataggatctggcaagaccggcatcctttctgctaatgctcctcaatcctccaggaacctccttgggcaaggtagcgccagaaagtctgcttcctaaagggctgcctcctgattcttatctatagggcacaggtgcccgaccatacactgggaaagttggtgctgaggatgccgatgggattgacatggcctaccgggtgctggctgaccacgctcggaccatcactgtggcactggctgatggtggccggcctgacaacacagggcgtgggtaagtatgctgcacactgggtggtgtttggagcggcaccacgtgtgctatgtgtgactctttatgaaacttttctttgtgtgtgagattgagtgttgctctgttgcccaggctggagtacaatggcgtgatcttgcctcactgcaacctctgcctgctgggttcaagtgattctgcctcagcctcccacgtagctgggattataggtgcacaccaccacgcctggctaatttttgtacttttagtagagacggttgttttttttttttttttttttttttttttttttttttttctgagacagaattttgcttttgttgcccgggctagagtgcaatggcccgatcttg

SEQ ID NO: 19135 - DNA, 1041 bp, Homo sapiens
gttccatatctttctctctgttctttttgtaggaattggcatgtaagatggctctggaactcctcacccaagagtttggcattcccattgaaagactttatgttacttactttggcggggatgaagcagctggcttagaagcagatctggaatgcaaacagatctggcaaaatttggggtaagaatgcacatcacttcttgagagtatggaggagtgaaatgacactcagtgccagagtggggttttatgacctggaatatgtggtcattttgcatctcagggttccttttgagatgcacatggggaggagtgaggctagagaatcgcttgaacccaggaggtggaggttgcagtgacctgagatcactccactgcactccagcctgggcgacagagtaattatctttagatgcattaatatctttatttatttatttatttatttttttgagacagagcttgctctgtcagctaggctggagtgcagtggcacgacctcggctcactgcaacctctgtctcctgggcttaagcaattctcctgcctcagcctcccaagtagctgggattacaggcgtgtgccaccatgcccagctaacttttgtattttttttagtagagacggggtttcatcatgttggccaggctggtctcgaactcctgacctcaggtaatccaccgtgcccggccgcattcatatggtttttttttttttttttttttttttgagatggagtcttgctctgtctcccagactggagtgcagtggcgtgatctcagttcactgcaaactctgcttcctgggttcatgccattctccttcctcagcctcctgagtagctgggactgcagatgcctgccaccacacccagctaatatatatatatttttgttgttgttgttgttggagtctcgctctgtcacccaggctggagtgcagtggcgcgatctcagctcactgcaagctccgcctcccaggttcacgccattctcctgcctcagcctcccgagtagctgggactacaggcgcccaccaccacg

SEQ ID NO: 19136 - DNA, 1050 bp, Homo sapiens
ctggagtcaggatctcctgttcactttgtacatctctattgtattttcctcataaggagaaaactttggctgggcatggtggctcatgccatcccaacaccttgggagattgaggccaggagttcgagaccagcgtgggcagcatggcaatactccatttataacaaaaacagaaattagctgggcgcggtggctcatgcctgtaatcctagcactttgggaggctgaggctggcagatcacctgaggtcaggagttcgagaccaggctgaggaacatggtgaaaccctgtctctattaaaaatacaaacattagctgggtgtggtggcacttacctgtaatccaggttacccaggaggctgaggcaggagaattgcaggaacttgggaggtggaagctgcagtgagctgagattgcgccacagcgctccagcctgggcgacagagtgagactctgtctcaaaaaagaaaaaaaaagaaattaactgggcatgctggtgtgcaactgtagtcccagttacttgggaggctgaggcaggaggattacttgagcctcggagtttaaggctgcttaagtgattgtcccactgcactccagtctggacagaaccagaaaaaaagaagaaaactttcagctaaacaacttaaaagtaatattatccattctgttccttcaaggttttcctttttttttttttttagacggagtctccctcagccacccaggctggagtgcagtggcgcaatttcggcttactgcaaccactatttcccaggttcaagcgattctcccatctcagccttctgagtagctgggattacaggcactcgccatcattcccggctaatttttgtattttagtagagatggggtttcaccatattggccaggctggtcttcaactcctgacctcaggtgatccacccaccttggcctcccaaagtgctgggattacaggtgtgagccaccgcacgtggcgtaacgttttccattttatagattgcttccaaatacagtatagcttttgatcctcacaacacctcagttgag

SEQ ID NO: 19137 - DNA, 1030 bp, Homo sapiens
catcagggaaggtaaaatactgaaactatatttttaaaaataaaagtattcccttttgagtgtgaattaggaatcaatgccccttctcactacttttgtgaaaaaaatcacagctcctgcagcaagtctatgcctgggtaacaaccaacccacaaaatccaagaggaggtccccctctcccgcctctgtgaggcttgaggagcagtatgtatctgggccagcctggtcctcagagtgtggaattaacacctttcctctagcaactgtttgtgctgctgagaacagcacagactctctggcagcctggttctctccagagggaagcctgtgaagcagaagaaacatatggcatctgcactcagggcgcccagttccatccggccttgctataaaatgactttgcctttccttttttaaaattacaaaaataattcaaccaatacataaacatatgaagtgaatcacggagggccttcctgcgatatctttttttgcctaccatttgtcatggaatgggtaaaggggaccacagagggaagagacgctgccccttcgcagggccatggcagtcccctgggctgcgtctccacggtgcttcctgtgaaacgctgttaccacgggcaccgcactggagaccatgaaagggaagagtttgacatctcagctgtctttgctataaatagaaataaataaaccttaactaaggcttgagtacacttaggccgggcaaggtggctcacacctgtaaccccagcactttgggaggccaaggtgggtgggtcatgaggtcaggagtttgagaccagcctggtcaacatggtgaaaccctgtctccactaaaaatacaaaaaatcagctgggtgtggtggcaggtgcctgtagtcccagctactcaagaggctgaggcaggagaatcacttgaactcaggaggcagaggttgcagtgagtcgagatcaagccactggagtccagccggggcaacagagcgagactccatctcaaaacaaaaaacaaaaaaaaattttttta

SEQ ID NO: 19138 - DNA, 1076 bp, Homo sapiens
gaggcaggagtctgagagttcaagtccagcctggggaacatagcaagaccctgtctttatgaaaaaaaaaaaaaaaaaaaaaatttagccaggtctggtggcgtatgcctatggtcctagctactcgggggcctgaggtaggatcatttgagcccaggtggtcgagtctacagtcaactgtgattgcgccaccggcattccagtctgggcagcagagtgagatcctgtctcaaaaagggggaaaaagcctgggcgcagtggctgacacctgtaatcccaacactttgggaggcggaggtgggcggaacacctgaggctgggagttcgagaccagcctggccaacacggttaaaccccatctcgactaaaaatacaaaattagccaggcatggtggcgcatgcctgtaatcccagctactcaggagaccgaggcaggaaaattgcttgaacctgggaagtggaggttgcggtgagccaagatcacgccattgtactccagtctgggcaataagagcaaaactccgtctcaaaaaaaaaaagccgccagaggcgggaagctagctagaatgtggagagacctggtcttccccacacaggtggtttgaacttttttcataaaatagagatgaggtctcactctgttgcccaggctccaacccctggactgaagcgatcatccagcctcagtctcccaaagtgctgggattataggtgtgagccaccacaaccagccgagaactgtttttctagacgttacttcatgccttagtgtagataggtacagcaagatactggatttccccctgcccactccgactcaaaacacagtggggctccctcctgaggtagcaggtggtggatctgaagggacccttcaccccaactcccctgccgcaccctctccccgtgcctcagggcccagcttcctcctcttagaggccgtttctttattttttctttctttttttttttttttttttttttttttttttttttttgtttctttgagctgtctcctacaggaagaggctgttagggtgcagcctcgatctttgtccagagaagactgacagttt

SEQ ID NO: 19139 - DNA, 1053 bp, Homo sapiens
gggtgcaggacagcgatgcttcccaaagccacctgcagggttggtgctggaagttaccagatggcaccaggctggccgtgggctcacaatgacctctcttcctagctggaacttccagggtccctgttggaaaggaagtgtccagaggacacagcagctgagcaaggggcccacctctggttccctccatcttttactctgcatttctataccttcactctggagggctgggtgggaggacatggcttccttttagtcttctggtagaagcatggatgcaaacaccttccttgagtttccatgagcatagctgccacaggctgacctttccaaaagacattactaaatataaaaggagaacaaaagaaagctaaagatagggcgtgcaaagaataaaaacagcctggctcacaaagaacaagttactggtttgtttccaaagctttcggaccctgccctgttattccccttccaggagataaccacctccaaggccagcagacgtctgcaggccctttcgccaggctctctggcctcctagtgctggcttgtccactgtctaggttgtcttgtaggacccatgccaccaggaatcctctccagactacttgaccaccctgcagtcagatctctgttctgccctcttctctacccagggctcttggctgtggtggcggagggagggatgcctgtttccctaggtctcccaggtgattggcacctatgtgactggaccttttaggagtgcagccttgttccatgtaggccttgtaatatgacctacctcttgccatgctgctcaggccagtttagcccacgaactgccatacaaaaggctttctccaacatttgatcttggcagaaactatagaagtctccccacctggttccatcctcccactgggccacaagaatagaaactgataagaagttggcctagttgatggaagtttgaacccggggacagaggttgcagtgaaccgagatcatgccatttcactctagcttgggtgaaagagcaaaacttcatctcaaaaaaaaaaaaaaaaaaaa

SEQ ID NO: 19140 - DNA, 1035 bp, Homo sapiens
ctctcattagactgtggatgctcttcaaatgtgtcctcattttctgaaataccaccacctggcttggtccttagcacctagtgggtgttcagtaaatgaattacagcggaaggtctcatggttacaggtttagggaaggattcttcacatttgactgagagtcatagtctcctggagagctggttaaggcacagattgtgtgtgtgtgaggggactccagagttttatggtttaatcttggtggagcctatattttgcatctctctccagctccctagggctaacactttgagaaccactggtttggggtcatcacaatttcttgagagattaatccaagcagatgcgaagtctttttttttttttttttctttttttgagacgaagtctcactctgttgcccaggctggagtgcagtggcatgatctcggctcactgcagcctctgcctccagggttcaagcaattctcttgtctcggccttgttggccaccccttcctggggtgacaggaacctaggattacaggcatacgccacgacaccccgctactttttgtatttttagtagagacggggtttcaccatgtttgccagactggtttcgaactcctgacctcaggtgatccgcccgccttggcctcccaaagtgctgggattacaggcgtgagtcaccgctcctggccagatgtctttttttttttttgagatagagtcttgctctgtcacccaggctggagtgcagtggtgtgatctcagctcactgcaacctccgcctcccaggttcaggctattctcctgcctcagcctcccaagtagctgggattataggtatctgccaccatgcccggctgatttttgtatttgtagtagagatggggtttcttcatgttggccaggctggtctcgaactcctgacctcaggtgctccgcccgcctcagcttcccactgttgggattagaggcgtgagctactccgcccagctagatgtagtcttttttattttattttattttattttattttattttattttg

SEQ ID NO: 19141 - DNA, 1051 bp, Homo sapiens
atgaaacaacatgaaagttaaaaataaggccgggcatggtggctcacgcctgtaatcccagcaatttgggaggctgaggcaggcggatcacctaaggtcaggagttcaagaccaacctcaacatggagaaaccctgtctctactaaaaatacaaaatttgccgggcgtggtggtgcatgcctgtaatcccagctactcgggaggctgaggcaggagaattgtttgaacctgggaggcaggggttgcggtgagccaagatcacgccattgcactccagcctgggcaacaagagtgaaactccgtctcaaaaaaaaaaaatagttaaaaataaaaaaagtagtttttaaaatgtggattatgcacctgatgaaatgccacatagtcatgaaaaataaggtaggtgaaaacatggaaaatatttatgatatacttttttaaaacagaattcaaaattgctatctgtatcatgattgtaacgatgtaaaatatgtacatatttcaaagaaagactataaaggaacctgaaaaaatgaaaaaagttgctctgtttcccttggggaaaaaaaatgagtattcctttcttggctgtcccctagagcaccagaagtgtctggacaaactcctcaataactgccttttgagctgtaccatgcaggagctaattggcttatatgttaccatggaggagtacttcatgagggagactgtcaataaggtaggacataggacgcatctcttggaaatggggcttccggtccaagaagccaggctgagggaaatggctgaggcatgtcatatttattggtcctgctttgagaatactcttgcatgcagattgagtggtaccactttgtatgtttagagagcatctttggagtcgttgtgttctttgtatacccagctaggacttccttcccaagaattaaaaaagaacagctcagctcagctcttcagggagcccacttgttccctacctccctgaaggtttgtgggtaaggagcctcagggaagtagggcccctgcagatatcttacactccccaggtaatgga

SEQ ID NO: 19142 - DNA, 1002 bp, Homo sapiens
tactaaaaatacaaaaattagctgggcatggtggtgcgtgcctgtagtcccagctactcgggaggctgaggcaggagaatcacttcaacccaggaggcggaggttgcagtgagccaagattgcaccactgcactccagcctgggttacagagcgagactctgtctcaaaaaataaataaataataaattataatcagtacaatcacgtgtcatttaatgactggaatacttttttttttttttgagacagagtctcactctgtcacccacgctggagtgcagtagcattatcttggctcactacagcccctgcctcccaggttcaagcgattctcctccctcagcctcccaagtagctggaactacaggcgtgcaccaccattcccagctaattttttataattttagtagagacagggttttgccatgatggccaggttagtctcgaactcctgaccttaagtgatccgcccacctcagcctcccaaaatgctgagattataggcatgagccaccataccctgccaacaactggagtacattctgagaaatacatcattagacgatttccattgtgtcaacatcgtagggtgtacttagcctactacacacctaggctatatgatacaaactattactcctagggtataaacctgcatggcatattactatactgaataccatagacaattataacacgatggtaagtacttgtatatctaaacatatctaaacatagaagaggtacagtattatgtactgtaccatagaaacatagaaaaggtataatattatgggaaccctcttgtgtataccgatacagtttttttttgttgttgttttggggtttttttgcttttttgagatagggtcttattttgttgcccaggccagactgcagtacggtggtatgatcctggctcactgcagccttgaccttctgggctcaagcaatcctcccacctcggcctcccgagtagctgggacacatatcagtagctg

SEQ ID NO: 19143 - DNA, 1126 bp, Homo sapiens
attttagaaagtgaagcagccaaaaggattgagctagaccttcggttagtcctggatgggagcaagtttattttgtaggaagaatacttggaatataaccctattgcttcctcccttctagggattgcccgcattgtggagacccaccagccaatagtggagacctattatgggccagggagactctataccctgatcaaatatctgcaggtggaatgtgacagacaggtggagaaggtggtagacaagttcatcaagcaaagggactaccaccagcaggtgagcaggggaagctacaggtagggtttggtagcagctttagcgaggaacactgagtagaataaattgtagggtttgaaaaagtgaaaaaaaaggtgcagacaggagaaaaataaatgctaagcgcacactggcctgcatcttgcccattgacagcttactttggacttgaggtgttgtcgagatgatgatggcctcagttcaagaccaaaacggaaataaaaagagcttcctgaaaagaacacagcagaagtagtaaaccagttctctatcacaaaatgtgcaacagtgccctctaatgatataatgacaattctatttcttgaggtcctattaagtgtccaagtaattgtctccaatttccccttcattcctaagatgttaaagataacgtttgctttttcagaactttgttttttccttcttttgagcagagaaagtaaaagtacgacatagaaataggagtggcctcatacaattgtatttctagaactccagactaggagactataaacagtagtctattggaacaccattagcatgacttttaagcacagtaatagaggtgagtattattagcatccaacccaaaaacaaatctttggcctgtcatcctgaaagcccactgctggcttgaagggaaggtaaacctggtaaacaaactaaatctaaatgttcttgtatgccaaaagtttggagtgaccagcaagaggccaatagatgtgggggtggggaagaatattctcattcctgtggtatgttgcagttccggcatgttcagaacaacctgatgagaaattctacaacagaaaaaatcgaaccaaggtaataatccttctctcttctt

SEQ ID NO: 19144 - DNA, 1030 bp, Homo sapiens
ctctgttgcccaggctggagtgcagtggcatgatctcagctcactgcaacctccgcctcccgggctcaggcaattctcctgcctcagcctcccgagtagctgggattacaggcgtgtgccaccacacctgggctaatttttgtatttttagtagagacggggtttcaccatgttggccaggctggtcttgaactcatgacctcaggtaatccgcccgccttggcctcccaaagtgctgggattacaggcatgagccaccatgcccagctttcatacttttttataagagatagggtcttgctatgttgcccaggctggcctcatactcttgggctcaagcaatcctcctacctcagcctcctgaatagctgagactacagatgtgtgccattgaacccagctaccttttcatacctttaaagaccgttagaatattccctttcatgaaggacctttttaaatcgtttgcccatttttctactggattatctgtcttcttcttaccaatttatagaactttttagtattgcagataaagttcctcatcggatatcttctctccttctattgggtacctttttattgtcttaatgggggtcttttaatgaccagaagttcttagttttaaaatagtccagtttatccatttttaaattgttagtgctatttgtgtcctgcttgagagatttttgcctactgcaaggtcacaaagatgttttcctctaaaagccttttggttttgcccttttgttttagatctgcagctcatctggaattgagtgtgtggtgtgtgtgtggtgtgaggtaggggtcctttttttcatatggatatccaattgacccagaacagtgtattgaaaaaaaaaatctgtcttagtcaatttggactgccgtaacaaaataccataacctgggtggcttagactacagaaatgtagcgctcacagttctggaggctggaaggccaggatcaagacaccagcagattcggtgtctggtgaggacccactttgtggttcatagatgtcac

SEQ ID NO: 19145 - DNA, 1054 bp, Homo sapiens
agcagcataatgcctagattttctttttttatccaatctgacaacctctatcttttaattgccatttttagcccctttgtatttactgacatatttggacttctggctttcttctttctatttgtcctgaattcttgtctctacccttgactttgttttttcttttctcttattccccgtctgctggattgtaagttatattctgtctcttttcttttataggttaccttgaaatcttaccatatgcatacttaacacaaccccacctcctgagtaattcaaggcccttaatatatatttttttacttgtcacccactccttctcaaacttacaagctatattattttctctttttttttacagtacccacaaatgacatttttcttcttaatttctttattttatacatacagtacttatttagatttacccatatgttaatacacatttcttgtcatttttttcttgcatctcaaatcctccaaagcttattttctttctttctgaagtaaaaaacatcttttagaagttcttttagaatagatctgtagttgtaaactctcagtttttgtttgtttgtctgtaaacatgttttattttgtcctcttcttgaaagttcgttttgccaggaacactattctggggtgacagttgtcttccatccacactgtgaaggtatttttccgctgtgttctggcttccaccattggttggaaggtcagctgtcagtcactgatgcttctttctgaggaatctgagtctctctctgggcacttttaggccttctctttagttttgctacagcgtgtctacaatgtggatttatttttatttaacctctccttgttggtattcatgtctttcatttgtccttggaattttcagtcattatttcattttgttttgttttgttttgttttgagacacgatcttactctgtcacctaggctggagcacagtggcgcgatcttggctcactgcaacctcctcctcctcccaggctcaagcgatcctcccacctcaccctccaaagcagctgggactataggcatg

SEQ ID NO: 19146 - DNA, 1052 bp, Homo sapiens
ggcggccatcagcagccaggttgaggagactgagcttgccccgtgaggccaccccacagtgagtccacaggccccacagaagccctcccctgggcctctgggaggccctgaccttgggctgagcgggggccaaggtcagatgcccactggtgtcaggctgcccattgaaacccagagaggggcagagacttgccaaaggtcatagttctgggcacggcaccttcagcaaggtgaatggggcctccacccagtgctggcccagccagaaaatggggtcatactcttcacccacccctcaagagtggggaatgtcacctggacacataggcctggccaggcctctgctaggggcccctgcagagggcagggcttgcgtactgttagctggtgttaactgagcacttactgcgtgctgggcgctgcgaggagtgctggctgagcagcacctgcttcaatttccacactgacccagtggggcaggtgctcctcctctcctgattttacaggtgaagaaactgaggctcagacagggggcccttgcccaggggcacctggaaagcccactccctgggattggaggctggattgctcacccacactccacatctgaaccacagccactgccgggacagagacagagtcccctcatccctgtccacttgggcgcctctaatgagaagcccctcacctccccactccagagcagccactgtgcttggggcagaactgggtgtctctcacatcccagcagtccctgccgcctccccagccttgacgttcagtgcttgtctccctgctttgtaagggagtccctctacctggcgtgcagtgaccaggcagacatgggatcaggtcctgaccccgccaccctgtggccgtgggcaaatgagctaacctctacgggcttctgtttccttgttggtgaaatggggctgtggggaaggtttacctgggcctgtcccaggtgaaggctgaggatgctgttcctggggcactggctgctggagccctatctcttatttttaatcagtgaaattgacctatccatgaag

SEQ ID NO: 19147 - DNA, 1035 bp, Homo sapiens
agattaggtaatttcatagctatgacaccaaaggcacaagcaaccaaagaaaaaatagacacattgggcttaatcagagttaaaaattttgtgcttcaaaaaaatttttttaataaaaagaggctgggcacagtggctaatacctataatcccaacactttgggaggccaaggcagaagggtcccttgggcccaggagtttgagactagcctgggcaacatagggagaccccatctcaaagaaaaaatttagctgggtgtgatggcacaagcctgtagtcctagctacttgagaggctgaggcgggaggattgctcgagcccaggagtttgaggctgcagtgaactgtaatcacttcagtgcactacagcctgggcaacagagcaagacactgtttattaggctgttcttgcattactataaaaaaatacatggctgggcgcagtggctcacacttgtaatcccagcactttgggaggccaaggcaggcagatcacgagatcaggagattgagaccatcctggctaacatggtgaaaccccacctctactaaaaatagaaaaaattagtcaggtctggtggcacacgcctgtagtcccagctacttgggaggctgatgcaggagaattgcttgaacccgggcggaggttgcagtgagccaagaccgtgccattgtactcaagcctgggagacaaagcaagactctgtctcaaaaacaaaaacaaaaacaaaaagacctgattgagagtaggtaatttataaagagatttaattggcttacagttctgcaggctttatagaaagcatggtgttagcatctgcttggttcctgaggcggcctcaggaagtttacaatcatagtggaaggcaaaggggcagcaggcagaggaggccaaagcaggagcaagagagtaagaggaaggtgccccacgcttttaaacagccagatctcagcagaacttgctgtctcaaagtaacactaaggggatggtgctaacccattcatgagaaatccacccccatcatccagtaacct

SEQ ID NO: 19148 - DNA, 1973 bp, Homo sapiens
aaatgttctacaattgacggtggtgatggttgcacagcttcgtgaatatacaaaaggctgctgacacctacactctaaaagagtgaatttatggtatgtgaattgtgtcccaatatttaaattagtgctgttttgttacagtctgagggaagcacttattcagtagtcacaactactgtcacccgagatcaaaacaagcctcctgctgtcactgactcttgcttctcctttgtagttttttccactggttggatccactgtatgctcagtacatgctcattcctacgtcatatctgctcatttctaatcagttcattcctaggtccaacctaggttggttggtgggtgcccagccaacatttatggaatgagcacaacctcgtgtgctatgtataagatcacagcttgtctctgattctgactttgcactaatactgttatttgagcatgtgcagtacagagcacagaatgcagttacctaatttaattctctaaaagccctgtaaagtcattgtcatgattaacccacctacagctgaggatgttccctctgaacacatgggaacctgagttcagtggctaaaacctctgccacctaggacagaggttgggacatagggccatcaccaaatgacatgggattggagttaaatgaaatcatgtgcctggcacacagtgggcacccagctggtggtagctgtgctatttggggaggggctagtctaatatagtggataagattttagatcttggggttagaaaagcctagatttgatttttagatccatcatctacaacttgcatgactttgtgtatatttcttaacttctctgagcctcagtttccacaaactgtaaaatgggtgtaatggtacttaactcagtggcttgttttaaggtttcaattagaccctgtatgtaaacatgcagcacgttgcctggcaaatagtaagtactcagctgatggttactcactgtgtcctgcgttcacagaagaccagcgctagagcctcatttcaaaacatctcaagtaggcacctcctctgtactccctgtgtatggaaggagtgccttggcgatgaccgagcactgtgtgaaagtgtatagagaaagctacgtttcacttgggggccttagttctgcacaagggaattgccatctgtaattgggtgcaattggtttgcagctgaagtggcttagggagatgggagggagggactgtgacatagttgaagggatatggacttggtagatgtcaagggttcagacctttggtgaccgtaggaaaggggcttgatttactgtttcagatctggaagatgggagtgaaataataatagctacagcaggaggtatcgtcgggaataactgacccctggaatactcagcagagtgtgagtgcttaggaagtggtcaactcaatagtcctcatgtgacctgtgacagtctcttgcgactgtcactgtgctgtggtacagagttaagctaaggggtcctgtggctgtgctggatggccccaggctctcccttggctcatgaaagtccagatgtgtcttgcagtgtccatggctgcttctcctgtcaggtagtcagtgtggcagtctttgagacattgagggtggcgtcaagagcatgatgttggccccccttggggcttgtatcttctggggaatgggtgttcctgccatcctgcaatgccactggccagctgagaacccaggctctgagcagcctctagaggacacctctccagccagggttctttagcactttttggaggaaaccaggcagaagtggatccctgctctggtgtataagacagcgatgtccatgcccttcacattagtgaaggtctccagggatttgtgatcgtgagagtttctgggccagatactaacttcaaaactagttcagcctcagatcccccacctctggctcccaacctgtagatgaaaggagggatagtgtggtctt

SEQ ID NO: 19149 - DNA, 1049 bp, Homo sapiens
tcctgcaatgtacaggacagtcctgcccactgaaaaaatgttcacactttcaaatgtcttgctgaacattcaggtaggtgaaaattctatttctaaattatctgaatctaaacctgttttctggataaacatgtatttttgcacagttttaacatacactgatcttccaggaatgtaattattgtataatcaagagacgattgtcctgtgtttcattcagaacttcacgaaaacatgtttgccattttggatcataattttgtgacttttgcaacaatgtaagtcacagctttgtggctgtggcactcagacaacgtctatgtgtaaaggcgaccaccttattaggtctcctgcagcagccaagaccaaacacattgaagtatgtgtttttaaacgacagatgacggtcctcttttttttctctttcattacacttaaggcataacattagtttttaatatgtaggtgtgtatgttatgtatgattttctaggccattatatatgaatatcaggtcaggagaataagatggacattacaaactatttgttagaaaaagggggcattgggtgtgacagcgcgccatccactggtccatttccaagactcccacacgtggctgcacctgcagcttcacctccccgggctgggtccccgcttggctctgattcttacctgccccattccccaggggtaacagtcaccgtgggccagacccgagctagccgacagggatgcggccacagctggccgggcgtgaccaccaccgaggcgcagcgaccttgctcctagagaggcccggccgcctggtgacgcacttccggcagcgccggggagcagtccgctacggaggtgagtgcagggctccgggcgctgtgtgccgtgccctgtcccccaggctctgggtccggttgagacgcactcccaccctgggtgctgcagggtctcccgtggcctacgctgccaggaggcccaggctgggagagggagcagggcggcggcccggggtgctcttccgcgctcctcgactccagctttggtctttgtggc

SEQ ID NO: 19150 - DNA, 1074 bp, Homo sapiens
caggaagtataaatctcatcatttcagcatgatcagaaatgccatagaagggttcagatcagaaatgggagaaaagcattgtaatcatgatattcacagctaatgctgagtgagtgctcgctaaggacgttccacacactgactcattagcccttccagtaactccaaggagtcgtcctgctgtttccacccactctatacttgagggatttaagacatggggatgttgaggaacttgcctgaggtcacgtagctggtaatagtggagtcacccaggcagcccggttccagtgccccagcgctcgggagtgcataacctctctgtcttaccgtcacggttctacttccttatcctccagggggcgcacgcagcacagtaccaagcacacaataggttctcattagactcattgattctgtccatactgacattggcatctactggggcactctgcccctagatctctgcatggcaacctcctttacttggaggtggtctctgctgcaatcccacgttctctgcgaagaagtctcctattgcctctgtagaatagcaccctccttcactgccaagccccttccccttatttttctttatagtacttagcatctgacatatattttttgttctcttgcccccaacagactaaaatgtctgttgtatgaaaggagaggctttgcctgttgtgtttgctgctgtatccacagcacctagaacattcctaggcatatagtagatgcccattaagtgtgtggaaaaaatgaatacatcccttagccaagtgctatattcaaatttccttactctggttattggttactacttttcctcatcactgcattgaaaaaaacaaaacaaaacaaaaaacacaaaaaaacctttctctgaatgaccaggcacctttatccagaagtggggcataacccttgacacaaggggcaatggattggggatcctcgactaatgcctgtcagaggtttattgttaactggactaggtcacttacagagtttatttttaattttgctttgtcagtctgtgaaagtaattcaacagtgtcatgataatgtaca

SEQ ID NO: 19151 - DNA, 1117 bp, Homo sapiens
tgagttgagagctcgcctcttgaatgttgaacagtgtactcttctgaaaactgcatattcactttatgtggtttcagaatactgggctcaatactaacataagaaagacacttcattgagaaattcttaagcttacagaaaacctatactctttgcacattccacataaccctagcaaaatgcagtttcttcatacttctgtcactttttccattggaagatttgcttaggaaaattaattcctatttattcccacaaaatgttggcattgcttgattttacccaatggggaatgtgctttgaatttttggaacacttttacaattaaaaataaagtagggccatttttaatttgtttcatcagaaactatgttaaagagagggttaaatataaatatattttcgtgtgtatttttgggaagatttttgttcaaagcaatagtcaaaatcagatgacctgtccataataattatgtgtcttcatcttctcagaggccccatgctcatatgcacgtgtcattgggatacactcttgggggatttggtacactctaatggatgtctaatgttcaacccctcgagaatctgaacttgagtccccagattgtcaaactactggtcagctattgagaattttagaactcaggtctttgatttgaagtagggaacatagtggctcacacagagtttaggtgctgttagaaagatgggaacaagagtgttttgccaccttatttttatatgggaaattttttttaatgaagaaaaaatgaaaatgaaataacaggatgatagtgatgagtgatgtaaaacatcttacttagatggcagaaccttcgggttgtagaatagtgatgtctaaaaattaaagttattttgggaatacaccactttaatagtatagtcttataaaaattattcattatggtgaacccttcttgtctgctattcgtttcccaacctacttattggaaccacctcaaaacccagttctgaaatgaccttaccaaaagtaaatgtatttattttttagtcagcagaactctgtaattccaaatgttgttctgtgtggtagaattttttttcaggaaccattaggttgtattgaaaatctttg

SEQ ID NO: 19152 - DNA, 1051 bp, Homo sapiens
gtttcaccatgttggccaggctggtgttgaactcttgacctcaggtgatccaccctcctctgcctcccaaagtgctgtgattacaggcctcagccaccatgcccagccctgcgtctacatttctaaaccatagctgtgtggggttgaactcggagccaaaaagtgtgagagccatcaggggctggctctggataaactggtagccactatcagtgttaagtttcacatttaacctgcattggaattcccaggggtactgggaagaaagcagctgttctgtatcagtcctaccacctgccattaaccctttctctcctaggatcattttgagaatttgcctgcctgggcaggaaagggactatttctgtggaggaaaaaagtgaagattgattctctttactagttgctgctgatggatctctgtgacagagaaatcaccttatctcagactaatggggtgtgatgtgactagtcacatggcttttcattcttctctacgagaatacagcctatcaaaatgatgtctgttggaaatgtagaaccaatcaaacagataatttatgtatgtaatgtaatgagagcacttttcattgactgtgaactttttatttttgaatctgcactcgagccaatcttcttagaggcagcccggcaccttcatccataggcagagagagaactgggtgttggagacttattcgagggtataggaagggccctgtgaagttgatttaacttttggatgtcagactgtgaaagctcctgagaaacttggggtaataggatcttcttttggggatgaaaatggggaaggcgtgaggacctagactacttctccctagatcagaaaaagagaattaccccttgacaaatatgatacctgctaggtatttcccagggaaatttagggattggcgtctttccctagcatgtggaggaattggcagacagcttcctaagggcggggagcgggggcccaaggctgacactgcttgcatccacgtgaccttaagttatggcagatgactctgaaacggactgaggccaatga

SEQ ID NO: 19153 - DNA, 1030 bp, Homo sapiens
tggtttcagcaacagtactggaggaaaatctgatcagttagtgactagcacaaagaaaaagcaaagtgaattagaaatacaaaatcctaatttgtgatcctgtatattgatagctgggttgtaagatggatgttaaatatctgccttagctaatttccagctcatctggtttgttattccaaatagaagaaagagttctctagtttgacatccccattctgaaatgcaaagtttcaaaatgttttgtgtttatactctatgtggtgtagtatgctctggtgttctcttttgataatgaaacatcagtatttctactgttttatagcttttctccttttttagaaattaacatttttgctttcagaagaactttagcaattacttgtgaacattgtttatcacaaagtggaattccgtgatgaattccgttcagatcttttgagaactgtaaattggattgtttgtttctgtattgttgagttttaagagtctttgtatattttggaaacaagttctttatcagatacctgttttgcaaatattttctcccagtctggggcttgtctttccattcttttaacagtgtttttttgcagagcttttagttttaatgaaggcccacctgtcagtttttatctcatggatcgtgcttttggtattgtatctaaaactcatcgccaaacccaaggtcacctagattttcttctgtgttatcttctagaagtttagttttgtgttttacattttggtccatggtctgttttgagttaatatttgtgaaaagtgtaagctctgtatctatattcatgttttgcatgtaggtgtcctcttgttccaggaccatttgttgaaaagactatcctttgtatggtctttgctctttgattttcagagatcagttgactgtatttgtgtgggtccatttctgggctgttttgtcagaattctatattagagttcatctaaggaaacaaaatcaaaaaccatcatttttatgtgattgatactattagaattctggaagtatgag

SEQ ID NO: 19154 - DNA, 1038 bp, Homo sapiens
caagctttgccttctgggttcacgccattctcctgcctcagcttcctgagcagctgggactataggtgtccgccaccatgcccggctaatttttttgtttttgtatttttagtagagacggggtttcaccgtgctagccaggatggtctcgatctcctgaccttgtgatatgcccgccttggcccccccaaagtgctgggattgcaggcgggagccactgcagctggccatcttacttaatttttataagaatccccagaaggtaggttgtgttaagattcaaactgtataaatgagtaaagtaaagcgtaatgagaataaatagttcaagtaaacaaagtgacagaaccagcattcaaattcaagtatctctgacttcagagttcatgatcttaaccactctaccatactgcctttctctgggtacataggagatatggctgttggaagaagggttaatgtaacaatggcatccaaagtacaattttgcttcatagaccaaaattcaaaggtactcctactgtatataattcagtgatggactagatctaattttgtcttaactatattgcttggttacttatatctataaataaggttgttgaatgttgacacacaatgctttctttttccatttctgtattcttacactactttaatggtggattctgaagtattatttccttttcagaaaaaccatgccacatggatcgtttggatcgaatcctattgtctggcatctataatgtacgcaagggaaagacccagctgcataagtgggctgagcgcctagttgtcctctgtggtacctgccttatcgtttcctcagtgaaggattgtcaaactggaaagatgcacattttgcctctggttggtggaaaggtaagactcacaaagatgaattatttttcatttgatcatcttaattaagaaaatatcacataatgcttttcatagcttttagtcatatcttttcaaagaagccagtatgggcattattaaagattatatcagagactgtttcagaggttcagaggc

SEQ ID NO: 19155 - DNA, 1126 bp, Homo sapiens
ctgaaatttatacaaataaaaatactaaaaaattaaatgaaccatttttattacttaccaaatatatatatttttttgaattgtgtaatcaggagactggaacctactgaacgacctcttcagatcgtttatgattacttatccaggctgggatttgatgatcctgtgcgcatacaggaggaggctacaaatcctgacctcggctgtatgattcgattttatggtggtaagaatttatcagtggctttgtatgttaactacttttaggttgatcatttgtgcctcttatctgccgtcagctttttaaaggtattttatcaaaagctagttttaagccaattaactaacgtagttaacaccaaccaaacaacaacaaaagccaagaggtcaggggtaagggaacactttaaaaatatcttctctttttatttttgctcattttgcacttgtattttgctaacttactagcattattttatacctttgccagaatcttgactggatcatgctttagtaaattattttttcaagctcctggtaaagtctgtgaacttctggatagctcaaaaatgttgagagtaagtaatcattatcatatatgacttgacgttgatgagtatacctgtcaaatttgtatattggtgaatttagtggggtttaaatctaggatttttgactcttctgagaaaaatattttaagatgaatttgaggaacacgacccatctatcactataatagttaaaaaaacaaaaacttggaacagtaacatgcttcttatctgattgtggttgaaccctagttcttcattatggtagtccccccttatccactgggattgcgttccaagatccttagtggatgactgaaattgcagatagtactgaactctatatgtactatgtgttttcctgtatacacatacctatggtaaagtttaattgataaattaggcaaagtaagagattaacaatatttaattataaaatagtataattatagcaatatgctgtaataaaagttagtgaatgttctctctctcaaaatatcttgtactttacttcctattttcagaccatgattgactgcagataactaaaaccttggaaagcaagaccacaggtggca

SEQ ID NO: 19156 - DNA, 1050 bp, Homo sapiens
tagcttactgattaagtatagaacagatcatacctagcttgcattgtgtgtttttatggatattctcagatggagagacatatgtattggtcgtcactttttcataattattttgatcacataattgttgaaaacattccgattttaccaacttggccagttttaaatcaggcatctattaagttcttcctttgtattcacttcaatgcttagatgctttgggggattaaaaagcaaaagtagcaactatccttttggaattgaccttcaggaactcaaagtcctgttctataaaattgaataataggcctcatttttagttttcctttgatcttttctttcaggtgtcctccacacatctgtagtcctcctcacagaaatgtgtgagcgaagcccagacatgcttgcgcatttcagaaaggtaggtgccattctgtatgcctaagcctttcttgattgaaaaatgattttcctgaaaagtacatgattttcttcttatttttttttgaaagcaagctatggatctgaataagggatttaactagccctgctatgcaattggcctggaagccagatttaggcatataagtgagaactggcactagtattgtgttttccctttcataatagaagtcttctctcattgttggcagacacaccaatctcatgtgttttatctactgttttcacatttgagtcaagaaacatgatctgaggtcaaattagaaataggagttttgtgtgtgttgtttttttttttgagatgtagttttgctctttttgcccaggctggagtgcaatggcgtgatctcagctcactgcaacctcctcctcctgggttcaagtgattctcctgcctcagccttccttgtagctgggattacaggtgcgcgccaccatgcccatctaatttttgtatttttaggagagtcggggtttcaccatgttggccaagctggtcttgaactcctgacctcaggtgatcagcccgcctcagcctcccaaagtgctgggattacaggtgtgagccactgctcctggcctgttttt

SEQ ID NO: 19157 - DNA, 1051 bp, Homo sapiens
ttttgtttttttcaacctacctgcgagtatactgtttacccttttctcagctcctggccctgcggacgtcagcgtctaataattctcccggtcttcctgattgcctgaaagagtcgggacggttcggttgattgtgtttcccggttaggactcggtgtaggagatccatcgaaccactcgctcagggtaatgtttatgaagcagattatgtttatgaagcagattaaatggcttttgggaggcaagagctgtcaaatgttttctcatatgtggattccctccctgtgctgaatacttagctttttggtgcttactgacacttgtgtggtatttttttttctcccctattatatatccctgagcacggaaatctgtccatggagaaaaatattaatctgaggtaggtagaaaggagagttgggctgctttacagtgattagttaacagaagggaggagttagtgctttcttagtgaccttaactttgaagtgtttgtacagtaatgatctttgctgactgattctaaaaaatacttgtaatgatttcatgtattgggtttttctggggatagctgaattttaaatattcacttccaccgttccctagaatacttgtcaaatacctaacttgtcacacaccctaactttcacgtttgaaaaatatgaaccctctaagtactcgtaatctcgtcacttttattctaaaggcatgtttgcagtctagcatgcttgaataaaaagtatgtctttatttttatttatttattttttgagacgaagtctccctctgtctccaggctggagtgcagtggcacggtctcggctcactgcaacctacgcctcccgggttcaagcagttctcctgcctcagcctcccaagtagctgggactacaggcacacgccgccacgcccggctaattttttgttgttgtattttagtagagatggggtttcatcatgttgcccaggcagatctcgaactcctgagctcaggtaatccgcccgcctcggcctcccaaagtgctaggattacaggcgtgagccaccgtgc

SEQ ID NO: 19158 - DNA, 1049 bp, Homo sapiens
caatagtggcaagtagaaataggtaatttcattttctgaccatgtgagtctcctatcaccttgcagtgaaatagaaccaactaaatatatttaatttaatgctgcttgtctattaaaagtaaatgaaatggggcctagcgtggtggctcatacctgtcatctcagcacttttggaggccgaggcaggcagatcacttgaggtcaggaattcaagaccagcctggccaacatggcaaaaccctgtctccactaaaatccaaaaaaatagctgggcatggtgacacacgcctgtaatcctagctacttggggggctgaggcaggaggattgcttgaacccaggaggcaaaggttgcagtgagccgagatcacgccactggactccagcctggacgacagaatgagacttggtctcaaaaaaataaatacacaaaataaagtaaatgaaatggactcaaggtctggggggcaggaaagtctgcattaagctttgcttaaatataaaagttaattgacacttgagcagagtaacggctgagcttcattagatctgccttctgggaagacgaagattgtgtggcatgaaactaataggccacctaaagggatatattaagaattcccaggtcgggctcagtggctcatgcctgtaatcccagcactttgggaggccgaggcgggtggatcacctgaggtcaggagttcaagaccagcctggccaacatggtgaaaccctgcctctactaaaaaaaatacaaaaattagctgggcatggtggcgggtgcctgtaatcccagctactcgggaggctaaggcaggaaaatcgctctgacctgggagatggaggttgcagtgagccaaggtcgcgccattgcactccagcctgggcaacaagagcaaaactccatctcaaaaaaaaaaaaaaaaaaattccagccgggcgtggtcgctcacacctgtaatctcagcactttgggagtctgagacaggagaattgcttgaggccaggagttcgagaccagcttgggcaacatagtgggacctgatttct

SEQ ID NO: 19159 - DNA, 1038 bp, Homo sapiens
tgacaaactacacagaattctcaagactccctcacatgtgctgggcacagtggctcatgcctataatcccagcacttgggaggacatgctggaggattgcttgaagccaagagttcaaggtgagcctgggcaacatagggagatccatctctacaaaaataaaaaaataagaagttagccaggcatagtggtatgcacctatagttccagctactcaggggactgagtggggaggatcacttgagcctgggagaggctgcagtgagctctgattgcgccactgtactccagcctgggcaacagatcaagaccctgtctcaaaaataaaataaaaaagattccctcacataatcagcatcaagggctcaccattagagtcacttttaagggtcatctggagacagatctttcactgggttaaggcatttcttacctggaagggataacaaacttgctagctaaccacattagccaggctaagggtgtcaattgtacatggctatggaggcccattaagaaccttgtgtatcagatttaaaccatgactgaggcagtgatgcccagcaaagaggataaggaggaccttaaagcactggcacccaaggctggagaagcctgaggctgcaaagaattgaaggttttctccaagcatgacccctgtgttggccttgggggccctggagcagtctgaaaccatgtggaccatggctgggaagcacgttaggaaacagatcaagtaaactacctgacaaagcatttgggcaagagtgccctgggtgccagccagatgcagagaggagttgaaccatgcaccctggtcataggacagatcttcagaaggaatggaatttaaatggagctctgcttttcagcagtcagtgcaagaaatcagggacttgcataaacttgccaagccgcaaagcaaatccccttccactgaagaggtgctgggcttgtcgtaggatgtgacccactggatgctggcaggcggttcttctgagagactgagagatgctggaaaactcagcatctcagtga

SEQ ID NO: 19160 - DNA, 1048 bp, Homo sapiens
tggtcttgcctctggaagagcagtgctgtggggcatctgctggtctttttatgctgccactagctcacttctcccccttctccatttcgtaattcctgtgtctacaaactttggacctggtaaggtctctatcttttccagtaacaaaactccaaacattgcccctgttaagagttgagctcttgcttcacacttgattttcccgtggtgttcttttttgttttttgttttttttgagacagagtttcactcctgttgcccaggctggagtacaatggcatgatctcagctcaccacaacttctacctccgaggttcaagcaattctcctgcctcagcctcccgagtagctgggattacaggcatatatcaccatgcctggctaattttttgtatttttagtagagacgaggtttctccatgttgctctggctgatctcaaactcccaccctcaagtgatccacccgccttagcctcccaaagtgttgagattacaggtgtgagccatcacgcccagccccctcgtgagggcttttgatcgtctttctctcacatcttgatttgtatttttgatcctatcttagtttctttccattccacaagtatttgttaagtgcctgctgtatgccccatcctatgctcacagctacgtaagtacagatggctccttagaggaggcagtgcctgcatgttgaaggcgggtaggaggtgctaatacagcaaggggaagggaatttcagcagagggcccccgaggaaataaagcccaagaactggagacggccgggcttgtcagagagcaacatggagtttggtgttgctgaagcccacaggctgaggccaggagatgttgctagggaggaaggcagagaagatgagtgatcaagagaatgccagagcttttctcttaccattattttaccagaagccacttacttaatacaatcagacaattctttaagaaaactggggagtagcttgttcttccaggaaacttggtgctgaagagaactaccagaggaaaaggtgtaagtgactgtgttctgaga

SEQ ID NO: 19161 - DNA, 1034 bp, Homo sapiens
ttcctggctagcaataacctgtcatactgtcatgcatcagtgtgccacggggggacgtggtcctgaggacaaacgaggcttcgcatttgagaccctcccagaccttgctctatgcatctctccttttggctggttctaatttgtacctttttggtataataaagctataatggtaagtacggcactctccggagttctgaaagtcattctagcaaatactgaacctgcaggggtccatggggacaccagtaaggatggtgtctacacctgcagctggtatctgaagtgagggcgttctcacggaggcctgtgcctgcgacctgtcaagtctggcctaactccagggaccagcacagacgcagaagcccaaggcgcacttctcaccactgcactggggtttccaaccccctcgctcatgagtaaagctgtgaaacccatcctgctactccaggctgcctcaggccctgaatccctgcaggtgtactgtcgctcctttaaagctgtcaggaactcctcccacacatccatgtgaccaccaaatgcacaagcaacttctgtcaccagtttgccttcacacatgcaccttcccataaatcctgaccctgcatcagggcctggtctctggcagcctcctgggatgggtgccaccccagccagagcccgaaggccggagctcacctgacactgcccagggggctgcgcttctcctgctcctgccgccgggctcgcagctgctcctcggccagcgccatctcctcctccatggcagaggcttcctctttggcccgacgacggttctcctattgaagagggacagacctggctgagcctactggggaccactaaggaaggaggcctcgtcggcacccaagtccctgccacaaaccaggtgctgcatccaccaggccagtgctccacatggctgcctgccccagtaccaaagccgccttctcttctgcagctgaggcctgcttttttcactgactcaagacactggacaatcagtcctaactcagtcatccctcagtccagga

SEQ ID NO: 19162 - DNA, 1067 bp, Homo sapiens
aggtggccatgagacgaacttaatgtgtcatttgtcctgagaacccctggctagcatcactcttactgtactagggaagacttcacctcaacactgtgttttgctttgagtcaaccactggtgacccagtagccgtgggagggaaattgcccctgttttcctcatagcctgtcagtctctattacatcagagaaagctgaaaaattgattcttttttgtccctgtccaaatgtggcagctgtttaatttcaattagcaaagcttgaaaaagaatattatgccaggagtaattaaagcaggagggggttccttgctcacctgcactccatcctcctaattggggatctgaggtgtcccccagcaggactgtgaagtttgggttctggggaattctggtgcctggggctttgatgtagctctctcttcaaacaagtgacaggacaggaagcataagcctccaggaaggattcatttaactttttaaagtctaaaaattagctgtacagatcagacttgtctacaccaaaatgccaacttgttcacttcaagcccttgcttttgctctctataagtcatctgtctgctttcaaagctcctcctactctcctgctggggaaggccaactcctttctcctttatcaaacaagtatttgttctggttgacacattaaaatctttaccaacaagtgaagcaaccccctacctgcaacttcgtaagtttcgctgcatccgtcagagtcccaggaggaaacagaattcactcctaatggtacaggtggatggaatttaaggaaggggctactgacagaggaatagacaggggtatgagaacaagcaaggaaaggtgcccaaagactaacaacaccaggaagctgttactacccatagggtgaaaggaacaatggaaggaccagagccagtgagagctgggggaacggcccagcagtggctgtagtcagagaaggatgtgaccttcccagagaggctgaagcagggtaagaacagggaaaacatgccctgctgcctttccatcttctgcatgtgcctcccatggccaaatagccagg

SEQ ID NO: 19163 - DNA, 1031 bp, Homo sapiens
acatgtcagacattgtacttggtattttacagacatgatcccattttaatcctcaaaataattgtgcccagttaatgagattaccgtattacagacaacaaaataggaattcagaaagtcactcaacctgtgactattgtcaaatgatggtacaaggattcaaacctaagtggaaagctaaggtccgtataatgtttaaggtccttgtaatttttaaggtcttgcgtgcacgcccactccatacaccttatgtcttggatctcaattcctattatctcttcttcactatcctccaaccctgcaagcctactcccacctcagggcctttgcactggctgttccttcagcctgaaaccccttccccacatgtctaaatgatgtattccctcaccttctcaggtctttgctccaatgtcaccttcttagtgagacttctgatcatcctatttaaaaccacaacctacaacccactccccactcccaatcattcttaccccaatctgttttcttttcctgtagcatttatcaccctctaatgctatttttattgtctgctcctcttgctagaatgtatgctccaccaagacatcgatttttgtctgttttgttcttgatgttccttagctactagaactgtgcctagcacatagtatggggtcattaagtgttgactgaataagtgaaagactcaattgattccaaagctgtgctctttcctcaatggccccagtaatgagcttctagagattttcattttaaacattattaatctgaatctctccttctgctctctgactttctcctttcaccaaacaatgggaagaaaccctcccctcaactacctggctggtgtttatgttattgagggtcatggttaaggatcagagtatgcaggatattatttgtctcatatccgtgagggtctctgttgtgtttggggctgtgagaagatgaccaggggtcctgtgtatacaaaggctagatgtgacatgcttctagttacctagcaaggggactgtcagctcttctag

SEQ ID NO: 19164 - DNA, 1136 bp, Homo sapiens
tttttctatgcatcgatttcttccttggattattttgaagttaatattgcaggtgccctgaattctgttggaatctaatcatctagcattcagaagatatatcaaagagtggtccagggagtctggcttggaccttcaacttcagccttgcaggtagtatcctgagattaaataagcatagtcaaacacaggttccttcaggcctaatttttatgttttaaatatgtaaataactccttattgtagggtcatcataattaatatggtattcccaatcctacattaatttattttttattcctgcaggtttcaagttcgaaaaaagatagaataactaaatgctatgctagctcacagcattattgctcaagaggaataatgctcttgtactttagagtaggtaactaccctagtttttcatctagagttgctgcatatgtatattcctctttctctgtgtgtgtgtgtgtgtgtgtgtgtgtgtgtgtgtgtgtgtgttcatggaatggctggaatctgtttaatctcctaaatagattgagcacatacacagcaagagcattcagactataggcttttcgtcaaggacacgattctctttctaatgcatatttgggactgacagacagaattactgaggatcagcagtcatggggagaaaaggaaaaacaagtgaaatggtagattgaaatggtgtttaagggccagtttctctgcatgtgctccctctacagaaagggtcctaggggctgtggggaaataggcggcctccgggctgtgagctaatgcggcaccactgctgtttgcatagctgcacagccctaggagagacctgggaaagctagcttgaattccaatgaatatttacaattacactgctccgtagcagaatgcaatcatagtgctccagtctacaggttttatgcatcaaaagaaaatgagaggagagcagcaaaaatggagttgcctttggagagacttacaaacacagatctcactgctgtggcagaactaaaatgctttatttctgataagagcaatttattcttcaggcatcttccttgatagtagaaagcacctgactgggttttgaagtgagaaagtcttcagtagatggtttttaattctgagcaaga

SEQ ID NO: 19165 - DNA, 1061 bp, Homo sapiens
ccattcaatggagaaaggatagtttttcaacaaatggagctggaattattatacatacgtctgcaaagaaaaataatctcagcccttagtgcatttgtatacaaaatttcttggattagaaaaagatttttaggtagaacacagcacaaaccataaaagaagaaactgatacattgacttttataaaaaaccttgaaatgttgctctttaaaagacattgttgaaaaacgaaattatatgacacagaatataagaaatatttggaaaatgtatttctgataaaggacttatatccagactatatttaaaaaccttcaaaaatcaacaattaaaaaaaatcttaaaatggacaagaattggaaggacactttaccaaaaaagatatagttggtaagtaagtacatgaaaatatgctcagcagcattagttgttagagaggtgttaagttaaaaccacaatgaaataccactatacgcctattaaaatatctaaaattaaaaatattgatcataacaagtgctgacaagaatgcagaacaactgaaactcaaagaagggatattagaaatcagtgggaaaatgacagacagttaaattaatttgatgtaccaattggtaatccatatgaaaataaaattagttttctaactcatataaccaaaaaaaaaaaaaaaatccacaggttaaagacccagatatgaggggtggagtaagcaaaagcattaaactccataaagaaaatatacgagagtatggtaagaaggagcatattgaccaaaatgccaaaagcacaaaccagaaaagaaaatattaataaacttgtctacattaaaacttttaaaatttcctattctacaaaagacaccacaaacaaaattcaaaggtaagagataggtgaggcaagatatctataacatatactattgatgtatagttacaatatacacaaagaatttgtagccacaatatatccaagatgcattcaactctttttttttttaattatctacatgtgcacattgtgcaggttagatacatatgtatacatgtgtcatgctggtg

SEQ ID NO: 19166 - DNA, 1072 bp, Homo sapiens
gttctctgggctgcctttaaaagaaaatctacaaagcaaatgtgaaaagatttagatagaaatgaaaattaaagttctatatattaaaattcatgcactgtaaccacatggtactgaagcataaatgtatacctttaaatatatttgtgaagcataaaaaagattgtaaaaaagtaacttaagtgtttgactcatgaagctagaacagaataaataaaaaaaaaagtagaaggaaagaaataatggagaaaaaagcataaactaataaaattaaaaacaaagaaataatacagaggatcaacaagtcaaaaaccagtctttgaaaagagtaaaaaaaaaaaaaaagcatgtagccagacaaattaagaacagatataaaaaacacagattaataaaaattaggattaaaaaatagaacagaggtataaatctgtagagaatttttcaatcacttatgaatattatgaataattgtatgccaatatattcaaaaacatttaaaatggactttttaatttttttgagacagcgtctcactctgttgcccaggctggagcacaatggcgcaatcttggctcactgcaacctctgcctcccagattcaagtgattctcctgcctcagcctgctgagtagctgggattacagtcatgcaccaccatgcccagctaatttttgtatttttttttttttttcagtagagacgggatttcaccatgttggtcaggctggtctcgaactcctgacctcatgatccacctggcttggcctcccaaagtgctggctcccaggcgtgagccaccgcgcccagcctaaaatggacttttcttaaattataaaaattatccagaaagaaataaaaatctgaataaatgaataatcattaagaaaattgaattagtaatcaaagaatccatgtaaaaaggaccagaaatgacgattttaccacacatttaaggaaaattaattactgttttatacaaacttgattagaaaatagtaaaaagataaagcaggcataccaaatttttcttatgaagcaagagtagttttggtactgatggaaataactg

SEQ ID NO: 19167 - DNA, 1114 bp, Homo sapiens
tcggtcctgtagcaggttgcctgatggattggtgagtaatgtacttgaagagtgcattactgagctctagactaatggctacctcttgcctatggcctttatggtagatcattcattgtgctgcctcatcagcttcctgccagtctgtatctggcatgagcactgcctgttccaaagctgattaataccccgggaataagtcccattgcaggtctcagggtggattacacaaaagtaggaatgttctggtgcttggggacaacataacttttctttcatgaataaaacagaaaaaaacatctttctatattgtcaaagtagaggtctgcacaaattataaattttctaaattattgttgattacagttagcatgttaaaggaataataacacacattaaataccagactctttggtgctttaagcagcccaagatttcttcagattcagtttcctgaaattgtgtgcgtgaaataagagccaagaaacaaaagcaaataatagaagaccacttgtgactcaggattaaatgcggactgtaattctaggagaagttggaggagagggaagttgacagtgaccagagatatagacaccatggaggaaatgcaggttaagctgactcttaaaggctagaattgggtaggcaatggggagggtggctatgacaagtcagaaaacagcatgagcaaaagcataaaagtattaaagagtatgacatattgatgggccagaaagaagaaaagcctgactagagtagagaatgtgggtttggaagtagaggtagtaaagaatcaagcacaggctgacaggacttctgatagtgtgatagactgactcacctaaaagacatccagctgtaatgacctagaaatggtacatataacatagaatatatttcctttggaatagttggctgaccttctagaaaaatgaaaaaaattatataccggggtcagaaatgacctagaaacttataatcggagtgataaacacatgtaccaagtctgtggctcacccaagaagttggacctgatgagagacagagattattagtcttggaaatctggaagcttgatttaacacccatgagtggacagagaatgagaccttga

SEQ ID NO: 19168 - DNA, 1048 bp, Homo sapiens
tcagtatgaacttaccgacactaattttattctataggttataatccattattatcattattttgatatataagttgttccaaatttgtcaagtagcccctttaaactgtctcctatactcttttgatatgtccccatcattctttgagcgttttctcatttgctggagcaagatattctaggctcaccttatacttccctgtactggtcaaaaattagccttttctccatggagcctaattgcttttagtagacagtggcatttttaaaccaaaatctgtgtactaagtgtgctcactgatgttggtgtatcattgcatctatgctccctcaactgatagaagtaggaaatttgtttttatagttctaaaacacactttttttatatatacctatatctatatttttaatcattactttaaaagtgttcatcttgataactttaattccacttcaacatcataggttaaattctagtcttccccctttccatatttataactcctgtctctaacactgaagaaatctggtttccattattcttaatgtatttattcatttgctcaagcctagacacggaagttagttttacattactcactcagattattacaaaaacccaagcctactaattagaatttaatattttgtagttcttttttgagataaaattcacatacagtgaaatgtccattttgatgagtttggttttttcaaatatatctatccatgtaatgcatgcccctattaaagtattgaacatcattcaagaaaggtttttttggggtcctttttttactcaatcctcctgatacaattttctgatatatttttcaccatagattagttttacctgttttataactttatttaaattgaatcatatagtgtatgtgctctgttgtgtccaactacctctgctcagcataatgtctgtgagatccatttatgttgttttgagtgtcagtagtttattcttcattgctgagtaatacttcattgcatgaatataatatactatgattagtttattcattctcccatttgt

SEQ ID NO: 19169 - DNA, 1050 bp, Homo sapiens
tgttccatggacaatggtggagagaagtataatcgtagatggcagtatggtagcccaaacttgataacatctgaagccataaaacttatttagatcctccagaaggggtatcaaaggagtaagaaacttggaatttagccttgaaagtgcccagttgtaggaaatgaactaaagatggacacatcagagagagttggaaggaattgttgaatctctaaattgtcataaatccatacaatccatataatagacaatgttataaattcacctcaaaatctaccaaaggggacctccagtaagctattaagaacctgaagacagtgttttactcaagccaaagcaagagagaagagaaataactgtgctggtttacaccgaattacattacaggattatacagggcttttccagacagtatcttgacttctacaacaacttactgaaatgattgtttttatgctccttgtactgatgaggaagggaaagaaggactaattgcctaaatttctagaaaatggaaacaatgtggagaaaccactgaatctggacaaggaagacatttccgaaaagattgagtctctcaaatttcacattgtgattggggaaaaattctttccacataggccttattttgtatttcctttttttttttttttttttttgagacagagtctcactctgtcacccaagctggaatgaatctcggctcactgcaacctcctcccactgggttcaagcaattctcgtgcctcagccttctgggtagctgggactacaggcacccgccaccacacctggctaattttctgtatttttagtagagatggagtttcaccatgttggccaggctggtctcgaactcctgacctcaagtgatccgcccacctcagcctcccaaagtgctaggattacaggcatgagccaccatgcctggccagccttattttaaagatgagaatttctgaactcttaacaatccttgctgatagtagaagactttctgtagtttgtcatggagcagtctcccataattcagagcagtaataagca

SEQ ID NO: 19170 - DNA, 1030 bp, Homo sapiens
gataatagaacttcccaaacctagagaaagatatcaatatccaaatacaagaaggttgtagaacatcaagcagatttaacccaaagattactacctcaaagcatttagtaatgaaattcccaaaggtcagggataaaggatcctaaaaggaacaagagagaagaaacagataacatacaatggagctccagtacatctggcagcacacttttcagtggaaatcttagaggttgggggtgattgacatgacatatttgctgaaaggaaaaaaaatttaccttagaatagtatatctggtgaaaatacccttcaaacatgaaaaagaaataaagactttcccagacaaacaatagctgagggacttcataaacaccagaactgtcctgcaagaaatgctaaagggagtacttcaatcaaaaagaaaaggatgttaatgagcaataagaaatcatctaaaggtacaaaactcactggtaatagtaagtacaaagaaaaacccagaatatcgtaaaactgtaactatgatgtatgaaccactcttaagcagaaagactaaatgatgaaccaatcagaaataataactacaacttttgaagacacagttcaataagatacattaataaatagaagcaacacaaagttaaaaagtggggggactaagttaaagtgcagaatgcttattttctttttgcttgtttctttgttgtgtatgcaaacagtgttcagttgtgttcagcttaaaataatgggttgcaaaatagtatttgcaagcttcatggtgacctcaaaccaaaaaacatacaacagatacacaaaaaaataaaaagtaagaaactaaattatatcatgaaagaaaatcatcttcactaaaaggaaaacaggaaggaaagaaagaaacgagaggaccacaaaacgaccacaaaaataacaaaatggcaggagaaagttcttacttatcaataatagcattgaatgtaaatagactaaaccctccaatcaaaagacatagagtggctaaatggattttttt

SEQ ID NO: 19171 - DNA, 1031 bp, Homo sapiens
gctatttttaattttagccattctgatagatgtgtagggatgtcttattgtggttataatttgtgtttccccagtggtttgtggctaatgatgcctaatattttttcaagtgcttatttgcatctgtatatcttctttggtgaaatatcttcatgtctgttgcctgtgttctaattggagtatatgcttttttactgttgttttaagagttctctaactagactattttcttccactctgtagtttgcctttttatcctcttagcgtggtcttctacagagcaaaagtttttaattttgatgagatcatatttagcactttttcctttcatggatcatgtttctggtgttgagtctcagagccctttccatagccctagatctggaagtttttccccagtgttttttctaaaatttgtttatagttttacatttcacattgaattctgtgaattattatgagttaatttttatatgaaatgtgaggcttaggttcaggttgttctttagtctatagattgtcaatttctccagcagcatttgtcataaggctggttttttcctccattgaattgcttttgcaactttgtcaaaaatcatttgggcatacttatgtggctctatttctgggttcctattttgttccattgatatgtttctattatcccatgaataccatactatcttgattgttatctctaagtcttgaaactagttagactgattcttcacacaatgttcttttgcaaaattgttacagctattctagttgtctttccatatgaattttaaaataatcttttctatatagaaacatctttctgagatttttatagttaaacctgcatattcatttggggagaaatgacaccattgctaggctgagtcttcccatccatggacacaatatgtttttctatttatttgtagttttcaacctacaagtcctttatatgttttcttagatttacatctaagtatttcactttttaaaattgttattaccaaaaaaaatattttagatacagggtc

SEQ ID NO: 19172 - DNA, 1024 bp, Homo sapiens
ctctaaaatttaagagtatttacaccttagttttcagaatggaattgtctgcaaatataagcgatcgactaatggttgttctccatttaaagcaaagataactgtttatcttagctgattacagaccaccaaacctaaggatactttgtagatcattatagctgagaagggatataaaaaatgaacaccaacaaaattgcataaaggaaatggattcttatcatcattataaccaagtgtttgttactgactgccttctctcttctttttctccacccccacatctccctgtacatctttccatttcgggggaaactgtgaacatttttatgattttttttctctaattaagctccattctctgttaagtggacaatgacatgataacttagttggactaatgtagtgttacatggtggagattctttatcatgcctattgaggttctgcttttttaaaatctcttttagctgggaaagaattaattcataatttaccataatgttcaaaggtagggtagaagtttcttttttaaaaataaaccatgatattttcaacagcttaaattaggtgatttactttttgctatcatagtaacctggattcttccatcttttgaagtggaaactgtcctaaccccataacctcgacatcactgtgagtaaaactctttttaattatatgactgtgtagtgtgcacattagcattgctaatcagcttactgcagtggatttgtatcttcactactaatgttcatagaatgtccattgacataattgcaggtctgtatcagtgcttagatgctactgtatttaaaaccacaggtcggaatttattagtgcataccacagtatatggaaaaattttaaacccgatacaattgtatgtcactaacttgagtttacatagttttatctgaaatcttcatggtacataatgctataatacactggatctttagcttaaaaataaaaagacactatctcacttgtttttgctgtatttttttcttctatgattgaa

SEQ ID NO: 19173 - DNA, 1049 bp, Homo sapiens
ttagcttgtcagtttctgccaaaagacatctgatattttgatagaattcctaatgaatctgtagttcacaatttggggagtgtggacatttaatactattaagtctttcagtccatcggaagaccactggatgtctttccatttatttagatccttgaaaatttttaaatttctttcaattatgttttatagattttagtatacatgtctgtcctgttattatatttattcctaagtattttattcttgttgatgctattgtaaatgcaattgttcactaagttttattttcaaattgtagtctatacattggtagcatatagagatacaattgatttttatattttagtcttatgttcttcaactttgctaagctcgtttaatagatctaatagcttttttggtttattccttagggttttgaatgtacaagatgcagtccagagcttattcatgctcttgagtttttaatttcggtgactgtattttcatttctagtttttttccacatataccgttgttatttcatatctgactcattttatagcttattgccttttgcctgaaatattttatatttattttatttatgccttcaaatattccaaacatacttcgctgaaagtcatggaagtcgttgttaggctttttcaatgaaactaatgctatgtggagtgaattcattttctttttctctaattttttttttttttttagacaaggtctcactctgttgccccagctggagtgcagatctcggctctcggctcacagcaacttcagcctcctgggttgaagctatcttcccacctcagcctcatgattagctgggactataggctcatgccacctcacccagcctatttttaaatttctttttgtagagatggaatctagccatgttacccagcctggtcttgaacttctgagttcaagtgatcctcctgcctcagcttcccaaggtactgagattacaggtgtgaactaccacacctggccagagcgaattcattttctgagtgttgatttgttgattttgtttgatacct

SEQ ID NO: 19174 - DNA, 1027 bp, Homo sapiens
aaaaaccacacagctaacatacttcttggtgaaatactaaatgcttttcagaaaggtcaggtacaagatgatgtccactctcagtacttctctttaaccttgtactagaagttctagccagagcatttaagtaagagaaaggaataaaaggcatccagtttggggaaaaaaatgtaaaactctttctgtttgcatgatcttgtataagcatacttcattttactgtgcttcacagatactgcctttttttttttttcttttttaaacaaatggatggtttgtggcaaccctgtgtggatgaagcctataggcacaatttttccaacagcacgtcctcattttgtctctctgtgtcacattttggtaattcttgcaatatttcaaacttttttatcattattatatctgttatgctcatctacgatcagtgatctttgatgttactattgtaattgttttgaggcactacaaactgtctatgaaagatggtgaacttaatgaatgtgatgtgtgtttctgactgctccactgactggccatttccctgtctctccctatcctcaggcctccctattccctaagatacaacagtattcaaattaggtcaattaataaccttgcattggcctcttagtgttcgattgaaaggaagagttgcacatctctcactttaaatcaaagctagaaatgattaaccttaatgaggaaggcatgtcaaaagccaagataggccaaaatctaggcctcttgtgccaaacgattatccaaattgtgagtgcaaaggaaaaattcttgaaggaaattaaaagtgctacgccagtgaacatacaaatgataagaaagcaaaataggcttattgccaatgtggagaaagtgttagtggtagaagatcaaaccagtcacaacattcccttaagccaaagctggatccagatacaaggccttacttctcttcagttctagaaggccatgaaaggcaaggaagctgtaggaaaaaaaaaaaaaaaataggccgggtacggtggct

SEQ ID NO: 19175 - DNA, 1059 bp, Homo sapiens
taaattagaaacaagggaaagaaatttgggaaatccagaaatatatgaataattaacaatacacacatgaccaatgaatgaaaaatttaacaaatgaagtgagaaaatacttagagattaatgaaaataaaaataaaacacagcaaaaggtatgagatacagttaaagcagtacttacatgaaattattggtataatgcctatatttaaaaaaagttgaagtcaataacaatcttaagaagcaataaaaagaacaaactaaacacagtgaggcagaagaaaataattaaaatttgaacaaaaataaatataatacaagatagaaaaacaatagagaaaatcaatgaaaccaaaatttggttcttcgaaaagatcaacaaaatggacaaaactttagcagaccaataaaaaagaagattcaaattattaaaatcagaaatgaaagaggaaacaacacttaaaccgcatgttctcacttataagtgggagctgaatgatgagaacacatggacacaaggaggggaacaaaacacactgggccctgtagggggtggagctggagggagggagagcatcaaggataaatagctaatgcatgcgggacttaatacatagatgatgagttgataggtgtggcaaaccaccacggcacacgtttatctatgtaacaaacctacacgtcctgcacatgtattccacaacataaaattaaagaaatgaaatgaaaaggattgtaaggtaacactataaaccactgtacaccaacaaattatacaacttgagatggaaaattcctaggaagacaaaaactaccaaagctgactcaagaaaaaataaaaatttgaatagacctgtataaaaagtaaagaaatttaattagtaatttttaaaattcccacaagcctaggcccaaataccttcattggtaaattgtaccatttgtttaaagaacattaacaccaatcctttacaaatgcttacaaaaatacctgagtaggaagtacttcccaacttactcttgtcaagtcagtatttccccgattccaaaactagacaaagc

SEQ ID NO: 19176 - DNA, 1073 bp, Homo sapiens
tcttttggcaatacctacacagacacaccctggattaatactttgtatccctcaatccaatcaagttgacactcagtactaaccatcacagacatgtaggcagaactacaaaaaggaaaagaaggaactgtgatagctatcatgtgagaactgtgtaataactatgtaatgggattttataaatattctgataatttttttaaacgacataagtaagctaaggttttcttatattccacactacatggtgaggattgagttactctttttatagtatctttaaggttcacaattaaaatatattatgaaatctgccagacacagtgggccacgcctgtaatcccaacactttgggaggccaaggtgggtggatcatttgtagtcaggagttcgagacccacctggccaacatggtgaaaccaccactgtactaaaaatacaaaaattagctgggtgtggtggtgtgcacttgtagtcccagctacttgggaggctgaggtgggaggatcgtttgaacttgggaggtggaggttgcagtgagccaaggtggtaccactgcactccagcctgggtgagagtgagactctgtctcaaaaaataaagaaaatatattatgaaatagttacagtactgtaaaaagtattacagtatggcacaaacttgtggcagcatgtgcagctgttctcagaaggcaatgcagagtggtgtgggcgtgtcattgctctaaacttttcaatgattgctaatgactatttcacttgggcatgtaaaaaccataaacttaattccattaattctcaatacaaaaagatgtgttcatggaatgttcaggttttcattttccattgcttttcagaccctagggaaaccttgaaattattccttaaaatctgaaacaagagtttagatgtagaccttcatgttttgttactcctgacattatccctggataatatcattcattctaacagttttagccacaatacatatgtggtgacttaaagcacacctcaataccaccattttcttttctttttttttttttgtttttttgtttgtttgcttgtttgttt

SEQ ID NO: 19177 - DNA, 1027 bp, Homo sapiens
atgagatttaaacctagtgactcatattttacatctaaatgtagcgatggctttatgaataactgtttatacttagcaagtattggacattatattcaggaagtatttgttgagttgaattacagctctctcaactatgagatacatttctagattcattagtagtggactgtttctagtattccctaattccatattattaattcatagacatgcggacacaaagcaacctggaatttctcttcagctccaggatgttctgagttgatagaagcttgagccaacaatacctagatcagacttgttagatatacggaaataatttataaaaaccatttatttcagattaaacctatatctgccttattactaaatttctgcaggtatattattacagtgttttaaactttgacactctagaattataggatgaaagtgagtagcagggagaacagcagaatattggatttaacataatagtggaactcatgtagtttagcacaggaaggaatagacaggagcatgttattataaattggattttcagttggttcatacatgtcatacaatatgaaagtgttcatttaggttcttatcaacttcaggaagatggcaagttggctgcttttgcagctgcatctgttatagtttcttattccccaataattatgaactgtatatattcaagatataatatacacatggcactgatggagctattatgctatcattatcagtagtattcactcctaccctgccaaataagcaccatactgaatgttttggatggggaaaaaagggacaagccagtgcagcaatggtggtggttagtcacttatactatagcaaaaaattggactggagaaggaccatttccttcagcataactctctatatttcataacctttgcccaaaactattcaaaccagcaaaaatgacttatcctaatttataaaatgtttgccaacattaattagatgtttcttctacttctctttatatagattaccttgaaggaatgtatgt

SEQ ID NO: 19178 - DNA, 1045 bp, Homo sapiens
tttcaaaacatacttttggaggtctaatgtatttccttataaaaatgaaattaaaagtaggttttaataccccagaagaattttaaataaccaataaattcaaaagaaatcacagttataaaagaggaacaaaatagctcttgttcagttcatatgaaccatattgatcttggttcaacttgccaattccaaaatacttaaaatacaaacattctaaattaatctttactcatttaatataacaaactgttgtcacagtaaattggaatctaaaatttaaaaaactcactgcacaacagaatttggaatatgagatctttgaccattttacctcatggacgtgagaataacacatgagaataacatcataatgttgttcttctgtgatgttattaatagaatgaaaaaacacagaagggtagaaaattgtcagttaaagctttgttatgtacagaagcaatcataaaagtaatttagcactaatattcaaaaaaggatagcagtgaccctgaacatgattctgttgttagtctatcatgaaccactcctaaaataataaaacaaatatttagtggcaaaaaagtggtgccttcttaagattataaacattataagcaagattataaacattaagcagcattagagtttttaaaataaacaaatcattgtagagaaacttcattagtgatttataagagaggatacacatcatgttaattaaatttacagatgatgctaaattggatggtgttggcaaaaccagtgagggcagataaaagggacctaaagtggttagaaatatgggcaggaaatgaaatgtgattcaacctggaaaaatgtagctaatacatctggggaaaaatgatcagaaacacagccattcaactggcaggatatacagtacttggaaagcagtattaccaagagactttgagatgatagtggtagcaaattatataaggtcttgtaatgcaatgtggcagtaaaatcagtcaatgagattttagtctgtatatgcaaaagcttcacatcatgtggctgaaag

SEQ ID NO: 19179 - DNA, 1029 bp, Homo sapiens
caatgttttcaactcatagaaagtaatggtcagaaaaggtagaaaacgtaagatgggatatctcatgaaacataatttagtcacgtacacagacacaaaaatgggccgggtgtggtggctcacacctgtaatcccaacactttgagagactgagacaggtggatcacttgaatccaggagtttgagaccagcctgggcaacacggcaaaagcccatctctataaaaaatacagaaaaataagttagccaggcatagtggcatgtgcctgtaatcccagctacttgagagactgaggtgggaggatcacttgaacccaggaggtggaggttgcagtgaggcaagattgagccactgctctccagcctgggtgacagagtgagaccgtgtctcaaaacaaaacaaaacgaaaaaatgtaaatgaggctacaccaaagtaagtttctaagtggtacttttgttagccaggcaaggaaaatcatttactgatagtgagttaattaaattgtgtttggttgtagtggctgaagatatgtatcctaagaaaattaacatttaaaagattgtttgcctttccataaggaaaactgaggacactgggaacaccaccagtggtcaattataaaacaaggcaaaaaagaaaaaggcagtcgattttcttgactcttgaatagtctctttgagacaactacaggcaaaatgtataaaaaacattaacttagtataacctgaagtggaatctgctaagatgtattaaaactgtcagtggtaaagatttatgtggaacagaaaaagacttagttggacaaagttataaaagccatagttaaagccatagtttttcattgtattatttatcagcaggtattttgtggaaaatatttgaaactctttttttgtgttattgaaccagtagtgttaacagtgaacttcactgcttttgcaagttaaatatcatttgttctgtgaatttttgtccaaaagagatgccggctatcctgaatttatttaccacacaaaagttcaatgac

SEQ ID NO: 19180 - DNA, 1047 bp, Homo sapiens
taaacttgaaatattttttaaaatgtagaatgtttacacattattaaattctacagggcaaaatggtacccactgaactataataccacccatatatagaagacacataggtcttctttccagaagcagccactattacccgtttctgctgtgtatttctagatatgttttatgcatatgtgaatatataaaaataaatgcatgcacatatgctttaaaaaacatacaccagaaaaataaataaataaaaagcacacacctacatgtacggtagtattctttacaaactgttctgcatcttgctgttgtttgcttgatcacagatcatgccacattagtacctgtaaagctgccgtttttttaaaaaatgaagcgttgcattctattatatagatgtctatctaacaagtttcttcatttttgtcatctaagtttttttcattttcttagttataaattcatatctgatggatgttactgtcaaatagtgattttatacctgtataggtgtatctaggaactgcaggttaaaatgtatgtacattttattggttttctctgtaatgtctgtttttctatttcaataattttcactcacatattctttcctctgctttcttagatttaaatttgtactttttaaaacttagatgattttaaacttttccccctaatgtaaacattaagagctatagattttccttcaaacactgttttagctgcacccttaatttttgatacgttgtatgtttattattcagttcaaagcattttataattgtggtttcttatttgtcctatatgttattaagaagcatattactgtaattacaaatacttggggcttttctaaatatctttttgtaattgatttccaatttgattctgttttggtcacaatacaaacaccgtattagatcagcttttaaagtttattgagactttaaaaaaattattgagatgcattagaagaattggtgaatgttttttctgcacttgaatgtatgttctgcagtttctcgatttactcttctagaacttaattag

SEQ ID NO: 19181 - DNA, 2037 bp, Homo sapiens
taataaaatttgtgttgatgagttgactttttaaaaaaatctataaatctgatgaaattagtccttgtattacagtcttccctggatttaactacctatttttattccaaggatatgtaatttttttccaagacacaaggtcttgctgtgttgccctggctggagtacagtggtgcaatcatagctcagtgcaacctcaatctcctagactcaagcaatcctcctgcctcagcctcccatgttgctgggataacgggtatgagccactatgcccagcccaaggatatgtaataatctaagttttatcatcaaaatattcaccagaattgcctaagtcatttggcaatcattttacatggctttttgaagtacagaaataatatatacttctgaataagcaagaggtttttgttttttatttgccattatctgatcaatttcatgaaagttaattccatagacgagtcttaattgataagatcaatatattgtaagtaattattgatcctcaggataaaccaagtagtcttctattttttttcttacccaaactgatttttctatatcagtttagttttgtttttttttttttttttttagtttctataatatcctggtcatgtgatagttactttagaaaaatgacacaaaatctttatcataaaattagttaggaggtgtgctgcaattatcactataatatttgatttcatcctatctgtttcttgtttctttttttttttttttttttttttttgagacagagtctcgttctgttgcctatgctggagtgcagggatgtgatctcgactcactgcaacctccacctcctcgattcaagcaactgtcctgcatcagatagctgggattacaggcgcacgtttttgtatttttagtagaaacggggtttcaccacgttgcccaggctggtctccggctcctgaccttcactgatcttagcctcccgaagtgctgagattacaggcatgagccaccgtatccagtccatcctgtctctatgtctaaaaaatgttttttaaaatatctgtagtgtaataaatagaaggaccaaaatatgtgttacactgaatgacattcagggcagggttgagttgaaaggatatttctaacacaaacattttccattttttatgagtgctttaggaagataacatcctatgaaagaaattaaaagcaataagcctgggcaacatagcaaaaacccatttctttttctatttttttttttttttcaggcaaagtctcactctgtcacctaggctggagtgcagtggcacaatcttggctcactgcaacctctgcctcctgggtttaagtgattctcctgcctcagcctcctgagtagctggggttacaggcacataccaccacgcctggctaatttttgtatttttttttatcatactttaagttctagggtacatgtgaacaacgtgtagattagttacatatgtatacatgtgccatgttggtgtgctgcacccatgaactcatcatttacattagttatatctcctaatgctatccctcccccctctccccaccccacaacaggcctcggtgtgtgatgttccccttcctgtgtccatgtgttctcattggttaattcccacctatgagtgagagcatgcagtgtttggttttttcgccttgcgaaagtttgctgaaaatgatggtttccagcttcatccatgtccctacaaaggacatgaactcatcattttttatggctgcatagtattccatagtgtatatgtgccacattttcttaatccagtctatcgttgttggacatttgggttggttccaagtcttgctattgtgaatagtgccacaataaacatatgtgtgcatgtgtctttatagcaggatgatttataatcctttgggtatatacccagtaatgggatggctgggtcaaatggtacttctagttctagatccctgaggaatcgccacactgacttccacaatggttgaactagtttacagtcccaccaacagtgtaaaagtgtt

SEQ ID NO: 19182 - DNA, 1034 bp, Homo sapiens
gtctcctgttaaagcttcgctttcatccccttctgtcttctcagtgactgacattatctgttgatcacttttccccattagcctctgtattgatttattcttctcaggatatatgcgtgattgagacttctcagttaaaaaataaaaacaaaataatacaaaatttgcctttgactctgagccaccattactatccccagcattcttcttcacctcaaagtcaagcttcctaactctcactattttcacttcctcatctctcactggctcttgctcagctataggtcgaattccccccacccccaacctttctccactgaaactgcttttgcaaaaatcacgtgacttttcccaaatccagtatatacttttttgtccttcctaacttcctccttgatattattcctgtgatttttctttcttcctttgcaatcctcagaattgttttgtgagttccaattactttgcctatctcttatatgtaggaattttccagaattttgtctttctctggctttacttctatcttatgcttcttgtaagcaatctggtccacatacacaaggttttagttactgcctgttcctcctatatcacgatgcttactaactctattctgaaactcccttttgatctccaacttcatagaaccagctttcatctgacaattttgtgtttagatgtgttgtaggcatataggaaaaactgacatcattatctttcctcagcatgtcccttttccaaaactaatctgtttcccttgtattctctgtcctggttggtgacaccttctttgccaggcactaaactctggagggggtacagagctacaaagacattatgaaataaagtccttaccctcaatcgtagagactaatgggggagacagacacatgaacagacaattacactacattagaatgtagtaaatacaatgataaaggtatgcactgtgtgtatttgtaacacaaaaaaggacattaaactcaaattgtggattgaagaaaagtttaggagaaggtgatgcccaagtg

SEQ ID NO: 19183 - DNA, 1081 bp, Homo sapiens
tgaaaaagttggggttttttttctttgtttgtttgttttttcttgtagtctcattgattttatggaggattttcagaggttttttttttgacatgaagtctggctctgtcaacccaggctggagtgcagtgatgccatctctgctcactgcaacctccgcctccctggttcaagcaattctgctgcctgagcctcccaagtagctgggattataggcacccgccaccacacctggctaatttttgtatttttagtagagacgggttttcgccatgttggccaggctggtctcaaactcctcagctcaagtgatctgcctgccttggcctcctaaagtactgggattacagatgtgagccactgttccctgccagaggtctttactttcagttttttagtgatgtccactatcttttttttgttaacaaagccatagaatttataagctaatggtctgagatctgaaagatattcctttcctgtggaacagaacaacaagatctcaattatttgatcaaggaaagtaatatgctgtaagcataacatgtcagttgataaattgtatcaatgccagaactggatgagccaaactttgctctgtaaataatgactgattaaatctcattagcatataacatagaatggtttatatccttttaagtttcaatgaaaaaatattatttaaataatagttaatctaataatacactatttcacctaaaactattttgctatctggaatgtctcttgatagaatggctatgtttatttgtttgttttccctgaatgttttataagcagtgtaatatttaagactagtgttagctttttatttgaatttcctgaatatacagcaaggatttttgaatctttattactagattttatttttctctccagttgttgctgtgtatggagtattgtaggtagaaaagagaggaagattgatttgtaaataataggttaatctggctagaccagccatgtataggtcaagctgcttgagggtgacctgctaacattgtggaaagattttattgtactttcattttattgagtttaattatacatgcagagcaaa

SEQ ID NO: 19184 - DNA, 1062 bp, Homo sapiens
gttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaa

SEQ ID NO: 19185 - DNA, 1024 bp, Homo sapiens
attaaagtcgcagcgagacaacagagggctgatgaattggtgtcttttttttttcttttttgccgtcattcacacttgattgacttcaacctttcaagtgcaaaagtctctcttttccattattattcatagccatctgagtttttctaattaaagtgtatgaaaacaattactgatccgtcgtactgagtctgttagaggggatgtctgccttactgtaatgtgtatgaaaagcccacagttttctataatgatgtgcagctgaggtgttagataattttattcttttttactctgtagggctttttttttatttctcatgattcatttttcataattcctaaagatcccaggaaaggactgatcttgcagctacaaccgagaaaggaggtgggggggagtcttttttcctttccctttctccccctcttacccccaacctcgtgctccccctcagctgaggactacaaattaatcggtgacctttcacttctcggattcccgctggactccccaaccacactagtcagaaatgccttctattaaaaagaaaatagatggaatgagtttggcaatctccactccattcttaacgattcatcaacagctagccttaaccagctgccgatgagctttgtgtgaggtgcagatgtctgtgggggcaagaatgctatgtcacacacattcacctgccacacacctgctcttcgtaaacacagcatttctcagaatgcttctccatggtacctgttgcttactttttgcacccgctggcatctgggttgctgaaattattctaatacccctaagtgtgatgaggagttatcctatgttgatgggggtggctgtctgggtttcctctagttgtcaagcttattgctgatgattctagtggacatctcagtagctattttgagcaaggctgggatcgtcacaccattaaaaattaatagtaatgtatttaaaatattatttaattttgaacagaaatctacgtattccaatctttgcaacagacagtgaa

SEQ ID NO: 19186 - DNA, 1049 bp, Homo sapiens
gtcgaggggcacggaaataagaactcgccaccccttcggagatgcctgcatagtgtccttacaagcttctcttctccttgttttcattgttatttatcttccatttctgtaaactagcctgtcttacggcctgggggcttctatcagtgataccttggagcggagtcctgtttctgtaaactcttctgatctcagaaatatgaacacggagtggcccaattgtgttcttaaggccattaccagaagtgaccacaacccagctgttcatttcctctaacccatgtcctgccgcattctcccctcactgggcaactccttgtagactaaaggatggtctcagtaaagctcgtttctgcgctgaattttccttgtactccagtggggccaatgagttttagcctgtggtttcttctgttctaatttatatgaagttaaagctatatttcaaatccctaaacgtctttatttccctctatgggagacagaaaaaagtggggccttataagtggacttccacatgtccaagttgggaatctcttccagacttccagagactttaaacatggctgtaaaagaggagttgggagaagaaggctgaggtgggattttgtctcttgcccccttgcggcctctctgggacgatagcggttgtcatagaaatccagacccacaggcaaccctttgccccatttccacccacaaagaatggaatccagagaactttctcgccttttggacatgaagagaatggctgagttggtgacaggggaaaagaaagaggattggcccaacagtttgtttatgtgggctgcctgtttctggagagcgtcatcttttcggtagaaatgcccttctgtggattgctttaaaaaaagaaaaaacaaagatgaaagttctcattgctttttggaaacatcaagctgtgacctggttggaggagtccaatcaacgtggggagggctttcagaggcacagaagccagagggcagagggtgtggagggagcctgggaataccccgtgctggccagtccggcctggctgtcagctt

SEQ ID NO: 19187 - DNA, 1012 bp, Homo sapiens
cagcccacagacaagacaccatacccacatacgttgtacacacacacaccccctgtatacactcacacacccacacaagccatatactacacccacacgccccatctgcgtgcacctcccccacatacactgcaccccccacatgcaagcatcataaacacatagacactgtacccccacacaccccacacacactgacatgcatcccacacgcaccctcactctacccacaaatacacaggcactgccccgcacactcctgcaccccccacacaacagttggactccctcccactccccagctccctccacactcagtccttcctccctccaccttccattatgattaaataataattgggggttatattaatattcagtgttttcattattataactataaatattaatcgcagctgagccatgtagagttttataatttcatttaccttcttgtacaacttattgttttctctggttttctaggtacctatgattaattcatggcgaaccttactctgccagaagtagacatttcctaatctctgaacgctctgctctatcagtttttctgtcagcttcatttcctcctggaggcgtccctcctaagcccctccaaagccctctgcccacctgctcctctctggatcatctgactgctccttcgctgcctcctcatataaatgaaacagcaattcccaaatgatgggatagaccacaattcaagaatttttctccttgctagagtggttgaggtttcgacagtcagtagaaattgtttgttcaggaaagggctgttgggtaccgggataatttttgtcacttgaaggtcactgcaagactgtcccttccatgtgtttttcaaatgcctcttctggttaaagttgaaacaccttaattggtggagcttctgctttgcctctgatcccatccgtctacatgggagcactctcaggagtaagggacgaggatgggcctgaggctgaggcccctgggccatctggctgtaggg

SEQ ID NO: 19188 - DNA, 2087 bp, Homo sapiens
tataaaatgattatatgtgcttttaaaatcacaatgaaattcagccttttttttttttttatgacagagtcttgctctgtcacagaggctggagtgcagtggcacaaacacggctcactggagccttgacctcttgggctcaagtgatcctcctccctcagcctccggagtagctggaaccacaggcatgcatgtaccacacacctggctaattttttttattttttgtagagactggatcttgccttgttgcccaggctggtctcgacttcctgggctcctcttgagccttggcatccaggagtgccggggttacaagtgtgagccactgcacgtagcctcagtcttgagaggtggcaattctgttttcctcttgagatctagttgggtggacaggttggagcagaggcccgccacgctgatcccggacactgggtgtcgagagccttctgtttgatgtgttctgcgagtctaggtgttgatggaagatctgctgtctgcccagtcactgatgggatcaatatagtattagaatttgtatggtgtgattctttattagtgtcatttttttaaaggcaaatttttgcagttgacacaatgggaaaacaaaagacagggttaaatggaggagaaataaatgccagatatttggagaatccagtgtggggcgggtgtgcaggtaggggacatttgttgcttcctacacacttcatcatcttttctctgtggacaggatgatggtaaagatcagtactggaattttgaattttgaataacgtaggctacttgttagcctatgtgtttttgttgttgttgtttgtttgtttgcttttagatggagtctcactctgtcgcccaggctagagtgcagtagtgtgatctcagctcactgcaacctctgcctcccagattcaagcaattctcctgcctcagccacccgagtagctgggactataggcgcacaccatcacacccaactaatttttgtatttttagtagagacagggtttcaccgtattggccaagcttgtctcaaagtcctgacctcaagtgacctgcctgcctcagcccccaaagtgctgggattataggcatgagccaccgcacccagcctagcctatgttattcttttgggtaagaatgcagcagttcttacccaaacattccttgttcctttcttgtttctctagaagcaagagcttccttgtttcttttttaatgtcagaacatcaaatgttaggattaaacaagcccatgagtaaatatttgcaggttgtagatcgggggtgttgtgggccaagtttctcccccaagtctgcctgctgatcgcttttttcctgacctctgagctttattgctttgtcacagtgaactctaaatgtttttggagacagttccaagtttgtgtctgtagtagataggggctgagatgggagtaagtatcgtggtctgtgggttctgagcttcttccatacctgtttgtagagagggaggtccttagccaagctaatgtgttctggattctctgccacactatagagatgaaggcggactgtcttctgttgaaaaccctccagaccatcttggttttgttgggcctccttagcgctgtcactcacagtgccactgtgggagtgacatggtgctgccgcattttaactgccctgaaatttcagagttgtatatcaagaagcaggatagcagagaggtctctagacagcatgatctctagagccagggggcctgggttcagatcccgcctctgtcccttcatagctgtgttaacacgagcaagtgatttaacctcttggttccacatttcacctactgtcatttgggaggattgttgtaatcttgtgccatctcattcatctggctgtggtggggattaaatgggctaatatctatagctacacagcacctggcctggcactgtgagggccctgaatctcttggcattgcttcatttccattgtcgagagcccaggtatgcaaaacaaagacaacaaactctgactttctagatagacatttccattagccacctttgtttgcataaagagaagtttatctcttttacgagatgt

SEQ ID NO: 19189 - DNA, 1035 bp, Homo sapiens
gctttggaatttggaagtctttcaaacaaactcagagtgccagcagaatccatgcccccttcagtctgtctcaaagcccttgcgtcctggtggtagttcttgctgccggttcactttaccctaagaaagagaatcgagataggagcaactctctgggcctctaggatttgaggactactcatgatgaaataaacctctcaagccttcagtctagtgcagtgagttatctaggagggaattcagtgatggggtctctgtgcatagcatgcctccaccagataggaagttgggtggaagcttagtacgcacatcccaaaggggtctctcgagggtgcccagtcaaggcatggggaagaccccgtgtacgattttgcttttgcagtaggcatccccttttcatgcctttaccaatgtctctaccttacagtggccattactgctttgttgagtgtccctttggcttcccactgcttgaaaagctctttatgccagcaggccagggatatctgaagaactcgctgtgcccgtgttggtgagaggctgtgtgtgtgtgtgtgtgtgtgtgtgtgtgtgtgttgccctatcagtgagcctccaaagggcaatccttgtttgttttgtcatggtgccagttccggagcctcgtgccagagcaagctgccgatggtgagcccaccgagtggttttcttcctgccgagaggaaaacacactccttgtttcagagtcattttggagataactgctgtgggaaactttccttcgcccaaggccagctctcacctcacccttacaggttttccccattgtcctgtgtgtgccatttggcggaatcattgcgaggacgtacctctgtccagcaacgttgaatggtgtttcccaggtgctctaattagctgccacaggcccagagaaaagcagctgtaccatgttcttcatttgttctcaggtagattcgatgtgaataaaagaaaacttaaggctcctggctgcttctgcctgcattccccaaactgccaagtgcaaagaatctgacc

SEQ ID NO: 19190 - DNA, 1056 bp, Homo sapiens
tgcctagcaaaaaatgtattatccttgattgtttcccctgctagaatctaagcttcacaagggcggagtctttgtctgatggtttttttttttttttccctttaattatcttacgtctaatacccggatcaggactggtgacaactccatttgtaataaggaaaccctgagagtcgtgcaaaggaaatttatacataaagatttttgctacagacacttataacagacatttataatagtgaaaaatggaaactatctgaaaaatcttacaggggattgatttaaactgtggtgcagccatatggtagatgcttatgcagctatttaaaactcctgcctcctggttataaatgtgggaaaacagtgatgtaaatggaatgaaaggaactctgtggactataggacttcagtttaatttttaaaatatgcatagaagagaagctaaagaattacatatgactgatggctatttccagctggtagaagtacaggctacttttaatactttgttttctgagctccgcatagtgaatatctattactttttgtcatgagaagaaaatatgtgcttaaaagtttgcaaaaatgtagaatcacttaaatagcactggcctgtggctgtgtttggaggctttttggagattattcaatcttgtgaattagcgagaacctaatttaaaaaaaagcagcaaagatgcttcacaaaatgtccttaggctacttagctttaattatttatgatatttactgtaagcatctatggtatgtgtttgtaaaaatagtggaagtcttagtgatctgcaagcttgtggaatcaatcgccttgggtacttgagaacacctttgcccaagttagctgtcttgatggaaatgtgtgtgctgtctttctgatatgtcactgaatttcaaagcaaacttagatcacacctcagcataagctgggtgggcagtatgcagttgtgatatgtgatatgtcgattctggtattaaccaaggagaagacgctctgatctaccttctctatctcgtcactttgtggaaggacttagggggcag

SEQ ID NO: 19191 - DNA, 1050 bp, Homo sapiens
cccagttgatttgacaaagctagcataattctgggaaccaacaccatcacaaaggttacacaaaaagaaagctgaagattgagttccgacatgagtggagatgcaaaaatgccagataaaacagtcacagattgaatttagcattttaaaagaatcataaccacataggatttatcctggaaatgtaagaaggggcttaatatcagaatgtcttctcttgaaataatcatgtatgtagagccaagaagaaaaacataatatagttggccttcatagtcacccgttctgcatttgtagattccagcaactgcaaatcaaaaatatttggggaaaaaattgggtctttactcaacatgtaaaggacctgtggactcgacagcctttttgcttgtcattattccttaaatgatacagtttaacaaatatttatatagcatttacattgcattaggtgttataagtaatcaaaagatgatttaaagtatacaggaggttgtgcatattatgctgttttatatcagggacttgactatcctcagattttcgggatctatgggagatatagcaagggacagctgtctgtctgtgtgtatgtgtgtgagagatacatttgatcaccttccttcctttccttcctttcctctttccttcctccctttcctttccttttctttcgtttctttcttttttttcttttctttcttttctttctttgtcttgttttgttgcttaggctggagtgcagtggtgcaatcatggctcattatagccttgacctccagctcaagcagtcttcctgcatcaccttgagtagctgggactacaggcacacaccaccatgctgggctttaattttttttttcatagagattggggtctcactatgttgtccaggctggtcttaaactcctggcctcaagttatcctcctgcgttggcctcccaaaattctgggattataggcttgagccgtcacacttgactgcatttggtaattttctacccttattcctagtctgcttagaattttgaaaactcaagcttgaaagag

SEQ ID NO: 19192 - DNA, 1999 bp, Homo sapiens
cagcaattagcccatgatattgtatttgagacattctgaatgcctaagtttggtactaacaccttatctttgcataaaacgttatagattttaagtaatatatgattacattttctatttttttcccatattcaggctagtatactcatttttcatccatatggaatgagttttttttttaaatagatgaagcattaaataaccacatctcactaataatgctcccaagagtacataacttggtggtgtttgcaattacatacaatgtaatctgttgtgtgtgcaggcgtgtggatttctgtttaccggcatccttcattatatggtaacataatatacagaatttcccagttgcagaaattagaaagtaggaaacagatttcttcaacgtaaattggaaaactgatttatggagtccatttttttttcttttctttttaacttggcactacaaagtttgtgggaaggaagggagttgatacggtatgatgcttataagcacaagttaattcaattaatttgggattgaaatgcgttttaaggtctgtagcaggcaagatctacaagatgtagtaattgtaaaatgggaaaggctgcgtaaggagatacagggaactggctactgtactgcctcagcttcatgttcctgacatttaggtttcaaaatagcccagttggaacctcattaagctttttaacatatatatacacacatacacacacacacacacacacacacacacgtatatactttatttttcttgtagctctcaattcttctgaacttggagattgcagaattagagattattgtttttccctcctgccttctttagtcacagatgtaatcatcttggggccaagtcttactcaattgaagccatctctaaatttcatcaaaaaaatatggaagtttacttggttatatacttagatggtgtatctgggatggttttattccatttattgaggggtgactttgcttctgaaataagcaagcagcatatgcccaagataaaattttcagaaggcacagagacttaacatcctcttccctctctccttgtgttgcttacactcagatctctcagtgccccaggaccaatggtggttatatcccttctacaaggagtgtctgtagatatggccatcacagcattatatgagtcatttttcacttttaacattgtcgtgttttctatttaaaaggtttttttttatttgccagagtttcatctcctttcagagatgtttttatcctccatagaatacttaaacatgttaatgaaatccagttacttgaaaatttaaaaatattctcctaaatcacacttgggtcaaagaggaaatgaagttactgttacaggatcattaggaaatattgagaactctgtatatctaaatgtatgggttattaccaaagttatattcaggggcacatttgtagctttaaaacattattaaagaaaatgaaaataaatgaattaagtattcaactcaaacttggaaagcataaaacaagcctaaagacagctggagaaaagaattgtaagataaaagtgatattaatgaattagaaaaacagataaaaacactgaattgataaatctaaaagctatttgggaaaaaaggccaaggaagtagaccaaatcactatcatgtttaattaagaaaagagaaaagagaaaaccccaaatacagaaaactaaaaaggaattgatatgatagaaaaagtgtaacaaatgtaagttgcatttgaagtaattgttttgtaatgtaaaacacagtaacttaaaatgcaacacctttgaaaatcccagtgacatggctgttgggaaatgacttggatgtctgaaactttaaatcagaaactggggaagaagctgagcattaaaaaaaaagttctggccttgcgcggtggctcacgcctgtatgtaatcctagcactttgggaggccgcggcgggtggatcacgaggtcaggagttgagacctgtctg

SEQ ID NO: 19193 - DNA, 1029 bp, Homo sapiens
ctgctgtagtgtgtagccaccgttgggcaccggccgtgggcttgggcccctccctacacttgttccaaaactgtgtatttaagatccttgcccagaacctaacacattcctccatgatgttattatttaacagctctaatttaataaaaaaaatggtgattccatatggttcaaatgcatactatcagaggccagccaaggaataaactgtcatgtgcagtatcacttgtagtagaaaatttgtctctgatggttctagaaacatggctccatcctatgcatgcacttcccagcacagaggttgagctgcagtggtcatggagaggcgctgtggagctgaatggagtttgaggctgtctgcccgttagttgtacctattccaccaggtgttttggtgttggaagacttgagatcaagttctcagttggcagtggtttcaaagccctgctgagaagactgactgcctttttgggtacctctattttgaagtggctgtgacatttgactgtaatgtttagctcgaatgtgttttgtgcttgatgagctaatagcatgccttcctctaaagatagtatttcagtggtggcagaagaggcttcctctttggtcttgggggacggggacagaagtcagcttctacccctcgatagaaacttacctggtgccccagaattagtgcagaatacccaaataacaccaagataaaaaaaggtatcccaccgaattgagttgaggaggggcatcttaattttggttgcatttattatcccagtattttggggggaggggagttagcttaaagcttaagaatccacaggggggcttgtgattttttttttttccttgagattgagtcttgctctgtcactagcctggaatgcagtggcatgatatccatgcactgcgacctctgcctctaggttcaagtgattctcctgcctcagcctcctgagtagcgccaccaagcccagctaatttttgtatttttagtagagacagggtttcaccatgttggccaggatggtcttg

SEQ ID NO: 19194 - DNA, 1084 bp, Homo sapiens
gctttgtcacccaggctggagtgcagtggcatgatcttggctcactgcaacctccacctcccaggttcaagtgattctcctgcctcagcctcctgagtagccgggattataggtgcccgccaccacacctggctaatttttgtatttttagtagagacagggtttcactatgttggccaggctggtctcaaactcctgacctcaggtgatctacccacctcagcctcccaaagtgatggtattataggtgtgagccaccacacctggctcagtcattgatttaaggcctaccccgatctagtctgagctcaatttagttataaattacttcaaagactctatttccaaataaggccatgttctgaggttcttggtagacatgagttctaggagggatgctattcgatctgctccaggtgcttatcctctggatagattttgaagggagatatgggacaagacaggacatagagtcaagggtgactgcaagatttttaacttgagtgactggaaggactgtatccctgtggccttggctgggctggccagctcagcaggccctcgtcccagaacctcgagccccgtttcctcgattgtctttcctcgctgctctaaaccccttcagtctttccttttattgagccactatatgtctacttagcatcacaattaggcctctgagttagctgctcaaatctttaattatgagtaaaagggtaaggtgccaagtctgtctgaggacatcgggaaaataatttaaggagcttcatttttcaaagtccttgggcctataccctttcaactaatccttgcaggtgctctatacggtatgcagagtggggacacatctcattttgtagatgagaaaagctcagagactaaatggctttgggggatcatcgagcagttggttcagatctgcatttgaacccctatggaagagtattgggggggcgggatgaagtggattatataggaagacatcctgctgcataacgttttactcagttcagccagatttgaataggataagacagaaaaggtccaacaaccatgcccgtgcctccctgactttacccttaaa

SEQ ID NO: 19195 - DNA, 1060 bp, Homo sapiens
ccaggctggagtgcagcagtgcgatctcagctcactgcagcctctgcctccgaggttcaagcgattctcctgcctgaggctcctgagtagctggaatcataggcatgggccaccacgccaggctaattttttatttttagtagagatggggttttgccatgttggccaggttggcctcgaactcctgacctcaagtgatctgcccgcctcggccttccagagtgctgggattacaggcgtgagacactgcacctggccacatactatgttttaaacatgggcacatttcacagaaaaatcagtattaaaaccttctcttgaaaaaaaaaatcgggggatttggccattttgggtcttcagggcaaaacctggctagaacagggtggtgactgccccttgtggaaggaacatctactttttaggttgccagagctcactgttgcttaccagctcttaccctaccacgtcctgtttcccagccaacttcgctcatttgtgttacctgcttggccctgtgctgtctgggatcgtggcatgtgggccgtcattggactgaaactcagtttcagcggttctccgtagggggtgattttgcttcctccccccaagatttggcagtctggagacattcttggttgtcacactttggggagaggatgctactggcatccagtgtagaggccagggatgctcctaaacatcctgcgatgcccaggacagccaccctcatccccaacgaagaatgacacagcctgaatatcagtggtgctgccctcaaactcccggctccgtattcttcttgttctgctgaccaggggcctgcagtggctcctctccctcctgcctttcaccatctgcctgcctggcttgcaggcctgactcagggagacgggcttctcccagcctggctttctcagcgagagcttccagccttggggcttccctgggctgcccttgaccttttgtttgagagtcccatgtgtgccagacactgttgttggtgccggtgatactccaatgggggcaaaaaaagagagaaatgcttgtctgcttggagctt

SEQ ID NO: 19196 - DNA, 1053 bp, Homo sapiens
ttttatttgcgcagcagtaaggatgaaatgggcagttcttctgatttttggatgttgtctacaaaaataacttctctcacaataaattggcataggaagtttgcgggtgtgtttttttggagggtgagagatgtggtctgacttccctcagactcttcgcttcacctcttgagtaggccacggccatctgctttaacaattttattttttttcattttaaatcctcaaagacaaagggacctggaagttcagacctgtcctgccacattcctgagtaatttggttttgattaacccaaggagaaaagttggtttctcctagcgaccgaccgaggggatcaaagcgccgggaggggcagttcccctgatacacccagtccccctcctccctctctcctgccggcccctctcccctcctcttcctctaccctctacctccacctccctcctcctccctgcgccttttcaacctccccctctttagaagctgagcaggagttatttccactttctgactctcacagaagtggaagcgtatcatagagctttgggtggacagaccagggagaaatacatccccccacccatccctttcttcctaaactccttttccccccacaaagcggcagagcgcattcctgtgctaatccggctgctggaggaatgcaaatggctgtaattgtgtgcctctggaccggccttccgcatctgtgcagcttttcttctttgaggaggtggctaaaaagttcatttacatagagaaatgagactggccttgtgatccctagtggcagaatagggactttctaataggaaaggggccacatctgtgctgcctgcaccttcctcccgcagccctccccagttgtagagagagagagagacagagagagagagagtctgtctatgcgcgcgcacgcgtgtgctgtgtggtatgtgtgtatggggtgggggagaaggtggacaccaggcccctgctgggcatattttacagaagggcagttaaaagggagaagtcttctcttgatagtaagaaatcaggctggagtaggag

SEQ ID NO: 19197 - DNA, 1029 bp, Homo sapiens
ccctactcctggctgctggtggtttgggatgaagccactgaaactcccttgcaaggccacaccttgagaagatgggccggtgctgggatgcctctcactttctattctgcttggtttctgggaggaagctaatgacataaggggcctaaaggctttcttaactggtgacctggagtttaattgtaagtgggtctttcggggcagcagttaggaatgtatggatcaccttcagtcatctgcagggagacttggactggaagtgggagaactggctccactggactctgaaaaaggctgtggagttttcatctgctgctgatttcatccactgtcccaaaagttatcttggccacaaacctttgatctgggagtgagacccctcgcccgatgcttctagggcaggagtcagtgactgcctatacccgctgttctgtgtagatgggagagggtgttagttattgagtagggctgagtacttggggtgatttggggtggttaggcatgattggggcttacacactggaggggtcatgtgtaggcttcttgatggggttctttcaggaaggaggaggcaaaagaacagttttgcttgtttcttggttgttcctgactccatccaggagtgtgactggagaaaaattcttctgagtgtatcggttaggctggcttttggatagatggtccccggtgcccatttctatcataggctctgcatttcagtaggaagattctagttcagaggcgactgcctctgtcttctcatttgaatctccttagtggagaggcaggaggcagattagccgagtgcagaaagaccaaggggcttaatctgatagttgatctcagccctgcatcccctgaaaaagtcatataagtgcctgttcaaatatggaagtctgtctcccttcagtatgcaaacatcgcttttcagaagcatttaaactcctgaaagtctataaaaaccacatatgtgtagacatgaactgagctgctccccatgcttccagtctcctgagtggcctatttctg

SEQ ID NO: 19198 - DNA, 1030 bp, Homo sapiens
aataaaagagaatatactagagattgacgcagtgtcaaaagtatgagttgctgtgtgtgtatgagaagagagatagaatacagacacagtcagtcttgaaagcttggtggtaggtgaatccatatttggagatgattttgaaatagtctagcaaatggtgtacgaagaggatttcgtaaaaagtgtacacggagtcagttttgaaaagactgcggtttgggaagatgaggtgtgggcaggaaaacctactctaggccagcagccttcctctgtctgtgtgtctcccttccccctcctcgggttttagtttttaattacttaatgctgaaacgcacagggcttatataaatatttgcaaatgctctttcctattgatttctctgaataaactgccctgctccggtccagagaggaggcgattcagatctgtggactttttaaacatacaaagtctctggaggagtggtgttctctgcgtgtgtgtgtgtgtgtgtgtgtgtgtagagttgtaggtatgaggatttggggggcccgcaaagagagttcaggctctcagtggtgtgggccaagaaaactggggtggagctggtcccatggcctggcagtcctgacgtgtgtgtgtgtgtatgtgtgtgtgtgtgtgtgtgtgtgcgcgcgcgcgcgcgcgcgcgtacgtctgcaccgtgtgggtgtcttcactgggggagtctggatgcatatgcacttacttcccccacccctattaaatatggagcagcttttcaggactctgtgactgccttctcctcagggtcacattgagtttgaatctgacccaaggtgcaggaatcctgcaatggggaaataaaagaatatacagaacggggtcaggtcagctgctcagaggccaaaacccctacagctgctttgattttattttttggtgtatattttaggctcctcctgccattgtacaaattgtgcctccccctttcaggtgtttggtctgtggtttaaaggcaccagagcctatgcctgcatagacataggc

SEQ ID NO: 19199 - DNA, 1033 bp, Homo sapiens
cggggtcccggagggggcgaggcggccgcgcgatcctctacctgtgcgctctccgccctgccccactggcagcgccgcgagcgcccagaggggactctgccctggacactaggggctcccgggggctcggggctgcgccgctggccagggccagacctcgcccggccggccttcttccgccagctgagctcagagacatccgaggatgccttttttctttttcttttctttcttcttcttcttctttttttttttttttgctctcgcgaatctgggattgtttacgttgggttccccactctcacccctcgcccggctccactcgatgcaaaaaccgtgttcctgaattttacattatgcattttaatgtccgtctttttgcatatctattggagagtagatctaagtgtatttcatgcagtgtatataattaagttgtgtatggactcagtactcggagggttcttgtataactattgaattaaaatatgtatatatcactttgcgagtgaagctgttgctcagaatctgacttttgttcaatgttgtgctattctttggactgtggcaaattctttgattacaagcgctttcaaaaggcacccagtcttaacttttcccccttgttgctttcaagtagggtaaatatgacaatttttattggtctcaattattgaaacttgatctaagcactgtatggacggagcatgctgattgcctttttctggcctccagttctagtgacttttaaaaggcagtttgttaagtacctttgaagaatatgacagacggtgatcgcttggctgtaatgcaaattacagaacataaattcactttggaatttaaaaaagactcgagccctttcagtggggacaattgaggatttattatgttttttaaaaaattactttttttcctccctactttgggagaatagctagttgcagaccaacttatttggaggtcctccgaaagaggcttgggcagtgggcgaggggagaagattgatcacaatctgcataatcaatagggc

SEQ ID NO: 19200 - DNA, 1048 bp, Homo sapiens
gaccccagttcctaattggttggtgtgcctgcttgcagcagtcttaggcaaaagaattgcattaattttattaagatactaaatttcaaactttagaaagtgatatattttatttcacactgagttcactttgcagttgtactaagcctaagcaagctgtttcgaagcttattgggtgtctccaatcctgactcactgaagcagtgtgaaactgactatgagcttaaaaaattattctagttacacatgatcattgtggaaaaatgacactattcagataaataaaaatgaatatagagctgggcatggtggcctgtgcctgtaatcccagatacttggaaggctgaggttggaggatcacttgagcccaggagttcatgacccttccgaacagtaggaccttgtcacaaataattaattaattgaaataaattaaaatcacctgaaatcgtaccacatacagaaaactaagattaaccctggcccaaagtgctttttttttgagacggagtcctactctgtcaccgggctggagtgcagtggcacaatctcggctccctgtaacctccgtctcccaggttcaagtgattctcctgcctcagcctcccaagcagctgggactataggcgcatgccaccatgcccagctaatttgtttgtatttttagtagagacagggtttcaccatgttggccaggaaggatggtctcgattttgtgatctgcctgcctcagcctcccaaagtgctaggattataggcgtgaaccaccgcgcctggcctaaagtgctgtatttcttaagggatttcagcattagcttcctaatttctctttttgccttccagttttgaccttctcccatctccatcctccactctgcagccagacttattttattgattgattgattgattgagactgagtttcactcttgttgcccagatctcagcttgctgcaaccaacacctcctgggttcaagcgattctcccacctcagcctccctagtagctgggattagaggtgcccgccaccacgcctggctaattttt

SEQ ID NO: 19201 - DNA, 1028 bp, Homo sapiens
gttgatgggcagcttgcctgtggcgactttttccaggtagctcctgatatccagaagcttggagttcagtcccttcaaaccatggacctggtttgtgatccgctgggacagagtgcccaccgtcgtgtctttgatatctctgtaataacccacagttaaaaagggcaggaaaaggcatcagggtaccatgttatcaggcaagttcttacattctaagaaaattcctagctttgttgggtgaggcaagtttttaaaagaaaaatgtcacttccccatttgataaagatttcgttatcaattaccttaatttcgttatcatttggaacacattttatctttctcatcacaggacatttttcaaaaaacaattataaaagggagctaaaataaaaccatttccacttaaggaaaaaaaaattgcttaggtcaacagttcagatctaccaataactttctgggtaaccttgtactgaagctgtctctctcagctttcctgttcctaaaaggatggcattttctctacatgcatctccagaatattgagaagcttaactaagatggtaatttttagaactagaaggaacctcattgactgataaaactataacctttttcaaataaggattataatagatataggattttaaaacaaaagctactccaagatgaagattctctccagaaaatgggctacatttgttgagaaggacacctagtggagagtgcaggcctgcatttatttcatacctctcttcccgtcagtcaacattatagtttccagacaaggtatgctatccacaaagtcataaattgtaactcaagacattttacagttgatgtagttcaaacacttcaatttacagacaataaaacaaaggtctggaaagggactgtgatttgctcagaatggcagacttgttagtggacggccaggacgagaccccaggtctccatattcccgacacagacctcttccttacactgtgtgacctctcgggcagtgaatgattttgatgctgtactagggt

SEQ ID NO: 19202 - DNA, 1034 bp, Homo sapiens
attagctgggcatggtggcaggcacctataatcccagctactcgagaggctgaggcaggagaatcgcttgaacctaggaggcaaaggttttagtgagccgagatcacgccactgcactccagcctgggtgacagagcaagactcggtctaaaaaaaaaaaaaaaatgaaaacaaagaaaatgaagaagataggggctctacatgaaccaaggatcctagctggttattttgattaaaagatgactcaaatgatgttaacactgatcagactttagcacgagagctgcagagaaggaagacactatgatgagaatatatttggggttttgagctgggaaaagacttcttaaatatgatccagaaagtactggccataaggaaaaaatgttaacagatttgtctgcaccaaaatctaccaagagagtcctttcaactagaactgccgtcaccacaatgatgaacatggggaaagaggagaggtacctgctgtatattctcaggccttttagaacacatggagttgttcctctggccacatccacacgaacctacaagaaaggagatgttatagacgtcaagagatgccccacggatgttaccaaggcaaaaggaatgccccacagatgttaccaaggcaaaagaggaagagactacatgtatctagtatgctgttggcatggttggaaacaaacaacagcatgattcttgccaagagaattcatgtgtgtgtatggagcataccaagcactccaagagctgggaaggccttcagaaacacgtgagggaaaatgatcaaaagagaaggaaacggccaggcacggtggctcacgcctgtaatcccagcactttgggaggctgaggcgggcagatcacctgaggtcaggagtttgagaccagcctggcccacatggtgaaaccccgtctctactaaaaatataaaacttagccgggcatggtggcgcgtgcctgtagtcccagctacttgggaggctaaggcaggagaatctctagaacctgggaggcgaaggttgcag

SEQ ID NO: 19203 - DNA, 1428 bp, Homo sapiens
tgagaccagcctggccaacacggtgaaaccccatctctactaaaaataattagccgggcatggtggtgtgcacctgtagtccaagctactcaggaggctgaggcaggagaatcacttgaacctgggagggggaggttgcagtgagcggaggttgtgccactgtactccagcctgggcaacagagtgagacgccgtctcaaaacaaacaaaaacaagtggagtagttaagcaaccgcatacagaggagttggacacccacctcccctcccagaccccagctcctgcccattctccaactgccgcagaccagaagtgtattcaggcccaaggcttggggacttgagggacaacagaaggctagggaggtgcagagctgaaaatcggcagatagatagaagtcttgaaacttgaagtggaggctgagtgcggtggctcacacctgtaatcctagcacttgggagtctaaggtggggagactagcctgggtaacatagcaagacacttgtctctacaaaaaattagccaggcgtggtggcgcacgtctgtagttccatctacttgagaggctgaggtgggaggatcgcttgagcctgggaggtcaagctgcagggagctatgatcataccactgcaccctcagtgacagagtgagaccctgtctctcaaataaaaataaaaaacttgaagtggatgaaaagatctaatatgaaaggtgaaaatataaagctaatgatgtgtaagtatgagaatagatttgggactttaagctggggaaggacttcttaaatatgattcacaaagcactaaccataggggagaatggatagatttgtctacatcaaaatagaggatttctgttccacgaagctccccacagataaagtaacagacagatgggactgactgaagagagttgccacacaaaaccgaaacaggagttgtttcctgaatattcaagggatgtctgcaaatcaacaagaaaaagaaaagaaactcaatagaaaaaaagatgagcaaaagatagaagtagcaattcacagaaggggcaataaacatggccgtggggagaaagctctatcaaagtaacttcagaatactattgcagtcctaagatctataaaaattgggaagttgggtaatacgcagtgttaggttagcaagcatattaataagggaccatcacaatcatacttacacaggatataatgtgtgcaggctctgctccaagccccttatatgtaatattttgtgtaattttcctgacaaatctatgaagcaggtggttttattattcccattttgcagatgagaaaatggagatagagatttgtctttttcactctgtcgcccaggctggtgtgctatagtgcgatctcagctcactgcaacctctgcctcctgggttcaagcaattctcctgcctcagcct

SEQ ID NO: 19204 - DNA, 2133 bp, Homo sapiens
caatgtgggcagatcacttgaggtcaggagctcgagaccatcctgggcaacgtagtgagacctcacctctacaaatattcataattttaaaattagctgagtgtgatggtacacatctgtggtcccagctactctggaggctgaggtgggaggatcgcttgagtctgggtggttgagactgcagtgagccatgatcatgccgctgtactccagcctgcatgacagacctcgtctcaaaaaataataaaaaataactaccacttactgagtgcttcttaggtgcttgtaccatgttcttcctgccttgtctgatttagtctttgcagcaaccatgtgaggtaggtgtttctagcccgtgttacagatgaggagttcaaagcctagagatttagtaacttgctgatagtcatacagctagtgagaggtggggatattttcaaacccagaactgtccgcccccaaagcctggattccctgccatgctggcatgttgcttctctgattggcaaacagaccattgtgcagtgtggtaagttctgtgctgggagaagtgtagtgtgttataggagaacatagaaaagccacctaaccaagtgttggagaaggagggggagattgtcagataagatgtcaaagacagggctgggcacggtggctcatacctgtaatcccagcactttgggaggccaaggcaggcggatcacgaggtcgggagattgagaccatcctggctaacatggtgaaaccccgtctctcctaaaaattaaaaaaaaaaattagccaggcatggtggcgggtgcctgtagtcccagctactcaggaggctgaggcaggagaatggcatcaatccaggaggcagagcttgcagtgagctgagatcgcaccactgcactccagcgtgggcgacagagcgagactccatctcaaaaaaaataaataaataagatgtcaaagaggctgtgacctgaggagattacctgtatttgcgggaggggtggcaggaacctgccaggagggaacagcatgcacagaacctggagccgaatagaacattcacacctcacctgatatgtttgacgaattacaggttgttcagtctggcttggtcagagtgtgaggaaaggagaaatgagaccacagataagaaccagactgtgaaggatcttgcacttgatatgaaaagagttttgcctttttcctgagggcatcagaaagtcattaaggtgggtgtggtggcttacacctgtaatcccagcactttgggaggccaaggccagtggatcacccgaggtgaggagttcaaaaccagcctaattaacatggcgaaaccctatctctactaaaaatacaaaaagtagctgggcgtggtggcgcgtacttatagtgccagctgttcaggaggccgaggcaggagaattgcttgaacctggaatgtagaggttgcagtgagccgagatcacaccgctgcactcccaactgggcgacagagcgagactccgtctcaaaaaaaaaaaaattgctgaggaaaaggagcaaaaacggagggaaacattgcaggtacaggaaagagagacagcagttgatggagctagggtcaagagaagagaggaggaagtgggatccagggcccttgggggagattaactttccagtggataaaagaaggaagagatggttgcagatgtaagtgggtctataggaagggtttcagggaatgagatgagccaggttatctgcttagaatgagggaagaaaggaggtgaagttgaaggttgagagaggaatagctgggctctgaacctgaatacagacagaggtctacctgtggcttaacatgtgctagcctaagccaccaaggagcaggacagttttcaagtataaccgagtggtcacgggtcagaagccaggaggttgacagtgaggtcaatgggatggggctggccatttggcagcagcagttccccaggagagctgtgttgccattgggacagagggtagagaggatgtcagcaaaggggtgggtgtttacctttgggaaaggtattctagagggtgcagtagaggagcttgaaggagaggaaagcaaagagagcttgggccacgggaaataaattggtcacgtagagatgagat

SEQ ID NO: 19205 - DNA, 1080 bp, Homo sapiens
caggcgtgagccactgcgcccggccaacttgtgctaatttcttaaacttgcgtgatcacctggtgtacttgttgaaaaatacagctccctggcgtggcaggatcagaatctgccgaggtggaccgtgggaatctgtcatttttaaacaagtgtcccaggtggttcttttgctgaggcaagtgtgggaaatgtgtgaacccacgctcatccagtcttccttgtgaccggcagtccactgtgcgcaacgctgcagccatacagagggactactcgaagttagaactagcaccttggtcttgttggaataagcagatctgagtagagccagctgcagtcttatggttgtttagcagaagttattcttcttagcagagaatattatacggtcattttccagaactgtaaaaactctatcatttgttttaaaccagatgatgtgcttcatttctgtctttgacgtcttcagtttcttctcccctggctttacctcctttgctatcagtttgtgctttggttttgctgccaaccttataggcttaggtttggcggcaaaggcactagactctggtgccttcttttccttcgttgtcttaagcccttcttttcctctgccctcatgccctcaccacttcactcttttgaaggtcataatgaacacaaggtcagagatcccttttttggcgccaagcaccctgggcttttttgagatggagtctcactgtgtcacccaggcagtggcgcgactctgcgcactgcagcctccatctccctggttgaagcaattttcctgtctcagcctcctgagtagctgggactacaggtgcaagccacgacacctggctaatttttctgtttttagtagagacggggtttcaccatgctgatcaggctggtctcaaactcctgacctcaaatgatccacccaccttggcctcccaaagtgctaggattacaggtgtgagcccctgcgcctggcctttttttgttttgttttgtttaagacagagtctcactgtgtcacccaggcaggagtgcagtagcataatctcggctcactgcaacctctgtctcccaggctca

SEQ ID NO: 19206 - DNA, 1025 bp, Homo sapiens
gagcttctcccacagatggggagctctgtgaggccttcacctgggtgcatgttggacttccattgctgttgctgttgtccctagacaagcccgttagcaagaagcaccggcaggggagccatgcactccataggcttgggatcacccccgggaaagcgatcttccccgggctaccacccccagctgcagttctgtgttagtgcatccttcaaagctaggagaattctagggtgaccagtgagctaatgttgagtgagcaggtattgacttgaacacactgcaggcctttggctgtctcatgctgtccttactcttcttgggaacagtgagtcactcagctggccagggtggggatgcatcctggtgaagagacagctttccctgaagatgctacagaaagttactgtcagatttcatttgtttctgtttcctgagatcaactaacagaagaatctaatggtgagagtgtcttcattcatgttttacgttttatcaaggcacactggaaagggaattatgtggctgacttcccttggccttcccaagagaagattctgttcttatgtcagtgtggcttctggaagtgtctcctatcctcccatcctccaggcctgtggtgtgacttctgccccgaagttcctactatagtgagtcatctggggagaggccactgaaaagaggccttcccttcccatttcctcccctgcctccttagaacacactctaagtcagaacttaatctaagaagaaggaagctggaccaggaaccttggaagtcagccagccctagaacagtcagcctaaattttggccgtaatggcttttttggttttttgttttgtttctgagatggagtctcactccgttgccaggctggagtgctgtggcgctatctcagcttaccgaatcctccgactccctggttcaagcgattgtcctgcctcagcctccggagtagctgggattacaggcatgcaccaccacacccagctaatttttgtatttttagtagagacggggtttca

SEQ ID NO: 19207 - DNA, 1104 bp, Homo sapiens
tctgtgttgatttttcttatctcctgccctccctctccaaaagaaaagacataaattaaactaggaactgagagggataagttagacctagcactgccaccagcccagtgctctctcagagaatcacattgccttgtgtcattctaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatc

SEQ ID NO: 19208 - DNA, 1018 bp, Homo sapiens
atctagcatccagtagtctttctcaggtggtaaatagtgggttgaattgaacctcctggtttgtgcccactgtctagtcggagctgttgctctgggaaaatgcagagagcctatctccaaaatgaatgtggacaaggagcagctctggaaggcagaagaaaccagaaatcgtgggtgtgtttcttttccattaggctggagcacagcctgccagtcatcctgagtttttgtctagttgggtttgctgtcagctgtaaggttgtaaatccttatctttggtaaggaaatcctgattccgattgcctgggaatgagaaatggataaagaaatgggaggcacagtggagctgaatgtttcaatcagaacacatggatgagcagtctctgacatctctcaacttgactataactcttttgccatagattatcgaatgtctgaaagaaaacaagaagcagctaagcacccgctgccaccaaaaagtatttaagctgcaggagacagagatgatggacccagagctagactacaccctcatgagggtctgcaagcagatgataaaggtgagaagccgacaccaaaggccgagcacggatgaacaacaaaacaacaaagcacaaacaatggcagcaacttcctcaggctcagctttctcaaagtgtggtccctagacgagcagcagcagcagcaccccctgggagcctgcgggttcctgggcccccctccagatctgctgaatcagaaactctgggagtagagcacgaagtctgccttagctgcctccctagggggttctgatgcaggctcaagtttggaaaccacagagctgggataactgacctcactttgacctgaggcacaagtaaatggatgtgcaataaataaatgattggttttgaggacgattaatagtagctgtactaagaaagtcaccatctaatgtcctgatcatccatctggcacattcagaagatttttctgttttacaggttgttttgcttcattccctcctccagcaggt

SEQ ID NO: 19209 - DNA, 1031 bp, Homo sapiens
tttcttacaagtttaaaatggcctgcaaggaggacgtgttgaagctttgcccaaacataaaaaagaagtatgtagcttgtagttgtttcattccactttcccgaagttcctcttagctccggaatgagtatgcgagatgttaggcagccctcctgctgcctcgtggggttagccctggaggcctcccgcatctctcctttgattagcgtggcaaacactcggactgtctggacagagcatctggcgatggtagttctcacatggaggtcccataggctaaaggagcatttttaatttttccaggtcaggccatctaactgaccaagtagggctggattgtgtacttagagaagcagggtgcagtgtgagtgaaagaggcgaactgacctcttccctgcgtcgtcccgttatgtcatctcatctaagatgcagcagtttttgtattggattagatatttagtgaagaaacagaatctttattcatttaagaattaagtctttttgaggaaactgatgagctttttcagcgtgactgtccaaattcttccatgttgctctttgaaaggaccatttctagaacacttgccctcatacaaaccaaattcccaatttgctcaggtttctctacctttcaggagtgagtttcacagtaggtcaaaagtacagtcctagagttaagagcagcattcctctgtggtcacatgtttttaacacagatgttgaactgtcgttgcacacatgtgccctgtgtggcttccccttctgtcaggaatgtagtcagcattcatgctgctgcctgcctttcatgacacccacagtcaaattgcagcttttagcaccctgaaaaaaaatacagtgagccttacaggaaagacattcccccaaagggcatcttgaattcttaatggtgtgaccccccccaagcccagctctcaggccatctgcccttgtgtggccccagccagcctcaagcttctttcgtctgcagggtggacgtggtgatctgcctgagcacgaccgtgcgcaatgac

SEQ ID NO: 19210 - DNA, 1030 bp, Homo sapiens
ccctgttgtgtttcttatgaatttttgacattttaaatttttaaaaattcaggttcttatttctagtgctaactaaactataatacttaaactttccaggatctctgtttccatttgtagcatgcaagtattatattctaactgaagattattgagagcattttctttaacttccacaatgtggttggttcttacttgatttcttggtagaacgttaataagtcaactctatgatggggttttattactttgtgtgtgtgtgtgtgtgtgtgtgtgtgtgtgtgtagccaaatgttgtttatttgaaacccatgtgataaaagttttaaaatattaatatcctcgctattttaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatgtgagtcagctcagaaactgttcttttcttccttttatttttacacatatataattttgttttaattaatttaattgtgttgttttttgagagattgagtcttgctatgttgcccaggctggtcacgaacttctgacctgaagcagtgctccagctcagcctccccaatttttgagacaggatcttgctgtggtgcccaggctggagtgcagtggtgtgatcatggctcactgcagcctccaacttctgggttcaagcgattcttctgcctcagcctcccaagtagctaaaaccataggcaagcaccatcttgcctggccaatttttttaaaaattttttgtagagatggggcattgctgtattgcccggactggtcttgaacccctggcctgaggtgatctcctccctctgtctctgaaagtactaggattataggcacgagccactgtgacttaaatattttttaatact

SEQ ID NO: 19211 - DNA, 1038 bp, Homo sapiens
gagaaaagcaaaggaaattctgaggatgctggagaaggatgatgcatgtacagagaaaatagccagtccctgatggaaacaggaaaatgaaaagactgcaagatgaatgtctcactggacacagcagaacattttgagaggagatttacatttctagtaaagagattgaggattaattaataatgggtgtataggaaaataggcctatgaaataagtgacttaactatagagcaaactaaaagtcgtataggaaaataaatacaatattctgtgtctcagtatatataactttttacatagtcaataatgtgaatactgagtatctaacaacatgatgatttaactgtatggggaggagtgggaccaggaagatgggtatgagaattcattcctcatcttttatagtgtaagttactacagaatatctaaaagtgacaagtcaagaaatgacagtttaagcatgtagtttaaaaatatggaggtaattaacgtaagcaaaaagaattgaaagtgcccgcttctggggagtgggtggggctttggacagggaatttcttgttttgattttttaaactaactttatagaaccgtttgactcaacatagctttgacttaaaattttaagggtgaataaaagaggaagtagattaaacgagctatagactaaattttctttttttttttcaaaaaccagtaacatagtcatttattatcaatatcaagtatgtattgcacataatcgtatgtactatacttttttttaattattatactttaagttatgggttacatatgcagaacgtacagttttgttacataggtatacatgtgccatggtgctttgctgcacccatcaacctgtcacctacattaggtatttctcctaatgttatccctcccctagccccccacccccaaaaggccccagtgtgtgatgttcccctccctgtgaccatgtgttgtcattgttcaactaccacgtatgagtgagaacatgtggtgcttggttttctgatcttgtgatagtttgctgagaa

SEQ ID NO: 19212 - DNA, 1049 bp, Homo sapiens
tccttcatttttgttagattgaatgaactataagaaattaccaatatttcatcatatttgacttataaaaacattttcatatggtttaacataattgttctttttttttttttgagacagagagtttcactctttcacccaggctggagtgcagtggcgcaatcttggctcactgcaacctctgcctcctgggttcaagtgattctcctgcctcagcctctcgagtagctgggattacaggtgcacgccaccacgcccgtctaattttttgttgttgttgttgttctttttgtagagacggggtttcaccatgttggccaggctggtctcgaactcctgacttgaagttatccacccccctcagcctcccaaagtgctggcattacaagcatgagccaccatgcccggccactcaccaaatacatttgatttaaaaaaaaaaaaggatattggtctaacaaccttttccctatttgattattcttagtcaagttgctatttagctttcagtttatggaacccttttaatcttatttgtagctcttgataaccatgtgtggtagatatgacagatatgagacttattttacaggtgaaaaaccacgaatcagatagatttttatttgcccaagtcacataatgttaagaacaggccaagtgtggtggctcatgtctgtaatccgagcactttgggaggctaaggcgggtggatttcctgagcctaggagtttgagatcagcctgggcaacatggcgaaacctcatctctacaaaacatacaaaaattagtcagtgtggtggtgagagcctgtagtcctggctacttgtgaggctgaggtgggagcatcacctgagcctgggaagtcgaggctgcagtggcaacagaatgggtaacctggacatcagagtgagaccctgtctcaaaaaaaaagaaagaaagaaacagagcttaaattcaaatccaaaaagcttaaattcaaatcttttaaaattcaaagcctctgtctttccatgttaccacattgcttctctgttatttttcacatttac

SEQ ID NO: 19213 - DNA, 1022 bp, Homo sapiens
ccttgcttcctctgtgctgcactcgctccttccctctttgctcctcactcccaggcgctttcagggaaaaggataccactcccactccttctttcccccgcccttatttccctccctgttgccggggtctgggacgaaaacctgggctcctggccgcaatccgccgaggcccagagcgtgtctgttcgctcctgtcttttgtgtgatgctctatgcagagtgtctcctcgccgaagatcagtttaggattttgccatcagtttcgactaggacaatttgtggcaagccatttaaacataaaaaaatgcctggcgtacttaggctgtaaagaatgatctgtttattagcagtagatgtaattcgcaaatccatatttttggtgctgaaattaatgtatgctttgttttcttcacttcctttggtcagttgtattgaaccccatgtttaagctgttaactcccagtgacttggcgccccaaagcttgaaaagttggggaagcgtttgaagctgtgtttgtgactgggttatgggatcttgcctttctgaggtctgaatgtgattttaacagtatctcttaatgaaatctacatttgtcgttgcttggtgtgattcagttgagtgacattgataatttataatcaagtgacattgataatttataatctaggtttaatgctgcagaccataatgacaattctcaaagtttgggagcaaatctgacagtagtaactttttccagaggtgtaggtatataaaattagccctaaaggtggacaaatagaatgaagctaccacttgatactgtttttggttttttttttaaatatcagatttgtttaaggcgttcaagctatagcaagaccacttgcttgtagaaatttgcttctcttggcatttccccccttcatctcgtgttctagtattctatacaaaagcaattcagatagaggaaaagacatacataagcaggagacagaaagaaaggaagtttccagagcccctagaaatgtgaggccttacc

SEQ ID NO: 19214 - DNA, 1084 bp, Homo sapiens
gatgaagaatggaagtcccttcgtgtactgactgactcctgacccttccctctgcttgtgttctttagctgtgggatgctgccagtggctcgttgctccaggacctacagaccgatcagcctgtgttggacatctgcccatttgaggtgaaccgtaacagctacttggctaccttaacagagaagatggtccacatctataagtgggagtgactgtggtctcgaaaccttgaaggcatgctgctggttagatgttgtttgctagcgcctagcagccccaagcaagatccctgtttattgtctgcagtctagaacattgggaatcatggtttgtttgcattagtatgattctaggaccctaggtcactgagacactacagattgtgtatctgttatgtccactaaaagagtaattgatgggtactttatctacattatccatttcttgggtttaaagccttcattaaccattattgtatgttggaaattcttattttctttattttctgtgtgactttctggaccttagagagtgtcctctcatcatctaggatgtgagtgggcatcaagcattttctggggaatatgacatcccatctgagttgtcctgtcacttaagtatccttgaagggactaaccatcgtcttggtactgatttgatgcaacgtagatgtaaaagagtattattcagttgaacacaagagggcactgtagaaccttgtgtccggtttatttctgaccttgaaggctgacaatcttttagtaacttgtctcatctccacacaagtgtgtgatagcacacctgggtgtgctttgtggcaataacacttgtgttccaggtgtgaagtgctgggacattggcaggcccagtgatggaagcagctagtgaacgattccctttgctaatgcctagtgcattaagttcattgctttgcgaaaggtaaggaaagaggccagttgtttgagcggtggggaagattttgttttttctagccagcttaggatctcaggattggttttatccaagctagtgctttgaagaacactatctcttgccaggaaaagatgagtgataggtcaaagct

SEQ ID NO: 19215 - DNA, 1030 bp, Homo sapiens
taagttgtttttttttttttttttttttttaaaggactttaaacgaaaccaccattaaggactttcaaccctcatattatgattctgtgctctccttatttcacttgcttgttgaaatactgtaaaaactcagcagttctggccgggcgcggtggctcacgcctgtaatcccagcactttgggcggccgaggcgggtggatcacctgaggtcaggagttcaagaccagcccggccaacgtggtaaaaccccatctctactaaaaatatttaaaaattagccgggcatggtagtgggtgcatgtaatcccagctactcaggaggctgaggcagaagtgcttgaacccaggagatggaggttgcagtgagccaacatggtcccactgcactccagcctgggtgacagagtgagactccgtcttaaaaaaaaaaacaaaaactctgcagttctctaggattcatgttaacactttcatataatggataaaaaatcttcctgtaaaagatcaaggaattgtatttgaggggaatatcaaattaaaaagctttgtatttataaaatctttttcattttaggacttgcaaaaacttacgtcacatcaaagtcagaatttacagcaacccaggggctcccaagcatgggtcctgagctgctcaccctccagccagggccagcacaagcacaagtaccacttccaaaagaccttcacagtatctcaggcaggaaactgccggatcatggcatactgtgatgctctgagctgcctggtgatatcacagccttctcctcaggcctcttttcttccaggtaaagagtctagaacctcagctttcatgttctttattagactccatatatttatttccttgccttttggaaaattcaagactcaaaggttaccaaatcacctttccctattagttccttgttaatgcaagtaccccagggtgctgcaaagatgtctttactgtctgttgacttcattctgtaaatttattaaccaagagggtagaaatactgataaccatga

SEQ ID NO: 19216 - DNA, 1635 bp, Homo sapiens
ctctaaatgggcataaaggatctttgtgggctgatagaaatattttaaattgggttatggtggtggttgcacaatgctcaatttattatatataaaagttaatttcatgaagaagcagtcagccaaatccaggatgtgtaggacatttcattagacaaatgacctgacaaatcaatgacaaacagaggggaaaaaaatgggtgagggggaattgtaataaaatgaaaaagacttaagagacatcacaagctcattatggagactttttttggattctgattgcaataaatctgcaaagagcagctttaaaactattgggaaattttgaatatgaactggatgcctggatatttagtggtattggaggattattgttaatattgttaggtataataattacacagtgtttatataaaaaaagaattcttatcagtgttgcagaagtttttgcaagtataatgacattttaaggtttgttaagtattccaaccaaaagaaaataatggaatgggggcttaggtggaacaagattggcaaaatattgattattttttaaattgagtgatgggtacttgtggcttaactatactgttctgtgtacttttatgtatgtttgagaatattcaaactaaatttttaaaaataaattcactgatggtacctggggaagttgtcatcctttttgcaggaacactgtcagttagaaatgggaagctgtagtgagtcaggctctctcctgctagcttctcatacctgacatatcttattttgtattttacctctcctgtcatttctggaaatgacttggcagagcaactagcaggtgtctcagcagagcaagaagttacatgtatcgatggaggcaagaccctccccaaacaggtaatatgaacatcattttaaaaaaatctatttatttatttatttatttttagagactaggtctcactctcacccaggctagagtgcagtggtgcagtcataactcactgcagtttcaaactcctgggctcaaaggatcctcccacttcagcctcctgaatagctggaactacaggtaatgccaccacactcggctacattttttattttttgtagacagagtctcactatattacccagttggtttcgaactcctgggctcaaggtatcgtcctgcctcggcctcccaaaccattgagattgtagtcatgagccaccatgcccaacctgaatatccccttttttttctttttttttgagacggagtctcactctgttgcccagggtggagtgcggtggtgcgatctcagctcaccacaataacctctgcctcccgtgtttaagcaattctcctacctcagcctcccgagcagctgggactacaggcacacgccaccccgcccagctaatttttgtcttttaagttagagacggggtttcaccatactggccaggctggtctcaaactcctgaccttgtgatccacccacctcggcctcccaaagtgctgggattataggtgtgagccaccgttcctggcctctgaatatccttttaaataaaaggtttgggtttttggctgggcacggtggcttacacctgtaatcccagcactttgggaggccaaggcgggtggatcacctgaagtaggga

SEQ ID NO: 19217 - DNA, 1061 bp, Homo sapiens
gggcatagtggctcacgcctgtaatctcagaactttgagcggccaaggcaggcggatccctttaggccaggagttcgaggccaacatggtgaaaccccatctctactaaaaatacaaaaaattagccgggcgtggtggcacacacctgtggtcccagctacttgggaggttaaggcatgagaattccttgaacctaggaggcggagcttgcagtgagccaagatcttgtcactgtaatccagcctgggtgacaagagtgactctctgtctcaaaaaaaaaaaaaaaaaattatagaatctgctcagggaatgagttatacagaatttaaatgttgaaagatgtcagtcaagctatttggcagccataatctgtctccacaaagggaataacctaaacggtcaggaagtgtgcagttcagtggaaattacatcagttctggagccaggtaaatgtgattaaaacttttttccctgaagtatgacctttcccaggactaatcgcttataacttctgaatttcttgagatgaatttctcagtgtggtgtttgacatttactcatctgacagactgtccctgggccaggtgttgaaagcctgggccaaggtgaacagcttttgactcacagtcagccaagaagccaaagctatggaaagctaagtagtgagcttattcttcccaacaggcttagctgaggtcacaaactcctttctgatttgtttggggcggtttcattctggcagtgggggtcatcactcattcatcaaatattgataacactcctctgtgtgagagactaaactttgccctagatatattggtgaataacacagatcacaatattgttttcctggagcatacggagtctaggactacagagagtagggaaggagcaaaattcaaagttggtaagtgcagggaaggaggagaatttcttgggttctaaatctgtgctcccaaagagaaaccctagcactgcttcctgttggttttcacagttcccctttcctgtgttcttgcctgactttggaaattctttgctacataaaagcaatattaaag

SEQ ID NO: 19218 - DNA, 1045 bp, Homo sapiens
tgagccaccgcacctggccttgtgttttcttttaaaagctttatagaaaaataaataaaaatgaaagctttatagatttaaattccttatttgaggtctgtgatccatttcaaattaatttttgcatgtaatgtgagttaaggggtcaaagttcgttttattttgtagagaaaaatagttgttctagcaccatttatgaaaagatttcctttctttgttgaatttgtattgatgccttggtgaacatcaatagaccatatatttgtggtctttctggactctcttttttcctttgatctatttatcctttatgccaacactacattcataatgtacttttctatagttaagtgtttaaatctgataggtcaagtcctccaattatattattcttgtttagttcaggttggctgttctaggtctttcaataaaattataaaatcaacttattagttcctactaaaaagcctgcttgtattttgattggaattgtgttgactctgtagatcaatttagagaaaattgatgtcttaagaatatggactcttccaatccttgcgtggtatatttctccatcgttgtatgtctcctttaatttctctcatcagcattttgtattttcacgcacattttcaaaaattaaatttattcctaggtatttgacgtgttttaatgctactataaatgagcttttaaaatatttattttccaaatatttgtttctaattgatagaactatagtagatatttgtaggttgaccttgtattcaaattcacttattctagtagtttgtagattcctttgaattttttatgtctgtaatcatagaagcattctatgcttgtgcagataaagcatttttcagtgttaaaagttttattgacttctttttctggagtttccatcttctcattttgtcttctccttttggtatcaagtgctaagaatagcaccacttggaaatatgacaggactgcagccagtgtggataattatcattttcaactacagatctctctcagccttgtctgcttatcacactgg

SEQ ID NO: 19219 - DNA, 1031 bp, Homo sapiens
atatcaagatatagaacactgtcctcacccacaaaggttcccagtcccttttccccgcccttcagcacccagaggacaccactctcttgacttctgtcatggtagttttgcctgttcttgaacttcattgaagtggaatagtgcggcatgacctgttttatgtctggcttactttgctcaacttaatgttattgacattgatccacattgctgcatgtgtcagcaggtccattgtatgaatgcaacacagtttgtttattcgttgtcctgtggatagatagttgcatcctttccagttttcggccattatgagcaaacctggacacatatgttcataaaaagacttgtatattaatttctgcacctgaggagcagaattcctcagtcatcagatagatgtatttttaacttgagaaactgtccaaaagtttgtgcacagtggttgtgccatttaccctgtcactagcaatgtttcagagcactggttgctctgtatccactccaaaacttggtattgctagtcctttcaactttagccattctgttgtgagtgtcctagtatctcactgtgggtttttttttttttgagacggagtcttgctctgtcgctcaggctggagtgtattgactggatctcagctcactgcaagctccgcctcccgggttcacgccattctcctgcctcagcctcccgagtagctgggcctataggcgcccgccaccacgcccggctaattttttgtatttttagtagagaccatgtttcaccgtgttagccaggatggtctcgatctgctgacctcgtgatctgcctgcctcggcctcccaaagtgctgggattacaggcgtgagccaccgcgcccggccgtctcactgtggttttaatttgcatttccatgttgatgatgaatgatgtcgagcagcttctgtgtgcatattgaccatttgggtatctttttttgtgatgtgcttgttaagtattttgcccattttgggggaactgtatcttatttgtttctggttgttatcta

SEQ ID NO: 19220 - DNA, 1034 bp, Homo sapiens
tgattctccctgaaataatctaatcacctgcttttcccttccctgccttagcctttcagcaatggattggtgactgtgatggttccccagctgcggagggaaaacagccttctcctgtggaatgtctttgacttgaacaccccagtccacaccttcgtggggcatgatgatgtggtcctggagttccagtggaggaagcagaaggaaggtgagtgggagaggcctgctgcccactttccttctgagctctggtgacagcggtgccagtcagtgttgccatggagtccagtaaagaagacatagagagagctgggctttaggaaccagagagccagggctgttgccacctttcgtcataggtgagtaaagggactatataaggctgctgttactcttccaaattctgtcctcttccacaattgtcagcgtagtctctcttgcttggaagagatatgctccagtaagagacggaagatagagatttgctgttggattgtttctgggactgaaagactctgggctcagaagtccagggcatttgccccttgccactctgttgatgagggagacccaaggtggtctttagtactgcctactacataccctcagttgtcttcacaagcatgtagtgctctgtctcaaaaaagaaaaaaaaaaagaaaacagatgatgtgatttcctcagtccagtggggaggggttgaccggtagttttggatggaaataaagtttttaggaacccattgttagttacccatgttgtctttaagctggtgggtgagttgtgtaaattggaactgcctggccagtagcaaaattttgagtacgagttactatttaactttttttttgttttaactgtggaagaggggaataataaagactggggcctacttgaggacggagggtgggagggggagaggatcagaaaaaaataaccattgggtactaggcttagtacctgggtgatgaaataatctgtacaacaaacccccatgacaggagtttgcctttgtaacaaacctgcacatgaac

SEQ ID NO: 19221 - DNA, 1030 bp, Homo sapiens
aatgacatataatcgttttataagactgcatcagtgattgccttgagagcaagagcatgttatgaacagtgaggatattatcaaatctccagggtcctctaattaatcccataaattgtataattgtcaccagttggtgaacatatttaaatctagaaacaaaatctttctttttttcttaaaaaaaaaggattaatcttgctaacagttatatgccagtctttatgcatgaacgtgaatatgtttctatccaaattgaaaagtaaacagttgctgaaatgtattcatattaacaacattttacttgtatataattaatctggggaggctgaacttttctttgctagctttccacatactgtggatttgataatagggaggcatgcacagtgtagagctcattaaaaatctgcagaatgacaagcatatctaattattttgagtatcattccttttataagttgaggggcgaattatagtttaccctgtggccatgtgggaaacccaaaagtagtttaagctgaaaagacatcttgaccattttattattttgaacataggacctgaatttggcaaaaaagagttgttatataagggtctaaagataagaaatggctggtgcggtggctcacgcctgtaatcccaacactttgggaggccgaggcgggtggatcgcctgaggtcagaagttcgtgactagccccactaacatggtgtaactccatctctactaaaattacaaaattagcttggtgtggtggtgcagcctgtaatcccagctagttgggtggctgaggcaggagaatcgcttgaacctgggaggtggaggttgcagtgagctgagatcatgccacatgcactccagcctgggcgacaagagctaaactccatctcaataaataaataaataaagataagaaatgattgcagtcttgatatatagtgaaactaaagttaaatacagcagtaagtgataaaaattattaagaatggtagcatttttaaaaaacaagggatttaggcatatgat

SEQ ID NO: 19222 - DNA, 1042 bp, Homo sapiens
tgctttaggtacttatgatctgagacatagactggctgcagagggcgtataactgaatagaaatacaggtggtctacagatgcctcaatcacattctcctgactttgttacttacatttataggtttcttttttttttttatttttgagacagagtctcgctctgttgcccaggctggagtgcagtggcatgatctcagctcaccgcaagctctgcctcccaggttctcgccattctcctgcctcagcctcccgagtagctgggactgcaggcgcccgccaccatgcccggctaatttttttgtatttttagtagagacagggtttcactgtgttagccaggatggtctcgatctcctgacctcatgatccacccgcctcggcctcccaaagtgctggcattacaggcgtgagcctcttcgcccggccacatttataggtttctaagttagattagttttagggaaaccctaaaaaggacggtggttctttttttatttgagatggagtcttgctctgtcggccaggctatagtgcggtgacacgatcttggctcaccgcaacctccgcctcctgggttcaagcgattctcctgcctcagcctcccgagcagctgggactgcaggcatgggccaccacacccagctaatttttgtaattttagtagagatggggtttcaccatattggccaggctggtctctaactcctgactttgtggcctacctgcctcggcctcccaaagtgctgggagtgagcctctgcgcccagctgaaagtggttctttttttagcctgcctgttctcattgcttttttttctgttatagatctttcttaaaaaatggaagtagaagacttctttcctttgtactcagtgaggtttctcagtggtgcagatctaccctgggggaaaagaggcaagtgagaggcttgtggaccttgataagctgctggatctagcataccccgagtggtacagcctcgggtactgcctgcttcccagagcctgtggtccccatctctcagggggcacattattcatg

SEQ ID NO: 19223 - DNA, 1049 bp, Homo sapiens
ctgcgccgtggctgagtggaattgtaagtctcatgttgttgcaaggggctcactttaggctgctcccagaagccacagttaggactgttgggtgtggagcaggacctcatatcagagtccaaggacaagagccaagatgatttgtttgtaacctttttatagtggaaaatttcaaacattctgtaaaaatagggagaagaaaatgaactgcctgtgttcatcgtcaccttcaacacttgtcatcatacatccaattttatttcatcttttcctccacccaccatttcacctccaccttcatcccccttgtgatttttttcttttctgagacagagtcttgctcttgttgcccaggctgaagtgcagtagtgcagccttggctcactgcagcctctgcttcccaggttcaagcaattctcctccctcagtctcccaagtagctgggattacaggcgcctgccaccacacctgggtgatttttgtatttttagtagacacaggtttcactgtattggccaggctggtcttgaactcctaacctcaagtgatcttcctgccttggcctcccgaagtgctgggattacaggtgtgagccaccatgcccggccctcttgtgattattttgaagctacatatcttatcatttcttcaacaagtatttcagtgtatgttttgcaaaagaagaatcccaatatcatacttaaaaatacctaaaaatattaacagtaactctttaatatcatcaagtatctaagcagcattcagatttccccaatagtctctctctctttttttagttacaaattgtttgaaaaatggtttcagtgagaatctaaataaagtccatacctgtaagtggttgatatatttctcatctttttaagtctgtctccttctcctttttgggtttgtgtttttcttttcctgtagtttattaaagcaatagttcatcctgtggtttctccacaattagattacactgattgtatctgcatattttttttgttttgttttgtttttgagacagagttttgctcttgttgcccagg

SEQ ID NO: 19224 - DNA, 1105 bp, Homo sapiens
tccattttccttgtcactttctgcttaaccctttaagaaattaaatacaggcattatttcaaggagtgttaaataattttgccttctaggacacccttttgaggatctttcttcttttcttttctttttttttttttttttttttgtttgagatggggtcttgctgtgtcacccaggctggagtacagtggcacaatcacagcttactattgcctcgacctcccaggctcaagcgatcctcccacctcagcctgtcaagtagctgagaccacaggcatgcaccaccatgactggctaatatttaattttttttgtagagatgcgatctggctatgttgcccagactggtcttgaactcctgggctcaagcagcctcttaaagtgctgggattacaggcatgagccaccaagcccagcctcttttttctctcttatgcacctatgtttttaaagtgacacgggacccagttgtgatggcgcagtcctcacacctcacaccttatcccagctatcctagactctgaggcaaggggattgtttgagcctaggagttctagaaaagcgtgggcaatgtagatcccatctcaagaaaaaaaaaaaaacaaaaacctgtggtaggtggactctgggcatttggtcatggaagggtgagctggagacatccagtgtaccagcagctggggagacgagtgtgtgaccttcagagggaggaggttcctctagtggccgggacattttcctggcccatgaagctcgtctgcagaagtgcttctgcaccttcagttcagctgtgactgttcaagatgcatctcttaagatagtcctgcctttccattttgagattcacagacctacatactgagctgaagttagctcaagctaatgttaattgtacttattcctgatggctttttaaagaaaagttcagcctgaaggatctttgccatgcatgagatccctggcttcctcttcactgccttaagctgattggggcaagaccatatatcccaacatacttgcctgtggccttctttcctttcttttcagagtaaccaacgagtagacctttacaagtggaaagacggcagtggggaagttggcacaa

SEQ ID NO: 19225 - DNA, 1034 bp, Homo sapiens
tcagtggataatattccattgtgtaattgtttatctatccgtccatccatcagaggacatttgactggctattgaatagagctggtatgaacatatgtgtggaggtacttgtttttgcttcttttgggtaaacatctaagagtggaattgcagggtcatatggtaattctgtgtttaacttttggagggaaccaccaaactatttccacagtggctaaaccttttatactcccatcagcaatgcacagagttccagtttttccacatcctctccaaaatttattttttgtatttttaaaaaaattatagccatcctagtgggtgtgaaggtgtgaggtggtactttgttatgtctttttgtttgtttgttttgagacagagtttcactcttgttgcccaggctggagtgcagtggcatgatctcggctcaccacaacctccacctcctgggttcaagcgattctcctgcctcagcctcccaagtagctgggattacaagcacacatgatcacgcctggctaattttgtatttttagtagagacagggtttctccgtgttggtccagctggtctcaaactctcgacctcaggtgatccacccacctcagcctcccaaagtgcttggattacaggcatgagccaccgcacccagccttattgtggttttagtttatattcccccagtgactaaggatgttgagtatcttattggccacgtatatgtcatttttttggagaaatgtctattcaaggcctctgccctttttctttttttttttgagacggagtctcgctctgtcacccaggctggagtgcagtagtgctatctcagctctctgcaagctccacctcccgggttcacgccattctcctgcctcagcctcccaagtagctgggactacaggcgtccaccaccatgcccggctaatttttttgtatttttagtagagacagggtttcgccctgttagccaggatggtctcgatctcctcacctcatgatccgcctgcctcggcctcccaaagtgctgggat

SEQ ID NO: 19226 - DNA, 1087 bp, Homo sapiens
ggcatattttgtctagtatctgccctgtgtttcacagatttatacatgcagttttgcatttcaaagttgtaaatccaacattagatatcaaaagcattttgttgaattcttaaagcttgtccctgagccgccttggactttgctgggttgccccctctgctggggcgggccctgggcagtttccgattgctcatgccttcattacggtggcacggcggtaacacctggctgcgggacatctgtgtctgaacctccaggtgctcccctccaagcctcaggcctgcccctcaaatgcctgggaaactgagtctcccagttccagggtagtggttggctgggctgagaaggagcccttgccaggacttcacgtgggcgggagggacactggctctcaggaagccaagagggtgagtgacaaggatggtggccaggagggtcagaaccctgggccctggagcagggtccagtggttgctaaggtgggagcctggtggcccgtatggctgagggagaggtgagggccacactggcaccgagactctttgggccgggtgtgggctgtaggaatctgagggcagaggctctttcatggtcagatgggacccccgggggaaggcgtctgtgggaggtcgctcaggtagtgcccctggtcagtgtctaaggagacagccatggcgtgaggtcaggcgtgcacgtggtcctgtcgggcctgtgtttcaccctcctcgccctagaagcttcatcttgccccaggctcccctgtgctgggacctcaggctggggtgcctggagctggggagggaggggagcgggctatggtggtggcccctcaggccaccatgacccaggtcgggtgagcccctcatgctggggtgtgtcctggtggccgtggtcgcagcgctcctgtggtgctccatttcccaaggaggaaacgaggctcctggattgggacctgggggtgccagagccgggagccaacccaggtcaggggcgacacccattttgcagaagggggagaccagccactgagctccagggcgggggcccactttgtccccttcctccgacctgacacctgcctctggggc

SEQ ID NO: 19227 - DNA, 1050 bp, Homo sapiens
gggtcacagcctgcctccctgctccagccccctggctgaggcccttcctctgccccatgctcttctcagacaggaatcctgtggaatgtcatctctttggggaggccgtctctgaccctgtatgcaaaggccttctcccacattatttttggcaccccactttcttccccgtgaaagcaaattgtttggtgtctttctgtcccactacagtataggcccggttcagacagaggccttgtccactaggcctgcgctatctctgcggagcccagccaaagcaggggccaggcgaatcttttgttaaaagaacaatgcgcgctgggcacagtggctcacgcctgtaatcccagcactttgggagtccgaagctggaggatcacttgagcccaagagtttgagaccaccctgggcaacataaggagaacccatctctacacaaaattagctgggcgtggtggtgtatgcctgtagtcctagctacttgggaggctaaggtgggaggtggctgaggtgggaggatcacttgagcctgggaggttgttgcagtgagagccatgatcgcgctactgggcaatagagcagaacccagtctcaaaaaaaaaaaaaaaaaaaaaaaaaaaaagaacaatcctatgaaatgagggctgtcatccagcagagaggatctagatgctcagagaggctaagggatttgcccaaagtcccacagccgggcccaggtctgagtctgcctagtgaggaagaaggagtgcatgtccttagggaacagaacaggaggcagagaggcccggagaggcgggggccctggccagctggagtggtcggttgtgtaccagcagcgtccagagctcaggctgggcgggggcacaccagctgacgcaggcggggaagctcctggtgccaggcgcctggtgccacgtgcccagcctgtgagatgcttcccagcctggcttcagcggccccagactgggctgtggccgatcagtgagctcatgcctggcagggctgggctgtgaggccagaggccccagccgctcacctgggccgggc

SEQ ID NO: 19228 - DNA, 1040 bp, Homo sapiens
gcaaggggcaactcaggagagccaaggttgtctccactcggtttcccccgagtgattcttccttctatctccctcattcccccagtgccgctctcctaccccatgtcgctgaagcagatgagttggagcaggactcaggagggtactaggcccaggttttaggctgaacctaggaatgagtaatgagaggaggcagatcagctggaggaccagcccgagtccccagatgtcggcacaatgcaggggaaggtaggtgctgcccgtgaaaagcgctgggtcgagagctcgccagcctccctgcttgaggcttcatttcctggggtccttacacggtgggaccgtctacagtcggagctgtggtggtgatgattcgtctcctacaggctggggcacgccccctcccctttccctctagattcagatttgagtcccacggcccatggacacgcgatgaatgccctggggttggttagcgggaaagacaagtcgacttgaggccatgtctcggctctggaggaagaaggcaaaccgggcagccttcccagaagtggaggagtttgcgtaggccttcggtgcgttctcgcctgggtggaaggcggggacgtgcatttgttggagagcggtgtcctgcgccctaggctggaagcctggcctcgggcaggggcctggagcctcggggttggaggtggggggcggggcggggggcggcccctactgggcgggcttctgtctgcgcgcccgcgcccccgacaggcggcttatttgcatggagagcggcggcggccaatgggcgcgcgcggccgggcatgctgggatcgggctgggccggctgggccgtggcggcaggcggagagcggctggaccggctctgggtggccgaggcggcagctgcgcggcggcaccggggcggctgcggcgcgctcggagccccgagggcacgcggcccgggcagctcggtgtgcgcccccgcgagagccggggccccaggcccgccggacaccatgaaccacctggtgagggcgccaggtggggccgggccg

SEQ ID NO: 19229 - DNA, 1034 bp, Homo sapiens
cttccagcctgtgagctcatcttcaacctggctggaggtgccaggccactcctgggatgacacaactgtctgggagggccctgtgctggtgccccggccacatatctgcagctgtctcccttggtctggcaacaacctctcccagctcctccttattcagggcgtctctccttgctgccagtcccactgtgtgtatacgcatgcgtgtgtgctgtgtgtatgcaagtgtgtgcctctgcacttaggcgtgacttaaccacccccatcctccagactggggcagcctcagatttcttcacccaggccagcctatcccatgagggccacctctgaggtcccacccagtcaacaaatgtttactgcaccccttctcaccaatggggctaaacttagtggggtgggggtggtgctggccccagtgctgagctcagttttactggggaggaaggtgcttaggtctcagttgcctgtccttttgcagtctgagtgtgacaggggtgtttggctttctgagcctggagtgctgctgtccctgtccctagattcccttcctgctgcagggtgggctgaggtctagcagccccatttcttccctggccctgtcccttctgtgccccgaaatgtgtgggatggggcagtggttggtaaactgggtctcggtctcttcatgtgaaaaatggggctaggctgggtgcagtggctcacgcctataatcccagcactttgggaggctgaggtgggtgaatcacttgaggtcaggagttcgagaccagcctgaccaatatggtgaaaccccatctcaaaaaaaaaaaaaattggggctaacggtgagcctgttttgcaggattgctgtgtgcacaaaataaatgcatgggcatagggcccctggcactggctgggcgcagaggctgtgctgggtatgtggggctgcatccctgtccttgacagcggaggtccgggaggctggactgggggtggggtgaggttctgcccccatataccccggccagagcctggccagtgggtgctcctcc

SEQ ID NO: 19230 - DNA, 1050 bp, Homo sapiens
ctggcccagggcctcaggggactggccagccctgctcctgtgggcactgggcagagggacaaggcggaccacctgagcctgctggagggccggtatcccagggcagtagtgattagggaatgtcactctggccacatcccagcctgggcgggcctctatggggaggtccccgtttgatttggtttggttgtccacagtcagagccaagctctgggcatggagtctgggatggcaccctgaccccttgccttacaggactttgggcagccttctttggcactgtgcctcatctgtaacaagagaggaacagcgggctgggtaggacttggacagataggcactgtcgtggggacctgcagcctggccacaccatcacgggctctgagtcatctcctaccctctcccttgtagtcacagcccaggagaattctgctgggggtgggcagaggtctttgccatctgccccctacgtggctggctggcagatcaccgtggctctctctcctgggaccttgggcagtgtgtgaggtggtggggccaagaggagaattcatttttggaacagtcttgaagtgttcggaaaattgctttcatgtgctgaggaggccctgcggaggcttccagactgagctgcctgctcaagccctgcccttggaacccagagtggcgactgctcagggacacgtctgggttttaagcacacccatccatttgggcagtcttttcctagatgggctgacgcagcaggcactttggcccacagaaattataagatgcttcagaaggggatgggaggggaagcagggtgagagattggtgggctggttgtgcgggtagcgaccccctgagtgttgggggaggggagatgccggggatcagctggtgtcaccttgtcatttgactcacatgcagtcccggacccagagaggggaaggagccagggcgtccctgctacctgctcagtgccccttcctctgctccaggcatagagcagtgcagtgctcgtgtgctgcctggacaccctgtgggtattcccatgccttcctctcg

SEQ ID NO: 19231 - DNA, 1049 bp, Homo sapiens
ttgctgtggtctggaactgaacccaaaatatctcctaggtgtccctgcatgtgtcacccagctttctctgatgttaacatcttatatttggcagtggtacatttgtcaaaattaagagattaacaacgggacggtactattatccaaactccactctttattataatttcccattttcccacaagtgtcttttagcatcttattccaggatccagttgcggataccctgttgcatttaagcagtaacttttaaaacagcacttttccctttccccaccacatttaagaaaagaagcacattttagacttacagaagagttggaaagatggaacagagagtgccatgtacttttacccaacatcttgcatagccatggtgcatttgtcagaactgagagactaacagtgccatcatgtttttatgcatcatgaggacacttctcttggagatatgtcttggattttttttttaacaccaaggctgtgaacctcatgctcatatgactttaaggctggagttaggcagaccaggacttcacattcctccctggccatatcccgctctgtgatctctttcaactttcttctccacaacagtgaatgcagagccatgagagaatgtgcgggtatgtggcaggcactcagcaagttactacacatgttccttgacatatgatggggttatgtcccaataaatgcattgtaagttgaaaatatacgttgaaaatgcatttaattcacccaacctaccaaacatcaaagcttggcctagcctaccttaaatgtgctcacaacacttaccttagcctgtacttggacaaaatcatgtaacacaaagtctattttataataaagtgttgaatatcttatgtaatttatcaaatactatactggaagtgaaaaccagaatgggcgtatgggtactcagagtagtttgtgctgaatgcatatcactttcacaccatgataaaggcaaaaaattctaagtcaaactatagtaagggacatagtcttttctgttcccagaaaggggcttagaacagagattc

SEQ ID NO: 19232 - DNA, 1031 bp, Homo sapiens
aatatttaaaagatacctagttaagaatcaagctttaataaatacctcattttatgtaaaatatttattttacttaataacttgctgtttcatttttttattaaaaaagctttagaataatgttgtattgaatatctgaagagattattatttcagaaaagctgctaaaatgacatggagagttcctatatgtaggcatgcctcatctgatggcactgtgctttactgtgcttcacagatactgtgtttcttacacattgaaggtttgagttgagcatatctacccgtgccattttaacagcagcttgtatttacttcatgtctctgtcctattttggtaattctcataatatctcaaattttttcattattattatattattatggcggtgtgcaatcagtaatccttggtgatactattgtaattgttttggagcaccatgagccacacccacataggataacaaacttatttggtaaatattgtattccctgagacaaaacaatattgaaattaggctagttagtaaccctacagtgacctctaagtgttcaagtaaaaggaagagtcacatctctcactttaaatcaaaagctagaaatgatttaaggttagtaagaaaagatgttgaaagccaagacaggctaaaagctaggcctcttgtaccaaacagttagccaagttgtaaatgcaaaagaaaagttcttgaaggaagctaagagtgctactccagtgaacgcacaaatgataagaaagtgaaatagctttattgctgatctgaagacagcttgaatggtctgaataagatcaaaccaaccacacaacattcccttaagccaaagcctaatccagagtaaggccttaacccttcaattctatgaaggctgagggagaggaagctccaggagaaaagtttgaagttagcagaggttgttcatgagattctttccttagaaagaagctgtttcatcagctgcaggagcttacacctgtaatctcagcactttggaagtcaaggcaggtagatcag

SEQ ID NO: 19233 - DNA, 1029 bp, Homo sapiens
agacagtgaagcatatccctgttgggccagaggctgttatcgttttgctctgaattcaaaacctgatatgtctccaaatttgcttagggttgttatcctggaaaatagaatctgatagaaggtgggcactggtaccaagtgcaaggtggaggtgatcatggttagggcaattgcatacaggtcatgactgcattggagtctcaggaaagattggtttagtgatttggcaaatccaaggcatgagttttgggtggttttgttgttttgtcttatttttccaccccttaagagtcttaggggaaaacagcatcattgaatagactagctaaaaattcagcacttaatacccttcacagcgtattagcctctgcagagctttgctattttggaaccagtggtgtgaattattctctgttaataagaatctggctttcttttcctgttggaaaagaggctcgtgtgcatgttactctgactcagtagttctcaaactttttgttctcaggacctctttacgctcttcaaaattattgactgggttataactgttgttatttatagtataagaaattaaaataaactagtatatttttaaaatttagaatagcatgattttgtaaatttctttaatatctcgcttaatcgaagatagctggagtgtcagatctgcttttccattcagtctattttaatcagttgttttggctgaattatataaagaaaatttagtctcactcaaatatgtagttggaaaaggaaggagtattttactagctgttttgataattttggttatccttttgtgatactacgccaaatgtgaacagtgatgtaacagcatgcattaatcatttcagaactgctgattactgggttatacagctcttctaacgttgactgatttcattagacattctcaacaagtcacattcattaatatcagtgccaatcaaaagtcttcacaaggaagctgtctagttcacggtggtaggcaacaagttttccaaaattctaaagctcagaatttat

SEQ ID NO: 19234 - DNA, 1075 bp, Homo sapiens
ataacaccgtcacccaccatgtagcctctggaaaaatccacttgtgacagaatacaagagaagaaggcaaataatgtcttcgtgttgtcatgaaaatagctttaaccttttcagctccctgaaaaaaatctcccatctctctggggtccctgaaccacactgagaactgcaggtttaatatatctctggaaggatactcaggcagctaagaacagtgttggtcttggggaaaggggaatttggtagctaaaagacagcaaagggtagaatggaggcttattttaaaataccttttgagtattttacttggtacattaataccatttttttaaaaagtgaattgttaaataaagcccttattttctttctggcagaaaggtgcttaaagtaatagttttttttgtttgtttgtttgttttgttttgttttgtttttttaatttcactttaaacacatagatctagaggggagaagtacctcagaggacacatctccaatctaaattaggttcccactagtatgaaccttcacagcccctaattcttttctgtagcacttacctcaatttgtaattgcatggctgtgtgtgtgtgtgtgtgtgtgtgtgtgtgtttcacctcttttctcccccactagactattaacttcctgagggcgtgaatcaaatctgttttgctcgcttgtctcagttcagtacttggttcataatagtttgttagtaaatatttattgaatgaatgaatgaggatctttgggaaactcctatcaatttcctatgtcagtgctgaccagttctggacagttgccagaagacagttcttgaccaaacacctttttttgcatagataaaatgcttcttggctggacatggtggctcacacctgtaatcgcagcactttgggaagccaaggtgggtggctcatttgaggtcaggtgtttgagatcagcctgaccaacatggtgaaaccctgactctactaaaaatacaaaaattagctgggtgtgatggcgggcacctataatcccagctactcgggaggctgaggcaggagaatcccttgaacccaggaggcag

SEQ ID NO: 19235 - DNA, 1024 bp, Homo sapiens
gggccaaaactgcctgtcgttggtagagggagaatataccactattttcctcaatagtagttgagccccaacctcagtgtcacctttagtttttccctttcttgtctttccccctagcccctaactgcccaatccaatgagtccttttaactctactcccaaaatgtctgtaagtattcattcatatccccctccctcattttatctccactctcattgccttttttctgggtcttacattctttcttttttaaaaaactattttaattttaattttttattgagacagggtctcactttgttacccaggctggtctccaactcctgccttcaggcattcctcccatgttggcctctgaaagtgctgggattacaggtatgggccattgctcctggccctgggtcttacattctgaagcatctgtcactatgtaattagaatattttctaaaatcttttgaaaggcttggactattgtaatcatttcctaagtttacataaagtctgtagtcactcttcctctctccactctacgtgccactgctggggtaatttggcagagatttagcttagatagtgtcacatgctcaaaaattttatctttgttgtctattagtaagttctagtttattgaactgctactgtcgattgctaactctcaaaaaaatccttcagttcactgtcagtatttccttttatgtttaatatgtttttactctttagcgaggttttatctgtggtgtgatcttatatgacctggttttaaaaagtggggatgaatttgctttttctagatgctcttgcctgggccaatttttatgttaattctttggtttggagtgcctggaacattcagatattataattgaaagtataattttgaagcccaaatctatgtgggttgcaggcccagggttcgttccggttcttaaaagagacctttcttcctacccgctacagcccaaaagcttagatacactttcttctctgttccttgggctgttatgtgattttttttttttcc

SEQ ID NO: 19236 - DNA, 1052 bp, Homo sapiens
aaggtggagtggggattccctgtggcctgaaacatttcttgcttagtctaactcaaaagatcctttttcatttgttaccaaaaatgtattaggtccctgttgaaggctaggcatggggtaactggtaggggaatacagatatttttgagttcataatctggtcatgtgggaattgctatctttgtgattttgattatttcttccagattattttattcaataaatctaggagactctgggttttaaggagtcagcatctaaaagtgatcttgcaagccatgcaatgaatactcaaagtgtagagtagtccacagaaagaatagggaaaacctaacatttctgtaagatttaaatttcagtataaaatctggaacattctactcgcagtagtattttaaatgttgtattttcgtgagtttgttaaccttcgttttttgtttttgtttaacattcttgcattttaaatcaggtgcagctattgctggagtttaccgagcagcagggaaggaaatgataccatttgaagccctcacactgggcactggacagacattttgcgtcttggtggtctcctttttacggattttagctactctatagcatacatccttatgctgagatgttgaacttaaactttatggaatcctccaaaagaatacattatggagtgtagtgttttcttagttcttcaaagggaagcaacttggatgaacaggaacatgaaggacaacacatctcagccttttcttcattttgaagctcctagaattgaagacttatgtggactcctattgttctcaaccaaaacaagtcttttggctttcttttttgtagatatttgatttaagcagttttcatgtgtacctttacccaagccaagtcaacagtgtctctggggtggcatcctttgcactgaaatttacagtattctgtgagatgtcgcatattttgaagaaaccgtggaagatactggtttatttcaaatgagcagagtatgttgtattaaaatcttatctaatcttgattaaaatttggcaaactcttttctttgc

SEQ ID NO: 19237 - DNA, 1019 bp, Homo sapiens
tgcattcattgtcctgaatctgttgtattgatattttggccccacagaaaaggttacttgcagtgtatgccaactcattatggcagaatcattgttctgaagtattctgacatatttatgtataccaggaagtactgaattgattttttctttattacctgtatttgcagtttagccatttacctacggagggttaggtagacatctaaatgactaaattggccggttgccgtggctcacgcctgtaatcccagcactttgggaggccgaagcgggcggatcatctaaggtcaggagttcaagactagcctggccaacgtggtgacaccccatctctactaaaaatacaaaaatttgcggggcgtggtggtgcatgcctgtaattccagctactcgggaggctgaggcaggagaatcgcttgaacctgggagggggaggttgcagtgagctgacatcatgccactgcactccagcctgggccacagagcgagactgtctcaaaaataaataaatgagtataagtaaatggctaaactgcaaatgcagtttaaaattttttcctttattgttgtcatttttaacaaacctcaaaaccaagaaactgagatctttatcttgtatcaagaatgacattcatcttcagaagatacagatttcactaaatcagtgtcaaattagatctagtgataattaaaaacccagtaatgtttttgtgtcatccttgcaggaatcaagactggtcacacttggaccagtcatttattcattcactcaaaaaatatttgctcagtgttgattgtgtgcctgttgttttctaggcaccaagtcaagatgccatagtaacaaagcaaagccccttcccacgtggaactttcattccaatggggagagagaaaaacaaaacagctggtggtgaggggcctgggaaggggcagggcctgtgtggtgggggtggattgctgtttgctgtaaagtgatggggaggccctggatggtgatgatattggagtcaaaatct

SEQ ID NO: 19238 - DNA, 1067 bp, Homo sapiens
ggaggccaggtggggactttgctggaatccaggagataaggatgcagccaggaccagcatgaccctcccgcggctggatgtccaggccatccactgggacaccatcaggtcccttgaccgtcacatagccagatgtgtcttcagtgtccccaacttgattgtcagctctgccaggatcgggatcctgagcactggctttcctggatgaatcttttgctgatcttatctcttctctattttccaacctttatctgtcatttatgttttttgttctacttttcacatcttttaaatttttctttcaacgtttctaatatctaatgcaattagccccaaggaaaactaagggaaacaagaaaaaacaagaaaggaaatgtactctcagtacttcagctgtgagctgtgagcttcagctgtgagctggagtgttttgctctggttttaggtttttgattttttttaagaaagagggtcacactctgttgcccaagctggtgagcagtagaatgatataactcactgcaaccttgaactcctgggctcaagagatcctcccaccttggcctcccaaagtgctaggattacaggcacgagccaccgtgcctggcctccaggcatattttatcctttctcaagctatgtgtagtgttttgacaaaaataaattttaaaaagagttaatgtcaaaaaaagtttctgtgacttaagaaggaccactgcttagggtgctcctcctgggtaccaaaacaagaaacagaactttctattccctttatggcctcttgtactttttagttccaccctcctcctgaaaaaatatgatcattttcatcatcatcatcaccatcatcaccattaattacttgttggaaatttaaagcagaattgcctctgaggttggaaggctggagagggcatgagagataggaaacgtcactttcttctgcctgactggccttgtgctctggtgtggggctgtgtctgcccagggggtgtggcctcttttcctgtcttcacatatgaaacatgagctggcaatgccctcatctttaccttgagtttttttgt

SEQ ID NO: 19239 - DNA, 1028 bp, Homo sapiens
agcaaatgttgactttcctttctcctccctttttcacagaggcaaggcagtcaagtttcccatttttgaggatgggaaaactgaggcctgaagagcagaaaggagttggctgacttaaacccacaagcgagtaggccaagtaccagggcctctgagggtgctatgctgctccgggagctggggctgggctcctctccagcctgagaggccggaacttttctggctttgttctacaaacagagtcaactggagtatagagagccagagagtgacttgctctaagtcacacccctcactggtagtagagacaggatttgaacccaatccggcttcagaagccaagcttctaaggccagtcgcagtggttcacgcctgtaatcccagcactttgggaggccgaggcaggtggatcacctgaggtcaggagttcaagaccagcctggccaacatggtgaaaccccatctctactaaaaatacaaaaataagctgggcatggtggtgagtgcctgtaatcccagctacttgggaggctgaggcagaagaatcacttgaacccaggaggcggaggttgcagtgagctgagattgcggtacttcactccagtctggacaacagcgagactccatctcagaaaaaacacaagccaggcctctagccatgactttccagcgtcttctgttttgtttgcccttgtggggaccctgtctgtgcctgccacattctgttgctggggcactggggcacctgaatctggtagagccattgtccttgggttttcctcattcaaagactttcccttggattcatagaatataagtgtggcccaggaaggaagattgctaagcaaatactcataagtgcactatgcgccagactttgttctgctttacaaatatccactcactcactctttcaatcaagcccatgagttgggttatattgtttcccccactttacagatttttttttttttttttgatacggagtctcgctctgtcaccgaggctggagtgcagtgaaagtgaca

SEQ ID NO: 19240 - DNA, 1069 bp, Homo sapiens
ctttgtgagctgaggcgggtgggtcacctaaggtcaggagttcgagaccactctggccaacacggtgaaaccgtctctactaaaaatacaaaaattagctgggcgtggtggcacacgcctgtaatctcagctattcgggaggctgaggcagaattgctggaacccgggaggcggaggttgcagtgagctgagattgtgccattgcactccagcccaggctgacaacagcgagactccgtctcaaaaaaacaaacaaaaaacgcaattggcttcaacgatacttgccttttggttttcttctctttagctgttttttctcgtttgcatttgtgggtttgtggttgtgaaacagaaataaatcaaaatgcctttgggaagccacccctcctccacttctgtaaaatcctatttctgttcatatgtttaagcagaggttcaccattctctggcccaagcagggctgtttggtagtccaagcaaggccagagacctcccagggacttttgttagtgctctcagaaaagatgttcttccttccactagagttgctaagcaactccaaagatggggccatctttgccatcacatggagagaacacagagaaaaacaaaaccaagagatggagttttgatgttattatttgatccctggttctagctacacctcaagccagtgaaccatccctctgagaggtgagataataaactgcctttttaatgctaaggcctgtttgaattgggagcatgtcattgcaaataaaattccttagtaacacagagcttgctttccctttaccttgatcgctctgaggtcagtttctaactgcttttagtgtgaaactatcagcaaagagaaacagattttattacctcaagtttggtaaagacccaacaagatgtttgtgacaaattaagaatgtttcctctgatcccaactgagaagatgacatcagtagagagcttggatgagctgcttatataatttggtgaagataaagttaaaggtctttgtttcttccgcaatggaaagtgtgagtcattttaattacatgttcttagactggtggga

SEQ ID NO: 19241 - DNA, 1050 bp, Homo sapiens
aagccctgtctgatttggtagtgtctgtggctgggggaaagctgcctccacctggaccttggcaagactttttggatttaagacagtgttctgagcaagccttagccaaaattttccagctcctaaaacccacttcccttgctggctagttaaatggcttaggacagtgttatcttttcaactgccactgcctcctgagatggtgtctgggaaagccagaggagctgttaaaatgagtcccaccgcagcagaaaagctattgaaaccaggagacagcttccaactggaaaaatacttagtatctaagtgcttactttcaagagctcaagcagctcttcccataggcggctatcccgaaggaatggttgaatacagaaacagccaaggaggcagatattttagacaaagtacatttattttccagaaagagtagtttttttaataccccatattgaagaattgttgaccttcacatcctataaatgtgaatccttttaaacttaaacgtgtctgtactggggctgagactgacttgctgtaacaccatccagatgaatccaaaacaaatctttatacctatggtccaaaagtggtaggaaaattctgtaaagatttaagggcttcaggcaaagttgtttgaattcaatttttatttcttaaaactggggacccaaaatgaatcaaaagggatagatgtcagatgagtggttattgcctgatgtggtgggggatggggagcaggcggttgagttagaaagaggcacaggagcaccctctgggagatggaaacatcctgtgttttgattggagcgttgattatattggtgtaaacatttgtcgaaattaagtctacacgttaatgttcgtgtactttacgtaattatacctcaaatttaaaatgcaaaaaaacaaaaacatagcccttattactttgtgtagtagaataaaactgggcctagatactcaagcaattgtgtcctagtaccagttctgccactaacttctatgtgtatgtggggaaagtatgtaacctctacttataacttctca

SEQ ID NO: 19242 - DNA, 1022 bp, Homo sapiens
aacttagcaaacgtcagctttattgctgctcttgtttgatctattgcctcgtccccgccaatatttttttctttgaccatttaaagcaaatcctaaccatcgtatttcacccaacagaattaatatccttaatatctaatatgtagtctgctcagttttcccatgttgtctcaaaaatgtattttgactgtttatttgttcaaattaagatctaaataagagccacactgtgcatttgattgatggggtcttttgtctctttaaatctgtaacagttacccttttttctgtgttgaaaggtgggttttttgtcctgtagaatttcccacattttgtatttcactgctcatttcctcccagtgttgtttaaaggttcctgtctccccagtatttcctaaaaatgtgcagttacacaaagagccttgattagattcaggtgcggttgatctgacataagtacttcctgagtgactctgcatctttgttttgcatcatatggagaggaacgtgacatctggtggttccacacgctgtgactgagcaatggggtctgtggtgtcagtctggtcttttccattataaagtaccccactaaccttccacctgatggttctagcagccgtgtcaggggtccctgagaccaccctcatgcttgatgattcacaagatagattcacagaactctgaaaagctgctatacacatcattcctgtttattttagtgaaaggatacagattaaaatcagcaaacggagaaggtgcgtgagcgaagtccagcagaaaacaagcacaagcttccagttgtaccctcaatatgaaccgtgcgtgtttgattctttgacatgggaggggccttgctcactcggtggagagattgttcctcccaaggctagccaattcctggagagagtaaatgactcacctatgactgctcctttcatatgtaaaccaaccaatctggagcccataccccaatctctcctttacaggacgtctcatactctgagccaatatcccatact

SEQ ID NO: 19243 - DNA, 1037 bp, Homo sapiens
atttcaccactgcactccatcctagacaacagagtgaaaccctgtctccaaaaaaaaaaaaaagtgtatatgtatataacaaaaacctgtacataaatgttcacaacagcattattcataataaacaaaaagacaaatgtccattagtggatgaatggataaatcaaatgtgatatatccatacaatggactatgattcagctataaaaacgactgaagtactattacatgctgcagcatggatgaacttgaaaatataatgctaagtgaaagaaatcacatattgtataattttatttgtgtaatatctagaacaggcaaatccataaagacagataatagcttagtagttaccacaggctaggtgctgtggctcatgcctgtaatgccagcactttgggaggctggagtgggaggatcgcttgagccaaggagttcaagaccagcctaggcaatatggcaaaatcccatctctacaaaaaatttaaaaattagtcggacatgatggtgcatgcctgtagtctcagctacttgggaggtggaggtgggaggatcgcttgagaccagggggcagaagttgcagtgagccgagatcatgtgactgcactccagtctgagcaacagagaccctatctcaaaaaaacaaaaaatttaagtggttaccagggaatagagagtgaatgctaataggtacgaggtttctttctggggtgatgaaaattccttaaattacattaccatgatagttgtacagttctatgaatatactaaaaacaattgaattatccactttaaatgagtacattttatggtatgtgaactatatccctataaagatgttggttttttgtttttttttaaaaaagccaaccctaggcactgtgcctgggatgttttctgtttttcctattctggtacttgcagttgctatctgcttcattctagaccagcatcatgttggcatctagtttgttcaaagatacaagagaaaaaaatgaagcttttatattataggataattttgggttttggtgtgt

SEQ ID NO: 19244 - DNA, 1035 bp, Homo sapiens
acacttgccaagcaagaacattattttcttagattgtacatgtattaaggtggcttagggctgggaggtaggtagagatgaatggagaagacagaacccccacaggctgcctgcagcaggtgttgacagggctgttttcaggaaatgggagaaagactcttgtaattgtcacagtctctgagaattaacctgtttggagtcccagagccccaagcagcagaagggttttctttcagagaaatttgtatgtgttctgaggtcgatttcatcagtcctgacctccaggtctttgaaagaaacggctgcatcttggagttactaggaaatgaattcccagcaagtcctgagtgtcaggagcatctctggaatgatggtactcccacctcggagcctggtaacatgttcactcacacactgagatatcttagaagaaggtcaccttttggttctctttcctcttctaggccaaggctgcaggtgatgatgaggccatgttcatagatgaaaacttctgtactgccctggaatatgggctgccccccacagctggctggggcatgggcattgatcgagtcgccatgtttctcacggactccaacaacatcaaggtacgtagcaaccctccacagagcacacttcctgaggaagctgcattgtgttggagccagggcatggtgggcctggaggataaaattaaggaagggctttgggctgggaagaggagcaggcagaggagttccatgccactcacaggagggccagagcctctgaccttaaaggatttgggttttttcctaccaggggcagaaggaatactaattgtttgcatttcttgaggatccagggaagtctccgtgcattatttcagctaattaagtcagccttatgaggtgtagaaactgttgtttcccatttttatagatgaggaaatcaaattttcatagaaatgcgtctattcatccttttgacatagtgccctaggcagtgctatgcatttgttctttgtcatctgtaacttgagagggtctgagttga

SEQ ID NO: 19245 - DNA, 1040 bp, Homo sapiens
tctgcatggaccacctttctggaataatccttgatctagatccctgggatggagagaaggaaccttgctgcacccaggggctggagctggttaattcccctaaaaaagagtgaggaggcccagcactgaggtctaatcaggcagaagttgtatcatggaatgaaaggacagaggacaaagctccgtggtcttctgcattatcctctttaaagagagactcagaaagaaggtcctaattcaatcaaatgaggcagagagcgctggatagcccaacctctgcaaactttgcctaggaatcctgtcactcaggaatgctggccagccctggctattcgccaaccatggaaattagcaccagccactggacccaccctgcaagggaatagccaacccccaaagaaatccctttggaatccagtctgtaggtacagcccaggaattgtggaagcctttgtttgttcccatctgcaaactcaggctgccaaaacatattgggagtataatgagaaataacggaatcaaaataatgtaaaggaaataagtgctgaagagtataatcaacatcctctctgcatagatttcctgccagggagacgggagcaaagggaatgttttacccctggggcccagacagtggtcctggaaaggagaaaaaaaacttcctggaagagagtcttttaattgttcttttaagagagggcggcaggagctgccaaggcctggaatggaatgagtccaccattactggggtgtctccatttgctcagctgtagggggaagcagagaaacccccaaacttgggccgtacagcagtggattcccacaggcatctcttgagtttggcacctgagaggtgtttaagcaacttagggttctcacatgccaaaggtagggaagctgtggggatagcgagatggacttgggtttggtcctactgggctacctactcagcatggcggtgtgggctgagtttcacatgtgctctaagtctcaccctcttcctaacaaatctgaatcctcgttcatttgtaaaacctcat

SEQ ID NO: 19246 - DNA, 1035 bp, Homo sapiens
gtggagaagatcttggaaaatgagcccagggcttgaatcacttttctcatttaccaaatggtaataataaaattgccatcttcagagacacattccatgagcacatcacagatgagttaatccacaggaagggattagcagtgtctagcacagagtaaacatttgacaaatgtcaactaaaatcatcatgtattatattaattattactacatctattactagctttgggaccttagacaatttacttaacatctctgagcctcattcatcctctctgagcctgggataataatactcacctttgccttgttctaaggaaattttaaacaaagaaggtttgtaaatcatttatcatagcacacagcagttttccccttcgccatgggaagttgagctaaagccgatattccttctaggcatccttagaacagaataggtgacaactcttaaattttaaaatgtaagtcttgggggaatttattcattcagtaacattgtaaaaaatagccctaaatcccgatgctggaccctcagtggacatctgttttctgtgatgggcccagcttggacctgttcgagggtcttacttctatgcgcttctcaggcagggaaggtcccagtggctctgccttgctggctttcggccccagaatcgaatagaggtgggagtgggggagaattgctggagagctggaatcatgggataggagccacttgagccaggagcttcatctctctggtcctcatttaccttagcttgaggcactgcaaaaaaaaaaaaaaaaaaaaaggcttaatttttgtccaagtaacatgtgcagtgtgggttagcaagaggggctatgcccattgtcactgtcactcagactccatatgatggaggctccatctcaacctatgtttctgtgatcagtgaggctgatagaatgtagtgattccatcactggatctcagacctccttcctggaggcaacttatgtgactgccactcacatctcttcctggtcaaggcaggtctcacgttcatgcccaag

SEQ ID NO: 19247 - DNA, 1032 bp, Homo sapiens
tagtgctctcagtatagggttttcaacatccctgagcctgctaagtttatcagtccattcttatactaataaacacatacctgggactgggtaatttataaaggaaagaagtttagttgactcagagttcagcatggctggagaggcgtcaggaaacttacaattatggcagaaggggaagcaacatgaaggcgggaaggagaagtgctgagcgaagggaaaagagccccttataacagcatcagatctcatgagaactcactatcacaagaacagcatggaggtaaccacccccatgattcagtcacctcccaactggtccccccccccacaacacgtgaagattgtgggacctacagttcaaggtgagatttgggtggggacacagcgaaaccatatcactgagtgaaagggaggtaagggagagttgtgatatcatagtcccaggtcagcagaccttttctgtaaatggccaggtagtcaatcatttaggtttcaagggccacatgatctctgctgcagctgctcaaccctgccatcgacaatatgtaaatgaatgcccctggttgtgtttcaataaagcttcttttttccacaaaaacaggtaattgggccgggttcaactcccatagacccagcttgcagaggcaacgtagaggattgtaactgggtattttgggtctttggtagcagaaaatttggctctgaatggtgtgaacaccctgggactagttatctcccgtaagaagtccaagggtaggtgcccttgcaaagctgtttatttccacagctgaatgatgtcagggcccggactcttgccctctcccagctccaccattctcaagcttcagatgtaagacatgtgtaaggttcgaggtaccacattttttacaccagcccacccaaaaccagaggcagagagtgtgcagccctttattccttcgtaagagcaaggaatgttttgcagaagtcgcttccccacatagttaataggctgcaattgtcaggcgtccatccctctgtcaatggttg

SEQ ID NO: 19248 - DNA, 1034 bp, Homo sapiens
ttctcaactgcctcctcatttttccacaatgtatttctggctgttcggaggtaatttcctaggttttattaacctgtaacagaagcagtttacagctgaatccatgccagagaaaaactcatttgcaacccgatgtcgcagcatccagggccaaagggattgaaagaaaaaaaaaaagcatgaactcagaaaacctagttgcctggaagctgcaacgggactagaaaaagagggccaccccaagaaatgtaggtaacctgatccattagcaacatgtcagcttttctttgctaaaaatttccagataaatacagtatacatttaaaaaaattattaagtgactaatttatgcctagcatggtttcagctactgagaatacagtcatgctgtgaacaaggaagaccaggtttctccctttgtggggtttatattcttgtagaaggtgttagacaacagaaatgtaaatgctgaaaataataaaacaatttaattgtgagttttaacagctaggtctctgtctctgtctctctcacacacacacacacgctactaaacccatgacacaaatggaatcattaaggagaatttcatacaggactattcataaaggtatgagtaggtccacagtggacaaaggaaggatggtgcagtaccccagagctagcaattgcagggagctgttagcagaaccaggcttgaaggaaaggaccacccgattcaaacccaaacttcagaagcagcgcgtccttaatccatggcagcccaggaggaaggggactggggacatcattattctgattcatactcctattgcctgactgccctcccccagctaaatccaactggaagcctgagattcagggaacccactactgcagtccataaggatcagcctcccttggcacagaagaggatggggaaaggtggagcctgtatagctagatgagcaaaccaaaaacttccagcacgtactggtatgtggagatgcactggagtaacaaaatggggtctggttgggtatgggatggtgcac

SEQ ID NO: 19249 - DNA, 1034 bp, Homo sapiens
ttctagaagaatcagttcggtaaaaccctccttggaatgtttccataaatatagactctccccaaaatctgtcacatagcagttacattcactctcacctttatgcccaaatgacagtgacttgggactttaccccagcaggaactggcactgaggttaggagaggtcataacttgttgaatatcactgtaatttcagaaccagaattcaaacccaggtcagcccaactctagcatttcgagcccaaggaacttacatacatacatatacgtatatatacatatgtatatgtatatgtatatgaaagtacctgagtgtggtgctcatttatcactcatgacttgctgcccacactcacactatgtatatacatatatatgtatacacacacatatacatatacatacatatatatacacacacatatacatatacacacatgtatgtatatgtgtgtgtatatatgtataataagcagtgtaggattgttttgaatcagcggctgttttaaagttgagtcacctgttaatttcttttggattccttgtccttattttcccagccataaaacataagtgtgacacattgcaaacaaatgtgcaggcagcatgacacagtggaaaggcgtgaggtttggagttggaaaagcaagactagagcctgactttctgcttattaagtgccttgactttgtgcttgaccactctgattctcagtctcctcttctggggagaaataattaacacatctgggtagagagctatggtgaagaagaagggagaaaattctcctagaaatgtaaatttagaaatgtagattttaaattgccatccaccttagttactacttttaaaatctaaaataatacgagtaagtctggcaagagaattcggcaaggtcttctctgtgagttaattggagatgctgtgtaggtcggcaagtcacaatgacacttatccttgagtattcatcaactggtccctttcttcttacatgaatgatgtagtaattgcaaagaaggtggagcctcaggg

SEQ ID NO: 19250 - DNA, 1046 bp, Homo sapiens
tttgtttgtttttcctctgagagtcagttatcctgggaataaaatatgtttgtgagaggcagtctagtggcatgctttaggctgtgggctttatactgaactcagtttgagtgtcaactctactaattccagctgtatgagcctgggcatgttccttaagtacttggagtctaagcacttggctaatagtggtatctccttcatgatgttcttaaaaaattaaatgagataatgcatgtaaagtgcttagggccgtgccttaccaacattaagtggtcaataaatgttagttattagttgggaaataggaataatgtaatcctcttaaggatattttgaggattcattgagatgcttataaagcatttaggtcactacctgacccacagtgagcactactcaataagtgttcatcattgacatggttgtttttgtttttacatgttatttgtaaaatgtggataatgtaattaacttagtatcgttctgaagactaatagagataatgtgtgtgaagtattcagctctgtgcctgtcacagagtaagaaccaaattatgttaatctccttaaggacaagaactgtgcttttatgtcatttttttccccagcaccctggttcaatgcttgacacatagaaagtgtccaataaatattttataaataattgaatgaatagctgtgttattaattatattctcttctatccaaaatgaaataggaggtcttggaaaaaattcctgttcttctttagaatctgttgacccctggaaaatggagaataaaataaacctgagaacacaggatgttcccaaactctgagatcatcgtcataatcccctacattagaaaggtctttatggttcacaaagaactttcacatccattatgtcattcaacataaaaaaataaaacaggcgagaaatatccttagggtcagcctggacatggagctcagtctctcacgaatgatttaaaatccactctgtcttgttgcagatattgcttatagaaaacttcaggcacagaaatgctacccagcttgat

SEQ ID NO: 19251 - DNA, 1043 bp, Homo sapiens
tatgatatgttctatgacattctgagagtaccaggtatgctggaaaaaaaaaggtaaggatagaagggtgaaagttgagtattctctccataaacagctgtctggaagttccatacaatcctgctttcttctactggcctgaagatagttatgtggtcacatgtagctgaaagtgtaattttcagctgcagtttcccctcccctcctgaaataaaacttgattgatggtctgtagggattgagggaaagacaagagttaaggtataatttccaggcttccattctagtccattaggtggatggtggagccaaggatgagcattggttggagggagtggagggagtggaaaggacagtgagtttggagtgtttgttgaacatccaggtacagacgtccacagcagcaagttgtgtgtgcctgaagctcaggagcactatttgacatggcgatagggattgggaataattagtatgtagattataattaaagccaaaaaacagtgtgtaaacatgaggaggggtcttgtgatggagaaagtggacattttagagatggaagaagagaaataaggtcagatgtacaaggggtagcaagagaggtagaaaaaaaagaggtgttgctggtatggaaggcaatggaatattgcattttaagaaggaggggatggttaataatgtcctttggagttaataaccagtgagtcattggtaaccttggggtgcatctattccatagagtgtgttggtgggtcagggatggcttgattgcagtgtgatgaggaatcgaggagtttgggtcttctggatttagagacatcttgtatgggcaactcttctaagagtcttgggcatgatagtaaaaagaaagtgaatgtgatatccagggtgaagtgggagaatggattagtcatctccacttttctagttctatacactctctgcccctttggatgacttggataacaaaagattgtggtgtagactttggatctacatgtttagaagaggtgattttccataagccctgctgacatataacagat

SEQ ID NO: 19252 - DNA, 1031 bp, Homo sapiens
gatttttaaatgcttgttatcattatctctttgagaaaatgctcttctattcctagacttatcacaggttttttcatgcatgggtgttaagttttgtcaaatgctttttctgcacctattgagacgatcatgtggtttattttttcatgtgtaaaaatggctaattctatttcttgatttttgaatgataagacaacattgtatttctgggatagcacacacacagccataatgtattaccctatttaaatattgtcggacttgatttgctaatatttgttgaggagttattttttatgttcgtgaggaatattggtttgtactttttttttttgtaatgtctttttggctgtcagagtaatatcatagtaatgctggcctcaaaatgttgtgggaagtattcccttgttcattatttttctgagacagttttgcctggttggtttttttttattttattttttttacctaaatatttgcaaaaattcatcagtgaaactatctagacttggtatttcctttgtggaactattttaaattgtgagtttaatttctttcatataaaggggttttcagattttatatttcttcttgcatgagttttggtaatttgtgtccttcagggaatttgtctattttatctaagtcaccacatattggtataagctgttaatatagtctcttactatcttttaatgcctgtaagatctatagtgatacctcatttttttttaacaaaaatttcaactgttgttatagctttaaagggcacacatgcaggtttgttacatgtgtaaattgtgtgatgctgaggcttggagtcccagtgatctcgtcacctaggtagtaagcatagtacccaacaggtggttcttcagcttacgccccactcccttcttccctctcacatctagtgatcccaagcgtctgttgttcccatctttatgttcatgtgtattcaatgtctatctcccacttataagtgagaatatgtgctatttggttttctgttcttgtggtaggtcacttag

SEQ ID NO: 19253 - DNA, 1030 bp, Homo sapiens
tgaaataaaagtcattttataggttagatattaaaagatggaggctgtgttctgtgcagcagttgtggaaactagcaatgttcagcgcaaaaggtagtaagtgggttatctgtaattaaatgtttgaaaattatagcagacaagaagaaataaaaggtggtagttgacaaggcagcacttttggtttaaaatgaaaaactttggaacgagtagaattgtccaacagttagacaggctacctctcaaggagtttacagggaagcacttttggtttaaaatgaaaaacttgggaatgagtagaattgtcccaacagttagacaggctacctctcaaggaagtgagcctctccactagaggtactcagcagaagttagaggactagttagactgcaagcccctggagaacatggacagaatttgcccatcttcagtacttatttaattcaaattttgggaggaaattgattgagcaaacatttgtgcatctattagcatgtagatgctgtactgtattgaatgaaattgtgctagatatgagatactctctaaggtaactatttccaatctcagatttggttaaataaaagataagaattttgtcagtaagaacatgtttaaaaaatttaaaccctgttaacctcaaaggacatttatattttgcaaatatttctaaatagtaaactgctataaatagtgacataatctgctgtttcttttctcccccccttcttttatttttcagtacgtagaaaacaggaccaagagcagggagcatggcattgcaatgcgaaagaaactttttaatcctccagaggaatccgaaaaataaattgtattttcactcgatgccttggctgagagaagacctaaagactctgggttgatacctgaaagaatcctgtcttatttggtctccataatcctttgaatggaaagtgacctgtgagagattgaaccatggagaaatatgaaaaccctggattctgagtatttgttgggcagggcgtttagtactgtctcccctttacc

SEQ ID NO: 19254 - DNA, 1048 bp, Homo sapiens
atagctgggattgtaggcggccatcaccatgcccagctaattttttttgtatttttagtagagatggggttttaccgtcttggccaggttggtattgaactcctgacgtcgtgatccacctgccttggcctcccaaagtgctgggattacaggcgtgagccaccatgcctggtgaaaaaggttttaagaacagcattataatgttttaagtccagtcttatcttcctaaaatctaggacttcccattcccaggaaatggtccaaggagtctggattctattttcagtgatgataaatgtccacattttaggtagtgacattcacagtagatatgggttattttctttgtatttcacctctaatgataccagattaatgtggtaccaaaacagtatgatcagtcaccaaaatctggcttcttactcctcctggagatatagaaggaagtattagccccgcttctccttaaagtgaggcaatgtctgtgatttgctccaggctaatgacatgtgaactgaagtcaaatgagtgacttccagaaagaaccatctaagagccatgtttgccatcacactctgcatcacagttggctgtggtttccaacgacgcaggcagcctctgtcagttcatgttcaggagtgaggacaatgtggaacagagtcccagacatcatacaatgaacctgcagcatgagttagaaagaagcctgtgtttttttaaccactggaaaagagatagggctgcttgttactgcagcctatccttgcctgtcttgactaatgctaggtagtcgagactgacggacagtactcctcctaattcaagtgtacccactgcagccttcttcaaaaagagcctggcagcttgagtcctatctggggcaaaaaagacataaaccaaaaataagcagacacaaaatcagaattctatttttttataagtccatttctaacctcattttcattaaaataaagtagccacgttattaccttctttatcaaaacaatatgaagggccaggcacggtggcttacgtttataatcccagc

SEQ ID NO: 19255 - DNA, 1114 bp, Homo sapiens
cagtagttagtgttccatttgttaaagacatacctggtcttgtgtatttggatcatatatttaaggacttatttttattatttttttgagacagagtctccctctgtcgcccaggctggagtgcagtggcgtgatctcggtgcactgcaacctccccttctcgggttcaagcacttcttctgcctcagcttcccagtagctgggatcaagggcaactgccaccacgcccagctaatttttgtggttttggtagagatggggttccactatgttggccaggctggtctagagctcctagcctcaagtgatttgcttgccttcgcttcccaaagtactgggattacaggcatgagccaccgtgcccggcccttaaagatttaaatgtcattttctgatgcttattacaacctaagagttcttaatttattatggtggaatctattctagccataattattttcatttgttatatacaagtattttaattcttaaggctaaaatttaaagttctatgaacaaataatgtatggtttttgtaaagaatacaagattgaggcgctcagaaatttattttacgttttggatgaatttgactttttaaaaagttaatgtggaatataaggttgtcttttggttgcaggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttgggatgaaatacttaatg

SEQ ID NO: 19256 - DNA, 1099 bp, Homo sapiens
gataagattccaagaagatttcaagcgtcagaggccaggtgggggtggaagaggttgagaccaagagaggagggcggccagtggtagagcaatgacttgcgccaggctggagccaaccaaggcttggtttgggtggctgtcagctgcctggtgcgagcaggtctgggtgccctccagcctcaggaagtgctcgagagcccacaggccaggccaaaggcatccaagcctctctgaccccacatgaagacccctgacttcagaggccagcttcttcctagcaggttctgagcatatttctgatttcctaacaggtggcactcggagacacatgtgttgaggatgtagcattccaggctgccgtgtcagagaaaatccccacagctctgcaaggcgagggtggccccgagcagctcctccagctggccaaggctgtgtcctccatgctgaaccaagagcatgaaagccagggctcaggacagtcactgagcatagacgtcagacagaaggtacccgtgggaagctggggggctcctttcattcccttcctctggggccccagggtctgcgtgcggccatttgggctgtggatcaaggttcatggatcaggggagaaacctgtggtgtctcccaagcggctgacaccacctccctctctggtcttttgggtgagtgacataaagtgaagaaaatgccttcttccttggtaacctgctttctcggctggccctcatggaggcacaggcctctgggatggggggagtttagaacacatcatcccctgcttttcatgtttcagatgacaaggcagagccccagagcagaaaggggactgtcctcggtcacatgggtagcggtttggagttggaccacagatggcgtcccggctttgtcacttaccattcgcattgtcacaggccagggaccaaacctctctaagtctcagtttccccatatagaagaatactagtctcctcatacaattgtagtaagagttaaataagaattacgatcactgcaactaaaaaactagataagaccgtcaacattcaatcagttttaatctacaaaaatggccgttccattgttacaacctagtatg

SEQ ID NO: 19257 - DNA, 1051 bp, Homo sapiens
ccattaaacagggccagccttccacttctcccacctcctccactcaccaccaccaccaccaagagatgcatttaaaattattactgacgactagtgtttcttccatatggcttaaagatgggtgggggaagttcagggaaaatctgaaagtttattatttcttcccccactcaccggaatgtgtcagcagtatgcctgctttaaatatgagtaactaatactaagatttatgatcttaaatacactttaaattcaccctaagtataattcagtggggctttgccttactatttttttgactcagagcttacttctcttacaccattgtggtatcaagtattacagagagtcccttatcaattttgactagttctctagattatttgacttcagtttctctgccttcaggtaagtttgacatcagttcctttcacaagcgttttctagcctgaaggtcagcactggtgtatttttcagaaattgatgcttcagatgaatgctaagcacaaagcagaagaagttgaagatgaaacagtagagcttgatgtgtcagatgaagagatggctagaaggtaaccgtgctgcgcagcagccttctaatctggacctagcattcattggctctcccaggaatgctcctcttaccccacagtgcacggcagctttcaagggagtcccccagtaggacgatgactgtgatcggccttctcttaatggcctacgggggccacagacctgtctcaggctgccagttgagggcccatttccagagctgctggaaatgtgtattttaaaatgtacatctctatttatttagggtaatgcaaacaccaaaatggcaaggaatttaatcactcttagagaagttcataaattgttaaatcagatggtttcttttaatgatagttttctttttcgtaatcttttttattgcatatttggtctgatattcttgacaaggcttgatccctacctttttatttgaaattaaacgtgtgctgcctgtcctcttgacagatatgagaccttggtggggacaattgggaaaaag

SEQ ID NO: 19258 - DNA, 1075 bp, Homo sapiens
aaacaaattgccctttctctgctgtcacacttccagtggtcagggccctgccgactcgaagcccagctcaagtgaacagatgctgcatgggtgttgagccttgcctccaccccctggggtgtcagtacagttccttctccccaggagagcctctgggatgcagcaggagccatggccctccgttctcctctccctgttgcccctgagaccccgctctcaggcccttcttttctcagtgggtgtcacatggtctcactgtctctgaatgagctccattctgcccccatccatgaggagctgagtgtggcactcaggcagttggtgcaacctggtggacagtggtgctgaccacctggaaccctggggcactgggagtggagccctggtcaggtcatggctgtgtgtgcttatctggctgggctgggccactgagaatgcatgtcttatgagaataggggaatctggaacatgttggatttactttgacctaaactcgtgacttctgaactcccatttcccccacttttggggactaacttaaaaaaaattcctttagagatttcttcttaaaagctaaattccgggccacgtgtggtggctcacacctataatcccagcactttgggaggctgaggcaagaagatcacttgagcccaggagtttgagaccagccagacccatttctgcaaaaaataaaaaattagccgggcatgctgtcatgtgccttcagtctcagctacttgggaggctgaggcaggaggatcacttgagcccaggagctcaaggctgcagtgagctatgattgcgccactgcactgggtgacaagagcgtgactctgtctggaaaaaaaaaaaggaattcctaaacaggcttgttgacttcgcagactgcttttggcttctggatgccctcctccagtacacatcgtatggggtgacaccgcctagcctcagtcactctgggaaccgccagcgccctcccagtggagcaggctcagtcactccagagaggatggaaggtgagtggatgggcaggatgccttggggagggaattggatccagctgaacatgatg

SEQ ID NO: 19259 - DNA, 1367 bp, Homo sapiens
cagaacaattgcagatagaataagtgtgcttgcctccctgattgggttcctaccaccttgagctgttttatttacctctgtgtcccgacacctggcattgtgttgggtaatgggagtttacaagccttgttccttcactcttcatttggaaactatagaaaagggagagggtcctagtatttgtttcttttttcgttatttattttttaaggttaatttttgaataggtaatgcatagctcagaaatgtcagaaggtaacacagtgagacccccacccctgtccccgtccagcaggttctttcctcactggcccgtgtgtcctgtgtgatgatgttcctttcttatacctcctcgtagaatttctttggtgtatatgagaaaatataagtacctggtcttttaaaaacctttaaaaacataatcttaatcattacattgcttctcttcctaccataaacttaattttatattttttaaaaaagcaacagctaaaggtgatccacaaagtaatgaagcttttgtaaggaacataggagcacttgaacatcagaagactaatactgtgaaataactgttactgctgccatttgtccttcagtctgtttaggaatgaagaaggttagatagataagttgaactattccaaaatgcttaacttaatagaagtgccttgggataagtccttttgtaggagaggggcggttgggagcttgggtgttatctaggaaggcattctttgtgtagagagctgtgcatttcacctagagagataggccacctgcagaacacagctgcctcttccttaggttcagctccaaggacttagaacttctacgtgttgtattttactctccagagcattatgcatgctcaggattcatttctggttttaagtaaaaaaaaattaagagaactacttgtaattttaaaagagccttagaaataaaaactgtcctagcactttaaaacttgattgaaacactaagcagactgttataatatttaactaggtatcttacacatcttggtttttggacgccttcaactatgccattttaaagaagatcgacgtgttaaacctcagcatcggcggcccggacttcatggatcatccgtttgttgacaaggtttgtggagtcactgcacacggggtttgggtgacagctcctgctctttcgcagcccaactttgcatcatatctagtgtgttggtggcttttcatccaggtggtgacagctttgtgagaacagatggctaatgacgtgagcttcagtgatttgcatgtcataaattgagtgggttagaggcctcagagtaggtgttgataaggagcacatggtgccttgctgatttttttttttttttt

SEQ ID NO: 19260 - DNA, 1070 bp, Homo sapiens
ctttgggaagctgaggtgggtggatcacctaaggtcaggagttcgagaccaacctggccaatatggtgaaaccctgtctgtactaaaaatacaaaaattagctaggcttagtggtgtgtgcctgtagtcccagctacttgggaggctgaggcaggagaatcgcttgaaccctggaggcggaggttgcagtgagccaagatcacgctactgcactccagcctaggcgacagagcaaggctctgtttccaaaaaaaaaaaaagaaatatgctgctgtaagtggatgttaggactataaaaatactaagtatttacatgggaatttcaaagtaaaagattctagtactgcttgagggttacctctcagtgaaaaatataatccaaaaaaaccacaaaaccacaagatagggctatatttcatgcaaccattttatcaaataatatctctgtatagtcttagactaattttttcaagaagcatagaatttttattttaagcttattgtttaggcatgacaaaggattggtaccttttagtactgtagaaagtaactttcttagatatttgaaattgtgatcgtaagtattaatttgagaatgcataattatctattacaatatatttcagttcctttatctggtgtagtaaagagatgtgccctagtttagaatttttttttttttgagatggaattccgctcttgttgcccaggctggagtgtaatggtgcgatcttggctcactgcaacctccacctctcgggttcaagtgatgctcctgcctcagcctccggagtagctgggactacaggtgcctgccaccacgcccagcaaatttttgtgtttttagtagagatggagtttcaccatgttggtcaggctggtctcgaactcctgatctcaggtgatccacccgccttggcctcccaaagtgctgggatttacaagcgtgagctggcagggcgtggtggctcaagcctgtaatcccagcactttgggaggccaaggcgggcggatcacgaggtcaggagatcgagaccatcctggctaacaccgtgaaaccccgtctctat

SEQ ID NO: 19261 - DNA, 1019 bp, Homo sapiens
tccgtcatacccacttcccccctgctccatgcagtctgagctgtactttcttataccagacttccaactccaaatcatctcaggggaaagcagatttacatttgtggagttcaggcacagctgcatccaggtgttcaaataatgttcatagagctgtgtctctctttcctgtctcgtccacttgcctctccctgcacagttccctagacaggctgtctctaggtagcagcaagatggcttatgatctaaggaaagagccagtgtccttcctgcggcaccagaagtcccagaaaggactttggttggcttggcttgggtctcacacccatctgtgaaccagtcactgtggcaagggcaatggaatattgttggtggccaggtctgggtcacatgattgcttccggggcatgggaacaggatggggtggtctcccaaaggaagaaattctaggtaaataagaaatgtgtccactgcacttggcctccttgggatgggacctgtcctcccctgagtgccaccgagtgatcctcctgctgttctctggtccccaggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcgtatcctttcttgcgagacaggagattccagcgggctcgcctctggtagaggaggtgctcttggcatggtccagagaagggcaggaatttggggggcttgcagtgatcatagctcgtgcactgatccttagtgagaggcccagatttccaagaggtcgttctgaccccaggtgacaatccccaattccttgggaaacctggacgcatccagctccagggacctgtccgg

SEQ ID NO: 19262 - DNA, 1031 bp, Homo sapiens
accagggttggctggattcgaggagagcgtgtgacccaagctgagctggtgagatgctctcttggaaatgagactggggctgcagcacatgataccccttctctgggtgtgtcaacaggtgagagcatgtgtagagggggctctttctatcccttttggctgagactccacaacatcggggctgactggccccacattccacactcctgaagtggtggaaaggtatgatgcctggtgcctggtgtccagtttgacatagccaggggtgggctgtagaaagggcaagagtgtttgcaagtgggccactgctgaagctgggtagtggctacacaggtgttcactttatcatcctctctgcttttgtacaggcttgaaattttcctttaaaaaatgtaaaaacaaacatgaagaaactatgacaacccaaatgtccatcagtgaacaaatggatgagccaaatgtggtctatctatacagcagaatacactttagccaaagaaaggaacaaggcactggcacatgccaccatgtggatgagcctggaaaacatgctgctgagtggaagaagccagacatagaaggccactcagagcacgagtccattcataagggatgttcagaatggggaaatctacacaagaaagaaagatgagcgattgcttagggctgggatgtgggcataggtgggaatgtagagtgatagctaaagggcacagggtttctttttgaggcgataagaaaatgttctaggcagggggtggtggctcacgcctgtaatcccagcactttgggaggcccaggtgggcagatcacctgaggtcaggagtttgagaccaacctggacaacgtggtgaaaccccatctctactaaaaatacaaaaattagccaggtgtggtggcatgcacctgtaatcccaggtactcaggaggctgaggcaggagaattgcttgaacctgagaggcggaggttgcagtgaaccgagactgcgccactgcgctccagcctggtgacagagtgagactccatctca

SEQ ID NO: 19263 - DNA, 1072 bp, Homo sapiens
tgcttctatttttctattctcagtctgtcagagagaccagtaagtaccagaattttgacttcccagagcctaggagagtgtatggcatatgacaggtgtttattaatgtgtgttcgtgggaagaacaaattgtgtcgctttcattgtctttcaatacaatgaagatcagttcctctcctgggccccacttcatagaaatatgcattcctgacttcacaaatggaactgcccaagaatccccactcatgttttctccccggagcttcccctgcacccacattctctgcattggttaggaatatcctcataggcgcaacactcctgaatagcagaccttacacttgtaccccgacaggcctccttgttccctgaagctaaccctgggcctggctttggggtttgcagccggatttgtcatcttctgtctgccagtttcactgacttggttattccaaggaattcctgggacttccctttgttaaaaaataaacgttaggaatgagaagaggaactagctactgcctgtgtcttcactctgagtgactgagggaacttcattaaatctcagattcccctaacgatcctgagaatgaaggtgaacccacagtcctgtagaacattctctctgactgttgagcactccgctttgtaccaggtgttctcatcaagtgtgcaagccccttttatgctcatacgaccctcccaacagccctaggatgtgaagctgctattgtccgcatttgcagatgaggagactcaggctcagggaggttgagtccccagggaggctcaggccactggagatgcctgtggacaagggtgcctgtttgtatttggcctggacctgctcccagcatgctggggtttaaacctgggcagttgggagccattaaaaaatgaaaaggggtcaggtgtggtggctcatgcctgtgatcccagcactttgggaggccaagggggggagatcacttgaggccaggagttcgagaccagtctggccaacatgatgaaaccctgtctctaataaaaatacaaaaatgagccggccgtggtggtacgtgcctgtaatccc

SEQ ID NO: 19264 - DNA, 1087 bp, Homo sapiens
ggtctcaagctcttgggctgaagtgatcctcccacctttgcctcccaaagtgctgggattacaggggtgagccaccatacctggccaatacacacatcactttaaaaattcaaaaaatcaggctgggcgcggtggctcacgcctgtaatcccagcactttgggaggctgaggcgggtggaatacaaggtcaggagatcaagattcatcctggctaacacagtgaaaccccatctctactaaaaatacaaaaaattagccaggtgtggtggtgggcgcctgtagtcccagctactcgggaggctgaggcaggagaatggtgtgaaccctagaggccaagcttgcagtgagtcgagatcgcgccactgcacttcagcctgggcgacagagcgagactctgtctcaaaaaaaaaaaaaaaaattccagaatatcaaatgatattttgataatacagagcagtggagggtgggggaacttagcatagtggattgtgaaacaaattttaaagtcatgataataaaaacagtgtggcattgaaataaaacttaatgtggatcaatggaacaaaatagccctcaaagccattttaataaaaatgactatataagatagaacaagcataacacagccaatggaaatgtgttcagaattcattgttgacctaattgccctagtcataagtgaaatatcctcggagccatatcccgggccaaattaagagccattttctttgtttcctcttcatacccagcaccccccttgcccctcctgtctctctacagtgtagagtctcattccaaactgcaaagattgaggcaaaaagagttgatgaatttctggtctacaaagaggatgaatttctggtccctaaataagatccataatttgagcctttttaaatttttatttttaaattttttttggctgggccctggcactgctggcggcacccacatctgtgcaatgggcccacccagactttgagccttgattgtaggaaggctgtaggcgttgcagccagaaaggcctgggtttaaatcccagcatgaccttgaattccctcacaaccttgaaagtgccatgtgact

SEQ ID NO: 19265 - DNA, 1032 bp, Homo sapiens
gagtctcactctgtcgcccaggctggagtgcagtggcgcgatcttggcttactgcaacctccgcccccaggggttcatgccattctcctgcctcagccttccgagtagctgggactacaggtgcctgccaccatgcccggctaatttttttgtatttttagtagagacggggtttcaccgtgttagccaggatggtctcgatctcctgaccttatgatctgcccgcctcggcctcccgaagtgctgggatgattacaggcgtgagccactgcgcctggccgcctgttgagggactttcatagtcatctcgtctgtggccttttgtgcctggctctcaccaggcattgcgtcttcggggtccatcgtgctgtggcatgatcagtgcttcatttggtttaaggctgaataatattccatgctctggccggacccttctcacctatagccatcgttagttgatgggcatctgggcgagttctgcttttcggctgttacaaatcatgctgctctgaacggccgcgtgtaagtttttgtgtggatgggtgtttcattcctcttgggtatatacctaggagtggagttgctgggacatatggtgactctgtgtttaaccttttgtggaactgccaagtattctctaaagtgtccccactgggggaaaaaaaagaaaatggaaaaaaaatcttgtggggaagggaatgatgaaaaaaaaaaaacaaaccccaaaacatcgaagcatccacaccattttacattcccacctgcagtgtgtccacatcttcaacacattattgccattcttttgtgacgccgtatctcactgtctttgctgtgtatctccctaatgaccaacgatgttgagcatcatttcatgggcttgttggccatttgtgtgtcttctttggaagcatgtctgcttgagtcctctggtgacaagtgacagaaaccaccaggagtcactgtaaatgaaactgaggaagggggagtacgcagagccccagggcaaggatgcttctggctgctggcaggctg

SEQ ID NO: 19266 - DNA, 1033 bp, Homo sapiens
ttctactcttttgtccaattctgtttaagaatatttagaggccgggtgcgctgtctcacacctttaatcccagcactttgggaggccgaggcgggcggatcacgaggtcaggagatcgagaccattctggataacatggtgaaaccacgtctctactaaaaatacaaaagataattagctgggtgtggtggtgggcgcctgtagtcccagctactcaggaggctgaggcaggagaatggcgtgaacccgggaggtggagtttgcagtgagccgagactgcgccactgcactccagcctgggcgacagagcaagactccatctcaaaaaaaaaaaaaaaaaaaggaaaatttagaatctatagactgttgtattttcgttgtagaataaccaggaagttcttaaactgttcctctttttgtttcacagaaccaatctcttctcttattttgaagaatatgaattttacctatgccttgttgacattttcttctctgtgcattgtgcgtgttctggactcttacccttcatttctgttttgtgctctttcatgaatcgtgtttggatttaatttttttttttttttgagacagagtcttgctctgtcgcccaggctggagtgcagtggtgccatcttggcttactgcaacctccgcctcgtgggttcaagcagttctctgccacagcctcccgagtagctgggattacaagcgcccaccaccacgtccagctaatttttgtatttttagtagcgacggggtttcaccatcttggccaggctggtcttgaacttctgacctcatgatccacccgcctcagcctcccaaagtgctgggattacaggcgtgagccaccgcgcctggcctggactttctttttttataatggagctacgacaagcacttggaacctctgtgtccgtggcgggggtttccctgtggcccctgacttagggaggtctgacagtgaatctgaccttcttgttgggttttccctacatcgcagagtctttagacctttttcttgggtcatgtt

SEQ ID NO: 19267 - DNA, 1025 bp, Homo sapiens
cgcacatgttttctggacctgaagttgtgacttgcctacaggtggggtttttctcttcacccccgtctccctctttctctataacccttgtgcatttctcttctactccttttctgccaggctcctttgggcctctggcccactcccctggcagatcttatcacacgcccctgtcgtttgcctgtggacttcctttctactttttcttgtctccctcaagcaccctccttcccttacttattcactcaagaaatgtttgtggagtgcgtggtgaacccgggagtgctggggatactatgagtaacattccattgaggtgatggcagaacaagcagccagggagaggctgctaggaagggaggccagcaggctccagatggagtggggctttctaggccatggtggtggggtggagtggggggtggggtgggattttattcgcactgaaaaggcagtgattgcatgagcttagggaggggagtgacatgatctgatttacgtctgtggaagaccactctgggtgctgcatgggggactggactgttgggtgagcagaggcatgagagtagagagaggactggtcagcaggtgatctaagcactccccaggtgagagctcatgggaccttggtctgggcgggtgaggaggtgggagaagtggtcggatttggggtaggtttagaggtgcaccccataggacttgctgatcagctagatgtggagaggtggggaatgagatacatgaagggcggggcctttttttttgggtgtggtgtgccgttgattgagatgggaaagagtggggtcgtgactgagtgggggaggttctgctttgaccctcctgccctggagttgttaagtggccagttggatagacgcccttagggatgcatcgtcagcctgagagttttccagatatctttttttgtttaaacttcgtgaaactgaggttccccattagctcctttgtggagagcatgtagatgaagggaaggccgaggactaagcccgggtgctcccggcgtt

SEQ ID NO: 19268 - DNA, 1050 bp, Homo sapiens
taattttttgtatttttagtagagacagggtttcaccgttttagccgggatggtctcgatctcctgacctcgtgatccgccaaattttgatctcttaagagcacatttcctctctgaaacttatctgcatgggtgtttctgaacccaaactcaaaaggttgcgtgtttgaaggtttccatcccttcccaactcaccgccacgctgtgggagagctgctctgccgtcaggctgaggctgtagtgccgggcctccagtcgtctacattgtgtctgtaacacctgccgctccagattttgctctgaaaagacaggagatggtgatgtattttccgtatgcaggagcccgaaggcccgctttgtgctctcctcttcacaccctgcccagcagagcccaaaacctctctccagtgcagccagcgaaggcctctcctgtggaccacaatgctcccagccctttgaattgtaccgataaatacataaacgtcactaaattaagcccaatacacaggaataaagacaaaggatccaggacctaaaggcaatttgatacagattaggaagaaatttgatggccttaaaatgcagctttcaaaaaaaaaaaaataggctttcagtttaggctgctggaaaaaggccagagtacacctaaagcacagatttaattaataaaataaagcctctgctctaccaaaagataccaggcctagtttcaacaggagagtgacttcacatctttcaggacaaatccctaccttatacacagtgtttcagcaaatgaaaaacagggaaagtgctcacaatctggataccaaagtacaataaaactagagtctaatactaacgaacatacattaaaaatcctaaaagtactaacaaattcaacaaggatggagcaacatcaagaaaaaaaaaatcaaaggatgaaaaactccggaaatgggaaccttcactctttaatgggatgctttaaagtttcacagacaagggccccaccagtgcctctctttggcagcactggagtgacaagacaatcagacaaattcaaaagga

SEQ ID NO: 19269 - DNA, 1048 bp, Homo sapiens
aggcctccaccccccagaccagtgactggcagccctggcctctggtgagggcccttgggagcaagagaggccttcttgatctaaacactgcctccataggcagtaactaggacaaggaggaagactcgcccgttgctttgccttggtgtgatgagcccagtttctgaccgttcctgtgcttgtcacagtaagttcaaaaaggaggggttcagctcagaccttgtggcttttacaaagctttgcgtttaaacaaagcctctgaagttcctattctgtacctgctctcagacaccttagaattatatcaatcacagaaatcattgacttcctgaaaggtttttaaaagcccccgcccatgtgtgcacatgactgtcacacatgggttctacagactaccccctcctcccttgatagcaatgggtaatatttgctattagcttgtccagatgctgggggcaggcagggggagtggaggaggtaagcagtagcgcatggctttctacggcagcttctggtgcaactcaaactaaaaatgaagtgatcgcataggcgccagtggtaagctcttttacttttcttcttctttaatttttaaaaacacttcaatattttaatgtcctgaccagcagcagtacaaacactaaaagcaaggttttttttttttttttgcccaaaaaaaaccaaaacaacaaacaaaacccccaaacaggaaaaacaaacaaaaatcccccaaaccacatattaaaaatggcaggctttttataacaatagttaaagtaataaaaacatacaaaactttgttttttttttaatatatatacacagtacaaggctgaagcacctttgacttttctctcaaaatttacgtctgtatgaaaacccaacccactgtagtaacaatctggtgggtgtgaagctgtgtatacacagagctctgtacatgctccccacggagtaataaaaagctaccttcagtttgtgaattggttttatctttaggtaagaaagagcttttccagggaaaagcctttgggttgctttgtgtgct

SEQ ID NO: 19270 - DNA, 1031 bp, Homo sapiens
tagtcccaattcagtgctttattcctttaagattagaatgtagactaaaatgtggaaagtcccgtcttggtcacttatctgagacaacagattaggaacatgatattttatcatgtcagtctgactctgactatatgaagcaaaaataacttgtttcagtgaggaaccagataatttactattggaaggtatccctctgcagagggacagatggcagctcccttccaggtaatgtaggaagatggtctaaggaccgagccgagggctttcaggtgcatcctgacacacaggtggcataatcgactccagagcagatttgaggtactcagtgtgaagtagctgaacaaaaaacttaagagattgcatgtcaatttttaagcccaattgaaaacagatttaggtgctactgtgttctttgagaataatctgaaagtaagttttcaaagtatgaaactaatagttggatggggaaaccatgactgggtactgtgtcttgggtggtgtgctttcgtttttgagacagttcttacctttttcttagtttattcgtgttgccttactggtttgtattctgattgtcgtattacttcttgagcaagagtagagtactcagatcgccacaagtaggtggaaggatggggagacagtgggcaagaagctcaagggccgggcagaagtggggtttccactgacaggggagaagccaactattgctagcacagtgacactgctcccaccctgggcagacctctcatggtgtgccacctgtcccctgtgctgtcatagaaaatccaaccaagggagtgccccttggatggtaagggatgagctacgtttttaagttatcggatctacttttcccttttactttagccaaggccatttccaaaagcatccagacatctgtgatggaggaggaggcctgagagcggaagtgctaagatgtgactcttaagccttcagaccagaaacctcaagtaggttttcagtggagaaatccagtgagattttgccctgatagtttgtagcag

SEQ ID NO: 19271 - DNA, 1049 bp, Homo sapiens
ccagggcctcagaatgtgaccttcttgggagtagtgtctttgcaggtgtaatgagttaagatgaggtcattttagtagtgtgagctcctagtccaatatgacgggtgtccttatcaaaaggggaaatctgggctgggcgctgtggctcatgcctctgatcccagcactttgggaggccaaggtgggcagatcacctgaggtcaggagtttgagaccagcctggccaacatggtgagaccctgtctctactaaaaatacaaaaattagctgggcatggtggcgcatgcctgtaatcccaactacttgggaggctgagacaggagattttgtttgaacccgagaggcagaggttgcagtgagctgagattgtgccactgcactgcagcctgggtgacagagtgagatccgtctcaaaaaaaaagcaggggggagtctggacagagacaagacgcagggagaatacaatgtgaaggcaagaggtagagatggggtgaggcttctacgagcctaggaacgccagattgtcagcaaccaccagaagccaggggaggggcttggaacagtctcccttgcagcctccagaggaaccagccttgccaacacctggatctggaacttctggcctccagatctataagacaatgaatgtccattgttccagccgcctggttgacggtgctttgttgtggcaaccccaggagacgaaggcactggggctcctctggaggctgattgattgctcactttggagctcaggctgcaggctgctgtctctccgggcatgacccggagcccccctccatcaatcacgcctttggacacccagtgtaaccacagcccccggcaaacaaagactctcctatcaggcaagatattccaagggcttagagagcacctctcagaaaccgcggacagagaccagacctctttttaggcaagattaaattatttactgcacaaagggcccagagaggaggtgcagtgcacgcagggtcacacagctggtggcctgattccaaagccagtgtgcctactgctttcagtttttc

SEQ ID NO: 19272 - DNA, 1032 bp, Homo sapiens
tcagccctggatacgattactctcactccctggggcctcaacactacacgctgcccagggcaccaggaggagggacccgccaggacccaggccctctgcccctctgctctagccccgcagcctggcccagggactcagacccacccacctgtttccaggtgaccctcctgtaccatgcccccagctccaggcctccctgggttcaaatcccagctctgccccttaacgatttggccttggagcagggccagcttcacaggcatgtgacctctgcagctgcacagggccccatgctcagtttaatgctcttaatacatattgaacaatgggcctcacatgttcgttttccactgagccccacaaattacacagtggttcctgccttagggcaagtgaccttgtctctctaggcctcagcttcctctggggtaaactgaggcatcctgcatccagcccacaggttttattgagtgctgggttctggagaggacttgaagaatcataaagacaggactctgctcaaggacatactatctagagccacaccatccagtagaaatagattttgacgtttctagcagtcccatgaataaggtacaaagaaacgggtacgattacttttaatatgttttatttaattcagtatattccaaacatcattttaatgagtggggtccagttcactggtctgggaggttcagtcagctgatctgggggggttcagttgtctaggggatttaggtttgtggtttgggggattttgttgtctggtcttggggggttgtctcgtatgggggagttggttagttggctgatctatggggtttaagttgtctggtctgggagttacttggctgggctggaggctttacttggctggtcttgggggcttggttggctggtctaagagggtttacctgtcttgtatgggggttaattggctaatctgggggttcagttggctggactggggttacttggctggtcttgggggtttagttggctggtctgggggtttagttgtgtggtctg

SEQ ID NO: 19273 - DNA, 1033 bp, Homo sapiens
agaccctgcgttttctgttttaatcccctgaccaactctccaaccaaatactgtcagccccattttaaagatgaggaaacagggccaggcacagtggctcacgcctgtggctgcaatactttgggatgccaaagcaggaggagtgcttgaggccaggagttcgagaccagcctgggcaacacagtgagtccccccagctactaaaaattttttaatgagctgggtgtggtgcatacctgtagtcccagctacttaggaggctgagacgggaggtttccttgagcccaagaagttgaggctacagtgagctatgatcacgccactgcattccagcctgggcaacagagggagaccctgtctcttaaaaaaataataataaattaaaaaataaaaatgaggaaacagaagcttgtaaaggcaaagtcactgacacaaggttacatggctggaaaatggcaaggccaggcctggaaccctgagccgtggtactgaattgctcttacctgcagtggaagccaggctaggcctctgggcctgctaagtataatcccccatcattaaaaagattagtaagtgatgatggggcccaggcacagtggctcacacctgtgatcccagtgctttgggagggtgaggcacgagcatcacctgaggccaggagtttgagaccaacctgagcaacatagtgagactcctttctctaaaaaaaaataaaataaaaaaaaaaaaaaaaaaaaaatcaaagcctcccaatcatctgaatggaccactccccttggctaagggcattccagagttaacctgcaaagctagttcaggccatgatgagaagtggggtcagacatgcctcattatactctcttgccttttgaaattgagaccccgcagaccagcattaacatcagtgcagaccttcagactaataggacagtccctttaagtctgataagaaacatgtacaatctgttctctctcaagccaaactccttatcgtaacccagacattcctttctatggattccaggtctttaga

SEQ ID NO: 19274 - DNA, 1029 bp, Homo sapiens
tccacctccccctcccccgctgtgcccagttgtttgaggaggacacctcaggtaggtaatgccgtgctatccctgggctctatcggggtcattttatttcatcctcacagcaatgcacaagtgaagaaaccagccggagaaggtggcttctcagaggccacacagcttgggagctcaggagctaggatcatgccaacttctgacttaagtatggttttgcttctgcctggaaaaccttcccctctcttcagccagacctagctgaaaatttgctcttcttattctagaaatattgcctcattcacagtgtcttgcagcatgatttggagccaagtagacctggattcaaattctaggtgacttactgattaacctccttgggcctctgtggccctgtctgtaaaatggagctgagctcatgcctcagagagtagtcatgaggacagaatgaaattgcgcagtgtgtttgtccttgtgcttggtttacagtagtggctggtgctgttactagtgctgtgatgactttttctattactgttctaacgtagtgtttataacttttatgaatttcctaaactttaggtcattccatcaagttttattatatgattcattgttggccagtgttttgcttcatagttagcatttgatatgagtaggtttcggtgcccggcagagagccctggcctgaggcagacactcaggaggaagcttttagatacacattgtaagatggcacctacacgctggcccgacatggtgctgttgagggtgagcagagtggtctgccttcagggtgcctgcagtttcagttggcagctggctcttcctaggaacaaggagttcctgactagcaggaaccacagcgtggcagtcttcattcaggatcaagtggatcagtattggagattcagtgcctaagacagagaaatgcaaagttggcagctgtttcaaatactttgacagttcattaactacacattttttttttggcggggcggtggcagagcagacagagtctcactctgt

SEQ ID NO: 19275 - DNA, 1047 bp, Homo sapiens
ttaagcatttctaaagccccagttctttatagtataagagaaggtaggtgaaggtcatcttccctctgactctctgcagcactgtaccaatccagtacctgtagacaaagggtcttctcgctgggactgaggaagatagtcattccttatgttcaaagtcctgcccttcctgaccattttttcctgagtcctaccctttcttctggggtgtagggtatgaggattaagattctgtcatgtcttgtcccagcatgtggcagtgagatctgtggtttttacgacttgatatttaagggagagtcattcatcttttcccaatttttgttcctctttcagattgattcatggtgcaaagatcatagctacgtgattgctggttattatcaagctaatgagcgagtaaaggatgccaggtacgtggatgcagaaccctctgtgggcgaggaagtgagcacgtgttgggcagaccccgtctctcgtgtgcttttcggccagatacgaaacctgtgagacctacaccccttccctctgtgcttatttgtagtatttgaggcgaactgtggtgtggataattccaaacaacagaaattccaaacatttctattaactttggaattctgttttgtgtcttctttattttgcatgaagggaattcatacaatgaaagcgacagttggcttccgacttctgtccctgctcagctctgccttgcttccccttcccagactaggggtggtgttgggcagagcactgggaaggaatgttgctctatttgccggtaaatagaccagcctgtaggtttggggtcagtactctgatgaaaatgtggtatttgctgccccctttatactggctccttctttcttttcctttatccagatccttccccaactggggctctcgctaataacaaagctgagaatttttctatatgtctgcgtcatcttggtcccaacagaaaaacagatgacacactcaggtggtgataatctgaggagggcttaataagcaggctgttgacaaggcctgggccgtagataacgcaca

SEQ ID NO: 19276 - DNA, 1046 bp, Homo sapiens
tctctgggggcgatcgcctcacccacagacccgtgaaactcagggtgacttggccacatccaaaccacaagatgcatagccgctgctgccccatctcccagtcaccgtaccctgaaaacccaggactccctgaacccctagctacaccaaggatctctgccaggctggagatggtaccagagacctgggcctgaagctggaacgtggtcctgaacctctgggcagttcgtccagctccattgatcttctgatccttggagacagtcgtgcgatgtctctccctgtgacagccgtgtgtcaggtagtctgtagtgggctgagagccatttggctgcctcagctctgtgccgtagcaaaccgaaaatggctgaagccctggacccgctagtgtcgagcagccctggccactgaccagtgcctgcccttgtcgggagtgaaatgcagagtcccagccagctcccagggctgagtggtgtcctatgagtcactgacaacagaagaacggaacttcctgttgagacccgtggtcacctgctggacccgagtgagcacctggacagcagcagcaggtgaagcctctgtggggagacccgggtctgccactgccgccgccaccctggaagctctgttctgcccaagctgcacctggaccgtggagacccaccacaccattgtagtgtttccctagagctggcctgagctgggggcaggaatgatatatgttaagaataccttggagacagagaggaatggtaggacatggctacagactccagaacctcaactgtgccgaaggcaaggccagcctgagtgggagactgagggctcaggagaagccactcgggcacccacaagcctgtggtccccgtcaccagacccacaaaccagagggccttttggcctttgcccagtggaaggactgtcagtcacacacatcttctcacccgtcctgtgctcctcaccatcagcacatggctcctgattaccacggggttggcgaggacaccatagaccaaggcccgtgcatctgactttcctgggtcaac

SEQ ID NO: 19277 - DNA, 1048 bp, Homo sapiens
gggttcttatgtccacacagcagtggcctgcgggacatggccactcacggctccgggagctatgcggccgcagctcccactagccagtgtcctaaaatagacgctcacaggccctggttggttccaaagtgtagggtccagaaggtatttgtgtataaaagaaaccctctcatgcctgtgtgcgcttgatttatttgctctaattcatgatccttcactttctgaaaggcaggcgctggatgagattcctgggggctgacacattcccctccccgacctcggacggctggggcaggatcccttttgtgctccaagttgccgggaagacaggccttggccactttcctctcgcattccctggctttggtgttaaataagatgaaaaagcactaatttgtaacacatccctgtgggctgttgtcgcatttgctcgctgatctgcccaaatcagacattagcggcgcacgcagggtcttcttgggagctgctcctggcctcccatataattctgaatatactcaaagacggttcactgactgcgctctcctgcatttattcttccagctgaaattttcctgacttttttccctctcattttattaggttaataaaacttggttttcgagcatttggctgccccaggagggccatcggccccatgtccaattcatcaggcgctaatgagtggcctcgcaggccccggccctccagccccgaagctctccgtggctcgtaaaggggaggcccacgggctgtgctgtatattttgtctgttggtttcccaaattctctcgccagctcgaccgtcactttttgggatttatttgaggccgacagcaccgtcagggagctcctccgcagccggaccctcctccctggcccgggctccacacaccccacacactcagagccgtaaaataaagtctgcaataaaacgaaatagaaatgtgtcgatgctgcattttagaacattccagcaaaaggctctgggaaatgccttcgtttacattaaagagggaagctccgtgggagcaggggtaacacagtc

SEQ ID NO: 19278 - DNA, 1100 bp, Homo sapiens
cgagactctgtctcaaaaaacaaacaaacaaaaaaaccccaaaaaacaaaaaaaccgacaaatacaatttacatatatttatggtggaaaacatgttttgaaatttgtgtacatggcgaaatggctaaatcaagctaagtaacatatattacctcacatactcatttttttttttttttggtgagaacacaatctactcttgtagcaattttcatgtatatgatacattgttgttaactatagttaccatgttacttacaatagctctcttgaacttattctttctctcttttttttttttctttttgagacagagtctcactctgtcgcccaggctggagtgcagtggcgcgatctcggctcactgcaagctccacctcccaggttcacgccattcttctgcctcagcctcccgagtagctgggactacaggcgcctgccaccatgccgggctaattttttgtatttttagtagagatggggtttcaccgtggtctcgatctcctgactttgtgatctgcctgcctcggcctcccaaagtgctgggattacaggcgtgagccaccgcgcccgaccttgaacttattctttctatgtaactgaaattttgtatctttgaccaagattttcccaatctctttcccccaaccccagcccctggtaaccaccattccactctgtacttctatgagttcaactttttcagattccacagataagcgagatcatgcagaacttgtctttctatgcaatattatgtttatattttacttaacgtaatgacctccaggtttattgatgttgttgcaaatgatagcctgaatagtattctattgtgtatatacaaccctactttttctttgtctatccatccatgatgagcacttaggttgatcctgtatcttggctattatgaatagtgttgcaatagacatgagattgcggatgtctcttcaacatgccaatttcatttcttttggatgtattccctgtggtaggattcctggatcatatgatggttctatttttaattgtttgaggaatgtccacactgttttccgtagtggctatactaatttacattcccaccaacagtgtat

SEQ ID NO: 19279 - DNA, 1048 bp, Homo sapiens
ctcctcctgctgtaacctcctcctcatcctgttgcccgaaccatgtgcctcgttgaacccgcagctgagaggtgggaccaccctgtctttccgctggagaagctgcagggtcacagtgccaagggtgggctttagggagggtgaggaactgaggcaagagtgtaatttgcaataattcacatacatgtgattgcatgtacattcttttttgaaaaatgcaaatggtagtgtagtgaactcacggtgctgcatcttcctcactttacagcctgtctcagagtttattccgtgtcagtccggacagctctgttccattattcccaaggctgcctataccctgttgcccgatgtctgtcatttattgtctcttactgaaaggtattcgggctgtccattcactcctgacaatggtgcaacaaatatttctgtgcataggacactttgcagatgtgaaagtatcctcatgggacacattcctgcaagtggaattgccgcatcaaaggctgtctattttagaacctgataaactttgttaagatgccagcagagccctcttcatagctgagagcactgcggcacagggatgctaagtgtcatgcccaagggccccagctggagaccaccagaccaggacagagccaggtctcccaataccaacctgtgtgctccgccagggcacaggtgcagatggtgggtagggaggccaggtgagccacggaggtcccgtgtctcccaacagtgggcatgttgtagagggtagaccacagtcccatatctggagtggttgggtgtgcttgtgggtgggaacagctctccagggcctgccctgatactaagacccagccaggggatcttctgggggatggctccatcagggagtcattggggacaggcatggctccatccccttctgaatcttctcctcccatcctctctgttagagtcaaaagacggttcaatttcctatcccccaaaccgccaagatgtgcccctgcctatgccaccgctttgggggccgcctcccgatgcctagggaccaggcagtgat

SEQ ID NO: 19280 - DNA, 1031 bp, Homo sapiens
aagtaaatccgtttttgaaggcttgttgtgtgttttgtgatttctttgggaatatgagttggacggaggcgagagccttaagccatgcgagctgtcggcctgggaacccagacttcccagcttcttgaggaagtgtcagatttcccgcgttgacagaagggagcattgaagggatgccttggagcccagacagtggttgtccctgtgtccttccctttgacctggcatcagaggtgtctcgagtccctacccagggacccagaggagttcgggccccagtagattttcttagatttaagccaaagtgagttgcattatctgcaacgaggacagatatgggagggaatgtgctgagagccaggcagatgaactgaggatctcattgatctttcttttgtgtttactaaactcatatgttcttgtaaacagttctttagcatagacagtgaaagtaccccctgttctcatcccagcctccccgtgagtcactgctgctaattaatgctgttagcttggaattgtagaaacaggatgttttccatggtaatgcactcaaagtacaccctcgattggcagaaattggcaagtgtgattttccaagtgttggcagtgatgcaggggaacaggaacgcaggtggggcagctgttttggggacagctggtactagctcatggcactaaggacacgggcccagggactggcatctgcatcctgaggtgtccaccctcgggcaacgcgagagcccaggcatgggccacgcagggatgttcattgctacactgtgacaactgtcacaggccggaaggaggcaggtggactacggtggagccacccatgctgtcacctggcagacgggcacacagccttgttccgttgcaaaacaagtgagagatggtattggtgtaacatgtaaaaatgcaaatacttaatttttatcaattcatgtgtggggaaaagctgaagatacgcgtgggaatggtgtggtcacttctaggggtgtcggagggtagaacttcaactgttttgcttt

SEQ ID NO: 19281 - DNA, 1032 bp, Homo sapiens
acagcggtaacattgaaatctttgttcattacattcagttacttttgtttctatctgttatttaaagagcctttcctcaagttcagccactcaggttttaattttgatgaggtccaatttgtgaaactttttgttttcttttatggttattttctgaatcctaaaaaagtcctaaaaattgagtcctaaaatactcagtttgcaaagataggctccattttttttttttttaatagaagtttggtagcatcacatcaggttctgcatttgtgtggaggcctgtgccccatcttgaatgatcttgtgtgtggcataaggcggggtcgtggttccttcttctccatatgaaaacccaactgacggagcaccttgctgaaaaccttcctttcctgaggggcaggtgtgggcacctccgctgcaatcaggcagctgggtccacatgagggtttctgggctcctggctctgttggtgcccgtgtgaggcctgaggcttgcacgccgtgtcatgacgggagcttatactgggcaagtcctgagagcagcctggtcctcccgtttgctcttcgttttcctgatggcctgtctgtcccagttctttgcttttccgtaggaatttcagacttggcgagtccagtctgtgtagtgcctggtgggcttgtggttggcgtgaggtcggatctgtagatcaatctggagagaagtgctcttggaatgaggccaagatgggtcccagaccccacacgtggcatctctgtgtacccaggcatttttacttcctttcagcggtggttagtggttttcagaatagatcttaaacgtattttgtaacatttattcccaagtcttatgtttttttgaggattttgtacatagaatttttttaaattttatttttatattttgtgctgctaggacataaaaatccaggtggcttctgtgttgaccatgtggtcctgccaggtgctcagtgcagctcctgcagtgatttctgtttcttgtcggagtttggagcagtgatgtatgaaagcgatt

SEQ ID NO: 19282 - DNA, 1059 bp, Homo sapiens
tagtaaagacaggggtccctgactcccctggtcataaggacaaagtaattgataaataaatgtttaaactctggccatgcacagtggctcacgcctgtaatcccagcactttgggaggccagatcacttgtggtcaggagttggagaccagcctggccaacatggtgaattaaaaccccatctctactaaaaatacaaaaattggcccagcatggtgttgtgtgcctgtaggcccagctactcaggagggtgaggcaggagaatcgcttgaacctgggaggcggaggttgcagtgacccgagattgcaccagtgcacttcagcctgggcaacagagcgagactccatccatccatccatcaatcaatcaataaatgtatgtatgtatgttttacctgtagccactatactacagcctgggcaacagagcgagactccatctctaaataaatgaatgaatggtatgttttaactatagccactacactacagcctgggcaacatagtgggacatgagactccatttctaaataaataaatgtatgtatgtatgtatgttttacctgtagccactacattacagcctgggcaacatagtgagaccctatctctaaaaaaaaaaagataactcagtaatgactgcacattgaaaagataataattagttatgctgagttaaataaaatattaccatgaattttacctgtttaattgtaccctttttgatgtggctactagaaaatgtgaatgctatttgtggctcacgttgtgtttccatcagggcagccccggcctagatctggaatcagcagcttcctgggctctgtgggagatcttcaagtgactcactcttctcattcctgttttcttctccaaagaactaaaatgcgtctcctcgctgggtgtatttattaggggacccactctgggcactcctcactggagcctactggatttaggatgtagtttcccaggtcctcccgctaagggggacccgtagaccacaactgagaggagacacaggccttctaggagccttgaggttcagaagtggaggcag

SEQ ID NO: 19283 - DNA, 1021 bp, Homo sapiens
ttctttgtaaagcaaataatttttcgaatgctctttgaaagcgcgtggaaatcttcatgataggccgtgaggtccccagaaggactgctgttgggtctaaaacggccatgatgatttcagacagcctctggttctagaaggtgcttagccagtgtggacagggcctccctggactgccgtgtcctgattcgagcccagagaggcacgtgtgagggattcagtgctgccccctggcttaacactggggccctcaggctgtggcgcatcggcattccggaccctctggggtggggctcgctgtcccctctgcccctccctgccggcgcggctgtgggtgtggggggctgtcacccctcagccatgctgcatcttccgttccctcctgttttatctccgctatttttttgtctcctttagtcaaatcccagtggatgtctgatgtagttgtaatagggttcttcttgctgtctgttttggaaacgggggactgggaaggtgggtcccaactctgacaactcatggtgccaccttgccaaagtcacttgatctctgcagacttccagttgcttctaagggttgcactagatctgtgattctcagacctgcctgtaacatcacgttcacctggagagtttttagaaacacgcctgctgactcagcaggcctgcaggcaaggtgggttgacaggcgctctgccatgcgggcccgggtgggcctgtgcctcccttcataaagctggctgcatctccagaggcacggggcactcaccagcgctcacctgccctcacccagtgaaaggacgcatgttagagcagcccgcctgacgtgtgcagagcctgactcccagaggaagctcccaaagaaaaagatggtgaacttttcctgagtcatttcaccccggtcagatttgataaacttgtaaaattaggtcccattttgcaggggcaggaagggagtagaaacggtcaggatgggtggcctagatttccagcaccagaatcttgcccagtggctctggaca

SEQ ID NO: 19284 - DNA, 1132 bp, Homo sapiens
gccatgatggacgtgctgcccgcgtccgcaccccaccagcctgtgcaggtcctctctgggctttcggagagcagctccatgtcacccacagtctcctttggtccccggaccaaagtcgtgcatgcatccacgctggacagggtgctgaagacagcacagcaaccggccctggtcgtggagaccagcacggccgccacggggacgcccagcacagtcctccacgccgcccgtccgcccatcaaactgctgctgtcgtcatctgttcctgctgattctgccatttctgggcaaacttcctgtcctaataatgtgcaaataagtgtgccccctgcaataataaacccccggactgctctgtacacagccaacaccaaagttgccttttctgcaatgagcagtatgccagtgggccccctgcagggtggcttctgtgcaaacagcaacactgcctctcccagcagccacccctccacgtcctttgccaacatggccacgttgcccagctgcccagcccccagctccagcccggcgctgtcctccgtccctgaaagcagtttctatagcagcagtggcggtggcggctccacaggaaacattcctgcctcgaatccgaaccaccaccaccaccaccaccatcagcagcccccggcacccccgcagcccgccccacccccgccaggctgcattgtgtgcacgtcctgtggctgcagcggcagctgcggctcgagtggcctgactgtcagctacgccaactacttccagcacccgttctccggtccgtccgtgttcaccttccccttcttgcccttcagtcccatgtgcagcagcggctacgtcagcgcccagcagtacggcggcggctccaccttccccgtcgtgcacgccccttacagcagcagcgggaccccagaccctgtcctgagtgggcagtccacgtttgccgtgccacccatgcagaacttcatggcagggacagcaggggtgtaccagacccaaggactggtgggcagtagcaatggttccagtcacaaaaagagcgggaacctatcttgttacaactgcggggccactggtcaccgcgcccaggactgcaaacagccgtccatggacttcaaccggccaggtaagcgcg

SEQ ID NO: 19285 - DNA, 1050 bp, Homo sapiens
tttgttttttctgtgaaagtttttgagccttactgaagaagatctgaataaatttgagtctcttaccatgggggcaaagaagaagctcaagacccagctggagctggaaaagtgagtgtgaagtgggttttgaaacctgtgtttatttccatttctcgtgtgccgaatggagtgctgaggcttccagtgctaaatactagtgattggattagttcctgttgcttatccagtccttagccatgcttttatttatttttatttatttattttttgagacggattatttttatttatttattttttgagacggagtctcgctctgtcgtgcccaggctggagtgcagtggtgcaatctcggctcactgcaacctctgcctctcaggttcaagcgattctcctgcctcagtctcccaagtacctgggattacaggcacccgccaccacgcctggctaattttttgtatttttagaagagaccgggttttaccatattggccaagctgatctcaaactctggacctcaggcgatctgcccgcctgggcctcccaaagtgctgggattacaggcctgagccaccgcgcctggcctagtcatgcttttaaagttctacaaatgtgtcttaggtttgacaggaaaggacctttatagtaaatttgaccaatcagaatgagttccttgccttaatgctctggggggaatttccctgtggtgtggagtagacccatctcgaagtcgccctgtatcaaagccgccctgtggtgtggagtagacccgtcttgaagccgcatgtgaggcagcaccagtaggcagtgctcacttgttcctgtgcttgattatttcacagggagaagtcagagagacggtgcctgaacccctcggccccgccgctggtcaccagcagtggtgtggctcgagtgccccccaccagccacgtcgggcccgtgcagtcggggcggggcagccatgcagcaggtgaacaagggtgtgtcgggcagatgggttactcatacacagagagggcccgtgtgtcgggcagatgggttactcat

SEQ ID NO: 19286 - DNA, 1029 bp, Homo sapiens
gtacgtctgggtggttcctgtgcccgtttccacaccagccgatcccctcagttctgcccaggctgctgtggagcctgtccatgtactcaagtcctcatttctgctgccaggggtttcttttgtgtttttgcccctaggttttccatttgacgtgttcatgaagtttccatctctctgctgaaacgtgttcatgaaagttcccgcttgtttgtgcatattgtcgttttcactaggtcctttagtacatccatcatagctgtttaaagtccctgtcactaggtcccacatctgagttatttctgaatctggttctaatgattgctttatctcttgacaatagttttttccccctttattccttttttttttggtatgtcttgcaaatgttgactgaatgtcagacatgtttagatgaccgtggagccggaggagagcgagatttatgcctggaaagggtcaacacctcttctgccagggcccttagtggggtcctggaggccatctgggcaggatgaagctggcactgggctctcttgctgcctctgttaccctcagggcctctccagtgaaggcagctgctgcctgagtctggagggtcttctccgccgttttgcttcactcccagctttcagccgtccctgcaggcctgtggcacacagcagggcactctctaccctctcggccccttttcgggggtagaccgctgctgcttgtttgcgacctggtgctgggcttgtgggggcaagggccttcactcttgcagcccagcctgatcctgggcaggcctgtgtgcctgggcttcggggtggcacttcctcagtgccttgccctccccggcaggagctgacctcctccagcaccagagcgcttttgcttttccccttcttccaggagcagcgggtcttcttgtgactggtggcagaggaagggaagtattgtccctgccccactcctaaaaaccgggcctttggtttgggctctggggccaggagcaatttttgtccctcctgcaacgtcttaagggctttt

SEQ ID NO: 19287 - DNA, 1055 bp, Homo sapiens
cgaggtaatggaagtcagaaggacagaatagcaaatgttaggatcagaagcagctggagctttcatccgcagctgatgggaggattaaatggtacaaccattaagaaaacaatttggcatttcttatgaagtgataaatgtatcttatattcctgcagttctcgtcctagggaatttatcccaaagaaatgaaagcgtacatccacaacagcacttggagatgaaggcttatagcagcttatgcataatagccccaaactggaaacaacccagatgtccatgagtaggagaatggataaacaagctgtggtatatttatacaatggaagagaactcagtcattttcaaagctaatacatgtaaccacatcggaatctcaaaaatacaatgttgaatgaaagcagggcccgtgtatggtcctgtttatatgacgttcaagactttttagagaattgaaaagcactgcgtcttgattcaaggattagtgatcacatgggcatataaatgtacccaaactcattgaattgtacacttcagatctctgcattttgctctatgtaaatttcgcctcaaattaaaaaaaaaacacctgacccccttgccgtttcacacaggccctttgcagtctggcaggtgtccaggctgcctgcttagttccccctggcccaaaatatgtgtgggtggaggggtgaggtctgtttcttccgccatctttaagaatatgtatgtgtcttataaggctctgccccaaaagagctttgccggagtgtcttttcctagtctattggcagaattctgtcttcctgttgagtcttagatgacgttatatgtattttgaatgtgaaaattctcatgtggtatttgtgttactaaattgtcttctcatatagaatgttggtttgctggccgggcacggtggctcatacctgtaatcccagcacttcttgaggccaaggcaggtggatcacctgaggtcaggagttcaagaccagcgtggccaacatggtgaaacccccgtctctactaaaaatacaaaaaaactagccaggcatggt

SEQ ID NO: 19288 - DNA, 1033 bp, Homo sapiens
tgcctcaatttttcagttcagtgcagcctcgacctctggggcttaagcaatcctcctgcctcagcctccccagtaactgagaccacaggcacacaccaccacacccaggtaattttcatattttttgtagagacagggttttgccatgttggccaggctggtcttgaactcctgggctcaagccatccacccacctcggcctcccaaagtgctgggatcacaagcgtgagcccccatgcccagcttatcctgggtcattttttaaactctcccctctaccataaataatattccctttactgtgattttttaagcataattttgtaaattgttgaagtggtttctcattgttgggaatgtagattaaaccacttaataaagataccttgaaagcaaattaaagaaagacatttggcggaaaactactggttttcttctgtaggtctctgttgacctaaagagaaagggattggggtttgctctcttggtggcgttgctgaattggtcggggtctgtcgctgcgcctctgcacctgtgtgatttgctgagtgctcctctctcctccctcgtgatcatggatggagggcctaggagcccaggaaccatggtgcccttccccctgtgctgtgcccctcaccctctcttccctgcatctatccctttctacttctcttcagagttttagagataggaacattaaagtgtgcccaattgtttttatgaggttttgttctagagaaaggatgtaaggaagcttgtaaagacagaccacaacaggtttaagagatgcctggggtgtgttggtcagctacagctgtgtaacagccaaccagcagagctcaggagcacccaagatgagcgccttcctcacggatgtgtgggttggctggtgtcagctgggccatgctccgtgactgttcaggccgtagtggctggggtggctctgactcaggcgtccctcatcctccttgaactggggaccaagggcacatgggagccatgaggattcgtaaggccgagcttgggccggcac

SEQ ID NO: 19289 - DNA, 1029 bp, Homo sapiens
gcgtttcagccagatccggaggcattttgcacattaaagtttggaagcagaggcctcctctctttaaactgtaacagtaagaagggtgattgcataagagccagaggcgggctgcccaagtccaggtgcccctagatgtgtggccactgtggaacctcagtcagctttcctggaagagccccaggggcgggtgtgccccgtgactaccagtagcttgcttcagagtcatatttcattcctgggttagcgctttgtagatgtggtggaacaatctgattgtctgttacataatgtagattgcagaagtttttgtttgaaatagaagtgctttccgtttgattctgaatttcattaaaatttggtgatatcatgatgtattttacagatccttattaacggcctgcttcatgccaggcccagttcgaagtgcaaaggaacagcagtgaacaaagcaaaccagaaacacagctgccttgctgagcatcgagaagtcttgctaagaaggacgtttgagtatagatgggaaggcacaggggcgcttccaggcagaggggacagccagggcgaaggccccaggcagatgtgactgctgtgcccagggcagcagtgcatggagtgaagagctgggggaggactggatgccaggttgcaggggccaggcagagggtttttgtgggttgtgggaagaggctggctgtggagaggaagagagcagcttatcgttgccttcctagcagtagcagaaggcagcctttggagccggtcagtcttccctctcgtgcacatcaggccagatgacgagtcctgcgggtgagcctgagtcagagagcacttgagtggaacataggtcacgtggagcaaactaacttcaccaaaaataaccccaaaacagcatttctgggaaacacaagtgaagacagctttcaatgtaaacaaaggaacaaagttacgataaaggcttggttggaaaaagtgaacatgtggaaaactaagaagaaattccttgggaaaatatacggaggaaaacag

SEQ ID NO: 19290 - DNA, 1056 bp, Homo sapiens
tgctgtattcatgtcatagtggtacatctgtcctccagaggtactcacaccgtgaacagaaatggcagacattttattaccaatcatatttgctccaggagagcttgcctgacagtaaactgtgcccagtttctcttgcttaattaccccaggggtgcagagttggatgaaatctttttctgttttcgcttggggcagtgttacattattgaggcttgataaaaaccagatctccattatccttaattttgggtttagtgtccggtaaaacgagaggcttgcagtcctcattcgagtttccttttaaaaggaagaatagtcttctcccgccagaggagaaagcagacagttttcatctatcaacaggtctgatctggtggaggaccacttttgaggccaggagttagaggtcagatggggcaacatagcgggaccctgtctctttagtaaaaaaaaaaaaaaaaacaatttttttttttcatgaaaaacacgtgacctccaaagtgactgtgaggcttttccagggcttgtttttatgtggcatgctgatgtgaatactgttcaggtccgtatttgtaaagaaacaaggtgaggagggcagtggcaggctgcccctctggtgggcacggttagatgtgactgtcccagtaggggctcctagccatggagagtggaagccatcacaacttcactttctccagcctctaactgggaattgagcattccctgcctttatggaagcaggcaggaatccacagtcatacgaacagtacctgtgacttggtcacagatgcagtcacagatactttgattgcacagtcgtagaaagcgtcttcaagtctccttcatgctcagcgctcctgtgaagtgagctgagacccacagactctgttcgaggagcccatttgtcttctaatacttagatgacggttttcaatataattggctttgtttgcagtcctgtgtattttatgcatttaaaatatgtttcttagaagggctcagtaggtgtcatcgaactgccagagaggtcgctggcacaaagaaaaggttaaa

SEQ ID NO: 19291 - DNA, 1065 bp, Homo sapiens
tcaggaaaccagcatggccccagcctagcctaactccactttgcttctgattagaaatctgtgttagaatgcaagtcagttgatgtcattgtttaaagtctgcaagaaacaacttcatagctgctccattttattttctaattaaatagttcagaagcattggtaccttaactctttttagaaataacactgatgtgcccaactctgaccttgacctaggtctagcctcattaacattccagtctcctggcctgggtctgcccgctgtaaccctttttggtctccctggcctgggtctgcctccataaccccctctggtgtcactggccccctcttagcctctgacatcagttcccttgtgtcattggaatggtcctcgtcaaatgcatgctgcaggagcttcatttctggcttacgggtcttggcatgatgtgccatggcctttgtgatctgtcccctgcctgtccgtacacacctctctctgtaggcgcagttcctcctactcactgtgctttctctctcctgtgcccttggagaggctgttctcttagactggacaccggttacctgtgatacccctatacgcattattggttcatagataccagtcattttgttgttgcatccttatcctagaccttatgtgctgtgttctgtttctgcccaagactttgactttggcagagactgactttttaaatcactagagcctagcagttcctaccacctactaggggctcacctgcggagcatccgttaaacccaggggcaggaggtgttgggtggatgaaaagccgccgtagtacaagtgctttttccctttggctttttcttttcagtggccacagtagtcactcctgtaaccaactcatactttttatctttttaatttttgcctttatccaatgactacctctcatatattatgtagctggagattctagtgaagtttaacttgaattttaacatctgtattctactttctcatttttatttatttattttttttgagacagtgtctcgctctgtcgcccaggctggagtgcagtggcgcaatctcggctc

SEQ ID NO: 19292 - DNA, 1032 bp, Homo sapiens
gagacttgccctggtgtggtgtggttttatcttaggagttgataaaggttgaatattgtttcaagtaaacgatttcattgatatttggtgagttgtttgtctcctttgctcatctctgttgagttgttggtcttttctttttttaatttttactttatttgagacagagtctcactctgtcacccaggctggagtgcactggtgtgatctcggttcactgcaacctttgcctcccgggttcaagcaattcttctgcctcagccacccaagtagctgggattacaggcacgtgccaccaagcctggctaatttttttttttttttttttttttttttttttttttttggtatttttagtagagatggggtttcaccatgttgaccaggctggtctcaagctcctgacttcaagagatccacccacctcggcctcccaaagtgctgggattccaggtgtgagccactgcgcctggctgggttcttagtttttagaaactccgtaagtttcaaggcattgtctttagtaggaattgcatgtatttgttttctgggtttttaatcttgtcttctgactttgccatgcagttgttttcttttctttttttttaaatgctatatttatcagtcctttttggtatggcttctgggttttgtgtcataatgcataatgtataatgcgtttctcatcatacatattatacatatgcatgtattgtgcatacataatacacatgacgccccgtacattctgaagacagtcccctgcagtgtcgcctggtatggaacttgtgtcattctctttttatatcaaacggatccatctggaattgatttggtataaggtacaaagttagttttatattttccagatgacagcccatttgtcccagtgccatctgttaaatagtctctgctctccctcccagatctgagctgtctctcgtttactcccacatctatttgggttcacttctggaccctgcgttctgcttcatggatgtctccatccatatgacctcatgttggccaggt

SEQ ID NO: 19293 - DNA, 1050 bp, Homo sapiens
agcttcgcttcctcggctcgtgcctggaggacctggcccgcaaggactaccactcgctgcgcgactcggagatcaaggccaacaacccggccgacctgggcagcctcaccaacctgacggacgaggtggtgcgcagcaagctgctggtgtcgctggcgctgctgggctcggagcagcgcgaggcggcgggcgtgctctaccgcacgctcacgcacatcgactccatcatccacaactacgggctgcagcttaacgagggccgcacgggcgatgagttcctgctgctgttcaccatggcctccaaccacccggccttcagcttccaccagaagcaggtgctgcgccaggagctcacgcagatccagagcagcctgaacggcggcgggggccacggcggcaagggcgcgcccgggccgggcggcgcgctgcccacttgcccagcctgccacaaggtgcgtgcccgccccgagctctgccctgtaccccaagtctgcatccccaactctgcactccaagcctccagcctgcaccgcgaccccccgacccacgcctccagcctgcactgagagctcccacccaggtctccaacctgcaccacgagcccccagcccgtatcccaagccccatcctaagcctctatgtcgcaccccaaatgtgtgccccacctctccaagcctccaccgtacatcccaagcctccgccgtacatcccaagcctccgccgtacatcccaagcccccatcctaagcccgcactcctcaccctaagtctgcactttaagccccaagaccgcaccgcggccctgagcccacaccctcagtcccctctgcgtgccccaaagcctccacacctccgcctcgcgccccttgggcaggagcggctgcaggggccctgggtccgaggatccgcgggagcggtgcgggagacgtccgcggtcagagctcacagtcccaggtgccctcctttcacttagccggctgcaaacgcgataaggcctttgtccccttaatggggcccttgggtgacagataacacacattgcggcgccttg

SEQ ID NO: 19294 - DNA, 2092 bp, Homo sapiens
tcgggaggctgatacaagagaatcgcttgaactggggaggcggatgttgaagtgagccgcatgcccagctaatttttgtatttttagtagagacggggtttcactatgttcgccaggctggtctcgaactcctgacctcatgatccacatgcctcggcctcccaaagtgctgtgattataggcttgagcccccgcgcctagccttatgttcattcttaaaatttattttaaaacaaataattgtcagaatgcacacataagtttgtcagagcattaattcattacctactatgtgtaggacagtgagattgtacagccccttcctcctttgaacttacaggttataaatcaaatcatgcttcatgtttgttttaacttgcaaccattttaaaatcagaacttttttcaaagctgttgttatcttgtttaaaattattcaaataccaacttgggagttttccttaaactctattctgcatttatagagaaaatattctgtatttatcttacgtgcaaagtagaatctttgtactaaaaatctgcgacgtgaaatctgaaaaaaacagtggtctgtagcagtcttttaaagattacacgcttccacatttccacattcctcagattctatctatattaagagccatcgtcctgcgaaggatgtggtcagtctgagttgcagtcagcaaggtcaggttatcttttctttcttctttttttgagacagattctcactcgatcgcccaggctggagtgcagtggcgtgatcagctcactgtagcctccacctcgtaggttcaaactattctcgtgcctcagcctcctgagtagctgggattataggcacccgcccccatgcttggctaattttttgtgtttttagtagagacaaggtttcaccatattgtccaggctgtttttgaactcctcgcctcaagtgatctacctgcctgagactcccaaagtgctgggattgcaggtgtgagccactgtgcccaggctgtttatcttaagaccagatgtggcagctggtgctgggtaaacgccctgtgacttttcctgcttcacacaaaacaggaacaaacaggagaaaaccgggcacttgagacttgggctagagctgcttgctcttccatgctttccttaaaaaatgagtttggctctcctttttgagtagctggagagcagccccttacgctttcacgataattgtgtcaaagttccacattaggacaggactttctgggtgcgcctccgagtctccccatgcctccagcaaagctgccacttccctgttcagcccagtctgcgtgctgggtccggcaggcactgagcagggcaaggctgcggggcctccttgccgcgctgtgatttcgggcacagagggtcggcttctgtggtcttcagtttccctggagcgcccagtcccctcgctcacccctccagtccactgtggggccttaccacccttgctgccaggctgctcacacctccgttctgatcatccctttggaggcgccattcactgctgcccttacggttgcacacctaataacctaatggaattgtctctgattgtgttaactgtgtaagaaaacgcagtatggctttcagattaaattcctctgcctctgtgggccagcattatttccggttttcaaatgcaaactcatacgtgcttgtggtcctttcatatcaattcaaacttgaattaaacaggtgaaaatgttgccctgtctccaggtagattgcgtcaagattgagtttgaggagacctgactggcgtctctggctcgttgcagggaaagcggccacgtttctgtgttgattgttgtgttggtgtaagagcagaggagaaaaatggtttgagtttttccccaaacagtaggaaatttacctttaatttaaatcagttcagtttttaatgtcagggcttttcccaatgttacggaccctgacagctgctgttcttctaaccagggattacatctactacaacgacgtgtatgcctttaatctggacaccttcacatggagcaagctgtccccgtcagggacggggcccacacccagatcaggctgccagatgtccgtc

SEQ ID NO: 19295 - DNA, 1045 bp, Homo sapiens
ttcacctgtagaagctgggataggatttgctttgcacctgccttttcaccgatagaagctgggataggatttgctttgcacctgccttttcaccgataaaagctgggataggatttgctttgcacctgccttttcaccgatagaagctgggataggatttgctttgcacctgccttttcacctatagaagctgggataggatttgctttgcacctgccttttcacctatagaagctgggataggatttgctttgcacctgccttttcacctatagaagctgggataggatttgctttgcacctgccttttcacctgtagaagctgggataggatttgctttgcacctgccttttcacctgtagaagctgggataggatttgctttgcacctgcctttttacctgtagaagctgggataggatttgctttggacctgccttttcacgtgctgtttttcgagcattgtcccgtgacatgcagtattttaaagaatctaattcttaaacatctttgtcaagttgatagaataaaatggtatctctgctttatttgaaattctttgattactagggaggttgattgtagttatttatgtgttatttgtgtgtgattgtattatttgtgtgtatttttaaggttttaaatttgctttttgtatttttttattgccatgtatttttatatcagttttattgagacataattacaataaaattcaataaaatgcatgccttttagatgtacacttagatgagtgttaagaaatatacacacctgaccagaggcggtggctcatgcctgtaatcccagcactttgggaggccgaggcaggcaaatcacctgaggtcaggagttcgagaccagcctgaccaatatgatgaaaccccatctctactaaaaatacaaaaattagctggtcgtggtggcaggcacctgtaatcccaggtacttgggaggctgagacaggagattcacttgaaccctggaggcggaggttgcagggagccgagattgcaccactgcactccggcctgggcaagaatga

SEQ ID NO: 19296 - DNA, 1539 bp, Homo sapiens
ggactacaggcgcccgccaccatgcctggctaatttttttgtatttttagtagagacggggtttcagcactggtttagttttgaatgaaggtctgatcctcagattgttcttataaagtaatccatcaggaaattcgtctgggggggagggggcgtcgggcaattcgtcaggagggggaggggcgtcaggcaattcgtcaggagggggaggggcgtcaggcaattcgtcaggagtgggagggggcatcgggaaatttgccaggagggggaggggcgttcttttcttgctccgcatgtgtggggttttcttctcaattgactctcatgtgtagtgtgtccgctggatggtgctgtcccctgcggtgccaagcccggaggggatggagctgctgtggagtctgtggaactgtgaagtgaggccagcttgcaggactccaaagaaacttagtgagctgagatcctgctgggtatccctatgtgaagaggccaccccaaaggctcatgccaactccgggttggattaatagaattggtgtctagaaaaaggaactgattgcttctggttgacattccatggaggggtgtggttgtcattttcagtgatacattgaaaggggtgctgatatgatggagggtgctagaggagagaagctggtgggatcccgcgtttgagcagtgagaaccgaattcgctccagcttggagcaagcgaagactcctggcagtcaccctgatgatgtggtgaattatctctgaacttcagtaaacttggattagatcactcaagcttccttttacgtttgagattccatgtcttgatgtcttgtgttttttttttcttgagacggagtcttgctctatcgcccagactggagtgcagtggcgcagtgtcggctcactgcagctcccacctcctgggttcaagcaattctcctgcctcagcctcctgagtagctggcattacaggtgcctccacgacgccaagctaattactgtatttttagtatagacagggtttcaccatgttggtgaggctggtcttgagctcctgacctcgtgatccgcccaccttggcctctcaaagtgctggggatgacaggcgtgagccaccgcgcccggccctcttgtgttttttagggtacctgcccatttctgggcttttacataaaaccctgtaagtgggttttggggacagctgtgtaacatgcacaaaaaataaatggaggaagaatgcattatctaaataggcactgacttgcgtgattgaagctgtaaccatcctttgcagcccagagttgctgtgacctgtgtggagaggtgggagggccaggcagagagtgggtgtgaaagccacggaggatcccagggagtggattcctaagtaggaggcgaggcaggtcatcagtgaggatcccagggagtggattcctaagtaggaggagaggcaggtcatcagtgaggatcccagggagtggattcctaagtaggaggcgaggcaggtcatcagtgaggatcccagggagtggattcctaagtagga

SEQ ID NO: 19297 - DNA, 1037 bp, Homo sapiens
gactgctttcctgggtatcctgacttgttagtcttggttttcttatctttttttttttttttttttttttgtcgcccaggctggagtacaaaggcgccatctcgggtcactgcagcctctgcctcctgagttcaagcaattctcctgcctcagcctcccaagtagctgggattacaggtgcctaccaccatgcctggctaatgttatatttttaataagaggcagggttttaccatgttggccaggctggtctcgaactcctgacctcaggtgatccacccacctcggcctcccaaagtactgggattacaggcgtgagccaccgcgcccggccgatttccttgtctgtaaaatgagaataaaggtaatatctgcaccacgagtttgctgtgaggataaatgcacataaaaggactgtgcctggcatagaataaacacaaatggtggtttttctctgagtagtaatcattaagatgagacaagggtgtggtttataagttgcctgaattctggagacggctactaatcatgccacataacgtgattaagtgccctgtctttacactatcatttgttatttgatggacttgatactcggaaaagcagggcgaagtttccaaggcatgtgtttgaaatggtaggggaggtgcatgcacacggctctccctggctgtgctgtaactgcttttgaaagacaggggctctctagtctgaggatgagccactagactctcagggatccggcaggaattgctcctttgctcagcagatgtctctaggccgccggtgcagcagtggtcctgctgtcgggctgcctcacgatgtttctgttcacgacggaccatacatactggtggtccgctaagatgatcagactgtgtttttacttcccttctgtgtgttgagacatctacttgccattgtgttacagtggcttagagtgtctgggacagtactgtgctgtccaggtttgtagcctataagcattgggctctcccgtcagtgcaggcgtgtggcaggctgtgccttccagaagt

SEQ ID NO: 19298 - DNA, 1003 bp, Homo sapiens
gaggtgctggtgtgtgggtggatgaggtgctggtgtgtgggtggatgaggtgctggtgtgtggatggatgaggtgctggtgtgtggatgaggtgctggtgtgtggatggatgaggtgctggtgtgtgggtggatgaggtgctggtgtgtggatggatgaggtgctggtgtgtggatggatgaggtgctggtgtgtggatgaggtgctggtgtgtggatggatgaggtgctggtgtgtgggtggatgaggtgctggtgtgtggatggatgaggtgctggtgtgtggatggatgagatgctggtgtgtggatggatgagatgctggtgtgtggatggatgaggtgctgtgtggatggatgaggtgctggtgtgtggatggatgaggtgctggtgtgtggatgaggtgctggtgtgtggatggaccacgttttggttttctgttgggcacttgggttgtttccacttttctgctcttgcagtgttgctgtgaaagttcacggacagtgcatacatctttgtatgcaccggagcacttgggagatgatcggtactgtttggttggatgaagatatagatgtgtgtgtgtgtgtgtgtgtgcacgtccgtgtgtgcgcaggcatacgcactgttttctcctgatgtgaggaagggtcctcatttggtcctcagctaaagctgcatctgagtgaaagtcagtttcctggagaaggctcctcggcaggatgattccgttactttacgattctgtagtgaaggaccgcaacgagttagctaacagtgactggcctctgagagtctcaggtgtgaagtacaggtcaccataggaatggacacaccctgctctgccctctgggtggtgggttgggttgcatggtctgaagctctctgactccacagtaacctggggtctatcgacagcaaacagcagtagctcatgaaggcagaacctgccctgctggaaggccggggtgtgtatggattccccgttgtgctgtttgctgacg

SEQ ID NO: 19299 - DNA, 1062 bp, Homo sapiens
acagccagcgtttctccaggcacttgccaccttctcttcctgtcccctggagaaggtgcagggggttgggggagattcgtctccctccattggtttctgggccagtgccctctgagggatgatctgtgactccactttaggaccccgcccgataggtgtttcataacagctttctctgagatgtgattcatataccctcaaatcaccctttaaaatgtgtcattcattggtctttagcatgttcacagaattgcgcagccaacaccatgatctaaagttggtgcattttcatcccccagaaagaaaaaccgtctttttagcagacaccccaccgtccccggtccctgctgtctgtgtctgtggatctgcctcttctgggtatttcataaaagcggaatcaaaacacgtggcctctgtgacgggctcttctttccgcgtggtgctgtcaggacgtgtcctgctgttgcgagtatcagcacttcactcccgtggccagatgaggtgctggtgtgtggatgtatgacgtgctggtgtgtggatggatgacgtgctggtgtgtggatggatgacgtgctggtgtgtggatggatgacgtgctggtgtgtggatggatgaggtgctggtgtgtggatggatgagatgctggtgtgtggatgaggtgctggtgtgtggatggatgacgtgctggtgtgtggatggatgagatgctgttgtgtggatgaggtgctggtgtgtggatggatgagatgctggtgtgtggatgaggtgctggtgtgtggatggatgacgtgctggtgtgtggatggatgagatgctggtgtgtggatggatgagatgctgttgtgtggatggatgaggtgctggtgtgtggatggatgaggtgctggtgtgtggatggatgagatgctggtgtgtggatggatgaggtgctggtgtgtggatgagatgctggtgtgtggatggatgaggtgctggtgtgtggatgagatgctggtgtgtggatggatgaggtgctggtgtgtggatggatgaggtgctggtgtgtggatggatgaggtgctg

SEQ ID NO: 19300 - DNA, 1047 bp, Homo sapiens
cagagaagaggatcttgagtagtggttctcaagtcttcgtactccacgtagaccctagggagcccaggagactgctccttcctgccctcccactccggacatcagtcccattcagagcaggttgatgtgtggttgaggaatctgtgttttaccctaacctctccttgtaccctctccacgatccctatcctgacagctgtggaccatagacggggtccagttgtgatctgatccatcagcctctgtgactggtggaaggcatgcttattttgaatattgttcaactgatgtgaagttttttagttgctgcttaaaagaagtaagaatattcatgtaaaatacctcttagatccttaataatgaaagtagtgtaggttttgcttttgtaagttactaatgattgcagaatgaaagcattctcttaacggtggtttggcaggtcaggctctgagtgctatgtggccggatcgtcaggggctagtgtagctggggatggtacaggggactgaagggtgcaggcggcctgttgatttcatgggctgggctgcggtgtgtggcatcctggtgcagtgctgctgctgcctgtaattgggcttgggggttcacacactatgtggccgctgctgagagaggactactctggctgtttttcctctgtcatttttttttttaaattgatctaaaaggaaaggtcaggagattcagccacaacaaagacggtttttgccctttctggggaagattgctgtgtcaggcctcgtgcagagcacgtgggaatccctgtggggtgggcttatgtcttttgagaagtccaggaagagctcatcaggaaacggaataggcgttgctaccatgacgcagccctgcactgcgcattcattttttagtgaatattttttacttctgtgggggagttggtttttcagccgaggatgtgaagttggcgggaattaaatattggtagaggcgcagggagtctggattcagtatctggagtagtcagtctcttccttggcttttaagggttttcttgtaggaaggcagaat

SEQ ID NO: 19301 - DNA, 1033 bp, Homo sapiens
gaatgttgctgatggggtttctgatgcatgtttaccacgcacgggtgtctcccattagtcaagagctacatgtttgtctctccgtgtagagagccagatggcatgtttgcatataaattatttaagagaagaagtctagtcgaatgacagactgaagtagagttgttagtgtccttctatgtgtggcctggctcgattgctgcggccatgacccaccattacgcacaccatctctctgccattaaagcagcagagcggaagtgcccttgcttctgggatagaggccgccgcacacaggccttctccacatcctggggcttcagccggagggcagcggcgctccctggagcccgggcttggttatgtcacaatgagccagttccgggtgttttctggagtttggtccccagctgtattgcagtgagccttgtcagggtgttgagtcctgttcgctggctgcactgctctgcctggctctaggccgggaatgttaaccagtcaaatgaagagtctgctgtgggtggggagggtgcagacagattccctgccctgggcccacctgctggaggaggacatgaccatagccttacagtgggacccggaaggtgctgtggtgtggggtgggttactgtgttcccaggcttttccgtcccttttctcatgcttgctttgagaaaggttcgtaattttagtaggcgcagcaattgggaaattactttcatgctaaaaatggatttctttgtgtatatcttgaagctcacgtatttccactcagcacacagttgtccttttgctttattccttttggagcccgcttgttactgatttgcttgtttatctttggcaaatcgattgattttttaatagcattttgtcagctttggtatctcttgttcacaattgacaggtgaggagagtgaagtctctgtgatagaatgcggctaacccagcacccaacccagcaagtcccgccaggctggtgttggctccggtgcctctgtggtgactctgtggtgactctgagctgtctgtg

SEQ ID NO: 19302 - DNA, 1050 bp, Homo sapiens
gtgcgacctcagctcactgcaacttctgcctcccaggctcaagcgattctcctgcctcagcctcccaagtagctgggtttacaggcgcatgccaccacgtctggctaatttttatatttttagtacagacagggtttcaccatgttggtcaggctggtctcaaactcctgacctcatgatctacctccctcggcctcccaaagcactggaattagaggcgtgagccaccacgcccagccagttcatatttctatgcatctatttcacgctaactggagcgtgcatgtatgtgttctttctatagtgttttttaccgttgatgtattattgtaggattattctgtggcattgaatagtcttcccgagatgatagtttaaaactctatttactgtgtggcatggttgtgccacctaacttcctctagactcaaaacatttgttaggtttcggccttgagccagtcatcatgtctgctgtaaaggtgtaaattggtcagtttctccctatggaactactgggcttttagaatgataggaaacctggcctgtccctttacaggtaagtcctctgtgctgagatgacagatgcaaagaacaactggaagtgggtggggtggagagggacacgccaccccctgtgtgctgctaccacctgcgcccgctgtctggcccaggaaggaaccgcatcggtgcagaggggcggcactgtggccgtttctatgtgcgggcgggcggaacaccgactcagaggtgccgggagggagcctgctgaggaccactgtctgccccacccgaggcgcacttgaccttagacgggttggcactctcatttaccagccctctctgcgccctgtgtggaaccattcttcgtcctgctagatcctcactcttaccttgaaacgagaggaaataaaacaagaggcttttatgaaagaaccaactctgcaatgaccacggctgagctgggaaatggggcttcacctgctgccaggttgctcaggtcgctttttctctcttaattatgccactaggtgcgttacagtcaggcgaa

SEQ ID NO: 19303 - DNA, 1028 bp, Homo sapiens
tgattggaggaaagctgagcgggctgtggctccgcggcgggtcctgggaataagtctcacgtgtgcctgcttgcttgccctaggaagacctggaagcgctcatagcccatttccagacactcgatgccaagaggactcagactgtggaacttccgtgccccccaccctcaccaaggtgagcaagtagcatttttcatattgtatgtttccttttcttctatacattgaaaaactgctttaaatagcaccaggtttcgtaaatgaccaggcacttgggacattttcattattaaaacctgttcttggtcactttctgctgaagaactggaatgaggctgtaagctttactgtcatggaacctgggagcagggcctacagcacagctgctgcctctgggctccggtgccaactttgaaagctcctccactggtcgtgacgtggggatgaaagttttgccccagtgagcttttctttggttcttaaggtattttaaaagtgcgtactgtaggcagaaagctgaaaatcactgtggccttttgatgtgtttgtaatgctttcaaattctcatgtgaaaagtttgttaaacataaattgagtataagccattttaaatggatttgaaaattacgtaaaaacgttccgagtctgtaggatttcatacacgtgtgggatgagctggaatgagaaatggtttatttccctcagtaggagattaaccttgcaggatttacccttttaataaagctgctgcaggccctagtggaagccggggttcagcccatcgggagtggagggtcacgattgtgctgcgtttgcattaatgaggcgcatgtgatggctctggtgcccgagtcccacccaccggcctcagaggcagggttatcatcacctgcccagaggtgggaggagcacggtgatcagcccctgagcagagtgagtggtgttggagccactcccaaaggccagtgtccttcctggttttcacttcatgtccattaggattttagttttctttttccctttagttt

SEQ ID NO: 19304 - DNA, 1409 bp, Homo sapiens
gctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctg

SEQ ID NO: 19305 - DNA, 1058 bp, Homo sapiens
gaaggattgcttgagaccagaagattgagactgcagtgagccgagatggtgccactgcactccagcctgggtgacaaagtgagaccatctcaaaaaaaaaaaaaaaaaaaaggcagcagcaagcccaaataatacagaaataaaggaagcatgaactttggccctcgcctccccactcctgcctggaggtgacacagctgtggtgtcctagatgccctgtggccgccgcttgaccccccgggctggagtgagcagtggctcccaagttgctgtccttgccgagttggttgggggaactgagaggcccacagccagcggctggaggggcctggttcccactgtggccagagaggcccagacaagccaggcacaggccctgccactccccagcctgcgtgtcccctgtccacgtgctgagttgtggggcggtggctgactctgccactcttgtctgtccacaggctcttcttcgtggggtcccgggaaggccacctgccctccatcctctccatgatccacccacagctcctcacccccgtgccgtccctcgtgttcacggtaagcctgctgcacggccctgtgccctacatccctgggggttgtccgggggctcccagagggaggctgccacagcttgcagctctgtctggggtgtggactgggtgacagctcaaatgtggcctcctgccgagctccgctgaatgccagagagcgctggaggggctttagattttattccaaaaataatatatggtggctgccacaaacgattcagaccatcggaaatgcgggaggcagaagctgacccggggtgctgctctgccagccgcctggctcactgcacctccgtgggcgcccactctgttcgtttctcagcggggtgcatcacacacagtttccttccgcttctcctgcatctttccgtgccagcccgcgtgactgcctttgttccctctggctgtgtcacacatcactccaaaatgtagtgttctaaaaggaaaagcacttattatctcacagtttccgtaagtcaggaattcagggagctggtgcctgaa

SEQ ID NO: 19306 - DNA, 1016 bp, Homo sapiens
gcattcccccacttgtaggacagatgctccccccagcagaagtaagtgggcgagacacagtagggctatgcagatgtgaagggtctgcacattccagaacattccatcagagagcagatgggagagaggccagaggggctgtgccgaggtgctgtgcaaagtgccctgtcctgagctgctctgagctgcccccgctccaggcctgcagagtcaagctccgcctgctgaccacctggtgaccagaatacatcacacgcaggcagtgggccctggagctccttctcaggagatcaaggcctcagcagggcagggtggcgggcagccctcagggaacccaccagcacccccagtgtaggctgaagatcaaaggccccagcacacctggcatctgggacagacagagctggaggcagagccgcaggcatccagcacgccacggggaagcaggtgcaaaacaggaactgggtccacccatcaggaagggaccccaccgtgggctctgccgtaggaaatctggtgccacctttgaagtgcgcactttgtttggggtaattgccaaggtcttatgggaacctcccttcacgggtcccctttgaaatttgctcacctcgtcactctgcggtgttccctggaccaccaaggtggttccccttcttgggcccccatggtgacctgtggtccaaggccacatgttgggacacagcagccccagggcccgtccctgcctggccctgtgagacgggctggtgactttccagcaggaaggatactgtcacacacggttctctaatgaactaacagtccacagcctgaccaagatttccacttgtgcctccagctgtatatgcacctggcaggtaggcaggaggggacccggctcctttgttccggtggtgtctttggtcttctttccaagttctccttcctgaagcgcagtggtctgtgagactgatgtctgggcaatatattccgggctcgaacacaccaggcccatttcacagaggaggcaacagcca

SEQ ID NO: 19307 - DNA, 1060 bp, Homo sapiens
gttagctgttgaaagcgtcctcccaccgtgctccccccagcaattcccttctgagctttgggatacagtgcagtgtctgcagaattcctgtctcctgtttggcttcaacagatttattttgttaccagatgaatgccttgcttttagaagatacattgtgttgacccctttctcccaaagcagttgtccaactttataccccccagtggacgcaaagcccttgggcagctgccccctcccctcgctggcacctggcagcagcgcccccagatacttcaaggcagagactccggcctcaattttgcaacgactggcaagtggccctttccgggtctggagaatgcagcgaaaatctggcagagcaggcctggcccacgcacctgttcctgcctgtcccgcaccctgggtgccctgctccattggggctgaaaaggctcctccttgctgcccttggcccccaggtgggccctgtgctatggaaaggcactggccctagggtcctgtaggccttggctgacctgtttcctcctcgtcagggaagtttgtaatcaccccttcccagttggccatccgcagaaccatcttctgtcccgtgtgccgcatctatgccgggtcccaatgagaacatggccccgcatccagagctcatggggggacctgagagccataggcacgtgaatgggagagtcgcagtggggaataagcggggccctggtgcagaccagaaaagcccttctgaggggttgggcctttcctgagatgcgggctgggaggggcagctggctgagtgacaggggcgactctgcaggggcctgagtggtcgggagcccttgcctcctccgcgtcttgggggagtcatggctgcccctaggctggggcatggggacacgcaggcttaggtgtcacatgaggttctacagttagtcccagccttttcgaaagggagacagtactcatgagggttcagatctgacccaccgtcccatgagtccactcgcaggctgttgcctaaggagagggtggctgggccttcgcctgcagggcggagggtgggagcgag

SEQ ID NO: 19308 - DNA, 1077 bp, Homo sapiens
aagcgactctcctgcctcagcctcccgagtagctgggactacaggtgcccaccatgcccagctaattttttgtatttttagcagagacggggcttcaccatgttggccaggcttgtcttgaactcctgacctcaggtgatccacccgcctctgcctcccaaagtgctgggattacaggcttgagccaccacacctggcctaaaatagctttccaagcagtccttttggtcccagtaggtaaagcttcaaggcaggccctagagtgccaaccctctctgacccagaggtgagggttaatgttaatagggtccctttcagcgaaagttagggccacacttctcatgtccctaagccatttgtacttgttttttttctctgacccacctgtgtgtgtggtgagtatgtgtgtatgtgttgcttttttttttggaaagtgattttcagtaacagaaagggatgtactctctgcaagagtgaatctattcttgcccctgtgtgtaaggcaagaaagagaagctgtgttctctgaacaggcagaccctgctgagagagggaggtgtgttggggttcaatcattctggtgggaaagatattagagatagttatagaaatagacacaaatcttggaaggccgagaagttggcataacttcggtaattagctctggctgaaggcggcctgatccctttacctttaattaaacaaataaaaatagtgataaaagaaaggcagcgtagtttacctagctagcttgtttactcgcataatcttaagaccgtgggtgtttaagtgctttttacttgggaagtccacaatgtctgttacattctaatggtgttgactcaagcttttgttagttaatcatactgaataaatgcacgtctgactagctgatcagggccaagtagcaactgtttacaggactcagcagggagcctataagcggctgggaccctcagctggactggcagagcagaatatctgtgtgtctgtactttattcatctgtcaccgggtcaggggtctgcaaggagtgctgtcgcagaggtgggctttgctgaggctggtagaactccaa

SEQ ID NO: 19309 - DNA, 1007 bp, Homo sapiens
gcaccccgcagctcggggggctccgggcggccccaggactcaccagcttcccccgcagcatcatggggctgtacgtgtccatcgtgctggtcatcggcaagttcgtgcgcggattcttcagcgagatctcgcactccattatgttcgaggagctgccgtgcgtggaccgcatcctcaagctctgccaggacatcttcctggtgcgggagactcgggagctggagctggaggaggagttgtacgccaagctcatcttcctctaccgctcaccggagaccatgatcaagtggactcgtgagaaggagtaggagctgctgctggcgcccgagagggaaggagccggcctgctgggcagcgtggccacaaggggcggcactcctcaggccgggggagccactgccccgtccaaggccgccagctgtgatgcatcctcccggcctgcctgagccctgatgctgctgtcagagaaggacactgcgtccccacggcctgcgtggcgctgccgtcccccacgtgtactgtagagttttttttttaattaaaaaatgttttatttatacaaatggacaatcagaggccagtcccccgtccttgccttccggctccagtgtggtgtaccaggtggccactgcctgctgtcccggcaagcacgtcctcacgctcagctctggcccgcctcgtcgtcactgtcctcaatcagacagtcccggatctcctgcaagccccaggccctagagagaaagctgcagtgggcaccagccccgaggccccttacccacgcgccacggcagtgtgggccccagtacctctgtgtgcggagctgggcctcagccaggatgtacggcggcagggggtccagtgagggctgcaacagaggccggtgtcgaggggccaagaaacctgccagcaccccctcaagccacccacgaggtgacggccttcccgcgtccccaagcccggcccaggacaggtgggcacgtactcaccaagtccttcatgttcacgcg

SEQ ID NO: 19310 - DNA, 1034 bp, Homo sapiens
tggactcttagttctactccactggcctgtgtctgcccaccattactaccgctgtgccatactgaggtcaggctggggcttttctgggctgctgggtgagctggagaatgcggttgtgtgacccgcaggaagggcagagctgagcgtatgacctgtgtcgttcccctccagaaatacccgcagcccaaagggcagaagaagaagaagatcgtcaagtacggcatgggtggcctcatcatcctcttcctcatcgccatcatctggttcccactgctcttcatgtcgctggtgcgctccgtggttggggttgtcaaccagcccatcgatgtcaccgtcaccctgaagctgggcggctatgaggtgagcatgtgtgggtccgcctgtccattcccatcccctgggggttctggccaaggtggtgcaccacccccagccgctcctccacgctcatcttcgtggccccgtgtccccgtgcctgccccagccgctgttcaccatgagcgcccagcagccgtccatcatccccttcacggcccaggcctatgaggagctgtcccggcagtttgacccccagccggtaagtggcctctgccctgtgaaagctggtgtggggaggcggctgcagtcactgagggtgtcacttgtacccagctggccatgcagttcatcagccagtacagccctgaggacatcgtcacggcgcagattgagggcagctccggggcgctgtggcgcatcagtccccccagccgtgcccagatgaagcgggagctctacaacggcacggccgacatcaccctgcgcttcacctggaacttccagaggttcgtcctggacttggggcagtgcctgggtgggtggacccactacagtgggtcacgctgtgttcccacccccagggacctggcgaagggaggcactgtggagtatgccaacgagaagcacatgctggccctggcccccaacagcactgcacggcggcagctggccagcctgctcgagggcacctcggaccagtctgtgtgagtgaaggg

SEQ ID NO: 19311 - DNA, 1044 bp, Homo sapiens
ggattctcctgcctcagcctcccaagtagctgggattacaggtgcccgccaccacgcccagctaattttcgtatttttagtagagatggggtttcaccatattggccaggctggtctcgaacctctgacttcaggtgatccgcccgcctcagcctcccacagtgctgggattacaggcgtcagccaccgtgcccggcctgttctgtttttctaactctcacacagcctcctgggttttccccggtcctctgcagtcggcccactctgcaccccagcccgcgctggctctgctcctcagctgccctgcccacctctgtcttgtcccaccgcgctggcctgtgtcttgtgcctgcactgctcccggctactccgcatgggaagggtggctctcgggccttggcccatgcaggcggagggggtctggctgggagtctccctgcatggaaggctggctctcagtgctgcctgcccacagtcatccactccggggactacttcctgtttgagtccgacagtgaggaagaggaggaggctgttcctgaagacccgaggccgtcggcacagagtgccttccaggtgaggtgggagagccccgtcggccccactccaaccacagagcttgtggtcctggaccagggcagcatagagggtgtcagatgcccccagggcctgggagccgagctcctccacctccagttagcccaccccgccccatccaggcctcccaagtcccatgggaaaccaggctacagggacatgggtcatgtgtagcctgctgccccacggtcttggctctgaccacccaggttctggtggctgcccgtggcctgacctgtgagaccggcccaacacctttgtgctggccgcctggctgtcctgggtccatctttgggcccctggctcttggtgttagaccagcccacccaactcctgaatgggtgggagtcttcccccacagcccctcagggtccccatccgggaggggctcagggacacggaggtccctgggagacacagagcagggatctggatctggcgcccggc

SEQ ID NO: 19312 - DNA, 1025 bp, Homo sapiens
ttcttcctcctggcctgcatcctgcagctgcactacttccacaggcccttcatgcagctcaccgacatggagcacgtgtccctgcctggcacgcgcctcccgcgctgggctcacaggtgcggccccgccctccctgtccggccctggagaggtgtagcctcctgggccagggagggagccaggtgggagttggacaggagccacatcttccaccttcagatcccaaggggcatttgctcataccaaggggatggcagtagcgtggaggtcacagggacagtgggcatgagttgcgacacagctgtgcacctgaactggcagctgcagcagaagcggtgccgacagggcttcttccagccccaggaaatgaggggcaggaacccagttgggagatgacattttcggaccctctcccaggcaggatgcagtgagtgggaccccactgctgcgggaggagcagcaggagcatcagcagcagcagcaggaggaggaggaggaggaggaggactccagggacgaggggctgggcgtggccactccccaccaggccacgcaggtgcctgaaggtgggttgggcgggcagagcacagctgccacccagtctgctgtgccatgtcccagctcggggggcgttggcagagtcccctctgggctccagagcctcttcctcacaggggacccgggaatccccgtttgtgccccgcactgaccctcacaccatcacaggggcagccaagtggggcctggtggctgagcggctgctggagctggcagccggcttctcggacgtcctctcacgcgtgcaggtgttcctgcggcggctgctggagcttcacgttttcaagctggtggccctgtacaccgtctgggtggccctgaaggaggtgagtgtggcaggcaactcagcttcccatctggggtggggtcgctctggcctgcccagctggcctccccaagcccagccccacgtgcccactgccctccccaagcccagccccacgtgcccactgccctcaggtgtcggt

SEQ ID NO: 19313 - DNA, 1031 bp, Homo sapiens
tggaagatgaggggtcccgaaataaaatttttttttttttttgagacggagtctcgctcagtcgcccaggctggagtgcagtggcgcgatctctgctcactgcaggcttcgcctcccaggttcacgccattctcctgcctcagcctcccgggtagctgggactacaggcgcccgccaccacgcctggcttatttttttttgtatttttagtagagacggggtttcaccgtgatagccaggatggtctcgatctcctgaccttgtgatccgcccgcctcggcctcccaaagtgctgggattacagacgtgagccaccgcgcccggcttttttttttttttttttttttttgagaccgagtctcgctctatctcccaggctggagtgcagtggcacaatcttggctcactgcaacctccgcatcccaggttcaagtaatcctcgcatcccagcctcccaagtagctgcaattacaggtgtgagccaccacgcccagccatcaaagtttcttattttcattgtagaccccaagctaagctcagaatcttttctgatccgtgttgcaggggctgtgaggggcgaggagggtcatgggggtggagtctctgtgtcccttgggaggccacagggagtggatgggccccaactgcccactctctgcaggctccaggcacgtttcctgcctgctgaggctctggcagcctgggagttccagccgcctggaccgccctcccgctgcccgctgtggggttggacctcagttgactttgatccacttgtgcgggggggggggggagctgagaccccccttgggaaccaccttggggtctgagctgggccaggactgtgttgctctcccgtatcctccaaacagagggcggtgaggccacgtgccaagcctgcagcctgggtgacgagggtagcagcaaaccctccatcctgtgacatgtcacctacctgccctgtgggggccatgtccattttgtgcccacgttttaggagagcgcgttttggagcaaacactcagagacct

SEQ ID NO: 19314 - DNA, 1030 bp, Homo sapiens
ggcaggtcagaccgtgagctcctctgctctgacggatgcatggacggctgccacctggctggacaggtgcagaggggaggtgccaccttctctggggacaggactggggcagaactcacccggctgaaaagtgcagctgtggagaacttcagaacttcagaagcctttgctgtgaatgcattttcctcctgcctcttgggccagatcttagggattttttttttttttaatgaaaatgtataatcgtcaaaaaactttagatttaaaagcatggagccgatggctatgcttggtgcgttaatgggaggaagaggggatcttaacttcagggagggctcctgggggagctgggggaggctgctgtgtccagcagggcgggcggtgccccccggagcccggcactccgcgatgtgtgcgctaagccgaggccgccttgagcccgtagcagcgccgagcgcgattctttcgtgtctgcttccgggagggtggaagggtgaagctgttgagagtgggaagggaggggctgtgcttcttgagtttgccgtgtgcccctgaccctttcaggtgcaagcgtcagctccacggtgccaatggggagatgggtctggaggccccaccaggctgtgaaaggcccggcctcctgtgctgtccgtggaggtcggggtctccctctgccctgcgcctcctctaacttgccctgcgttttccgtgcccctggtctagggtgaggctcgggtcttggggactgaggggcaggtgggtgtcaaggtgagagctgggctgggctgggcctccctccagaagacttcccggggctcctttggcaccaaggatggggcagatggtggcacgcatggcctcccctgggcacagagccagactatggagggatctcgttggctacatcctggctggggctttggggtcatggtgggagcagcagccaggggtctcgcttggacacgggtctgagctcactgtggcctccttcctcagcctcctgaccggggtcctgaggctggagggtggg

SEQ ID NO: 19315 - DNA, 1036 bp, Homo sapiens
tcctgtggccgagaccccgtgtctcaaggcacatcccctttcgtaccccgccccaccctccgcagcttcatgacctctgggtttcccccaggaccttcgcatctgatgttcccagatccttcctgccactgggtcctgctctggtgccccccggggaagccttccctgaggacccagctcagcatctggtgctaactgtggctcatcgtgcactttggcccccaggaggctgtgggctcctgaaacccctctgaaccacgggcttccaaccacacctgaccccctgcgtgccgaccctgtgtgcaggtgtacaggtgtgcctggggcaggatggctgtgacggcctcacagagcccggagagctgcctcctagcttccaaagccttcatttcaggaatcttaccctctcaattagtctggaatgctgggggcggggccagctccaggtcacagagcgaccttgtttacccagaccttaacatcggcccttccatgctaatcaatgtaatcattgtggtccatgcggcctctggaatgtgctgtccactccctgggtcagccagagagtgtcagggagcacctaccggctgttacccagtgctgccctgacctggttcttcactctgcacatttgtatcacgccagaccctggctggcagctccaggtgacgaggcatgtcagtgccttcctgttctgttctgttttgttttgttttttaaatcgggatgaggccttcctgtgttgcccaggttggtcttgaactctcagggtcaagcgaaccttctgccttggcctcataaactgctggattacaggcaggagtcaccatacctggcccactgctactttctagatgaagagacagaatcccagagaagaagcaggggtttggctgctggtctggagccggttctgctcacctccagcttctgccttgggccgccctgttcacacaggagctgctcacaggctgagacctcgagcagggccctcctagaggaactgggcccccgtaagtgccctgagccgccagga

SEQ ID NO: 19316 - DNA, 1045 bp, Homo sapiens
cctctctggcgagctttggctggaagcagttctaccgtgttttggaaatgaatgaggccttcagaaggcattagtcagtgtgtgcctgcgctggctcagacagtgcctggtgagggtttgagtcatcctggggtgcccctggcccccacgccctccctctccagtgcaggatcattacccaaaaatctggcagggagctgccccacccacagggagcaggggcctccttcagcagtctcacctaatgttgctggagccttgggggatcagggcccatctcttctagagagatgtcagggcagggctgggcgcgatggctcacacctgtaatcccagagcttcgggaggccaaggtgggaggattgcttgagcgtagccattcgagagcagcctgggcaacgtagagatccccatctctatgaaaaatatttaaaaattagctgggcatggtggtagtgcacctgtagtcccagctactcaggaggccaaggtgggatgattgtttgagtccaggagttggaggctacagtgagccatgattgtatgactgcactccagcctgggtgacagaccctgtctcaaaaaagaaaaaggaaaaaaaagggcaggacatttgtgattctgataatatgggaccgcacctccagttctatcagtgggaaatctagacagggctgcggaaagccagctggtgcgagaggagccaccgtgtcactgactgtgggacacccacgtgggctgacaatatggcttctgcttttcagggtgcctcgtggcacagcctaggggcacacccacggccggcaagctgggcgtcacctccttcaggctgattgtcactgagaagtgtcaccatttagcatgagggatgctgcctcctttttcagaacattgtcaccatcagggtctcaccactcctgggaggcggccgagaagctggggaacagcaggcactcggctcacagttgctcagcagtgcagaccctctgagctgagcatggcagagtcacccttcggaggcctgtgcccgggtctcaggacctgc

SEQ ID NO: 19317 - DNA, 1050 bp, Homo sapiens
ccttgccaccggccaaccctggcccctggggattcccatgctgccgagtcactcctgtcacttaccctgacaggcctagactcccgaggcttcctctttggcccctccctggcccaggagcttggactgggctgcgtgctcatccgaaagcgggggaagctgccaggccccactctgtgggcctcctattccctggagtacgggaaggtaagagggctggggtggccagaggaagggcagggccaggccaccgtggccactctcccccagttctaaaaggccttcccaggcgtgtcaagtggagctgctgtggttacagtggccttgggagctcagagaggttgagacataggctgggctcacacagccaggtaacagcaaggtggggttggagtcagggtctagggtggcagctgccaagctgtgcaacaaagctgttttctgcgggaggctgaggaccacacaccacttcccactccaggctgagctggagattcagaaagacgccctggagccaggacagagggtggtcgtcgtggatgatctgctggccactggtggtaagggtctccccgcagccaactgctgtggctccaagggcctggtgggagtgggacaggacctcgctgtgtgacatgggatgcagcttactgttgtccagagggtgcctggtggccaggccgacaccttcctctccccatgccttcccctccccaacccaggggctggcctggagcacctgctctctgcagcccaggccaactggggacctcaccctcccatccccaggaaccatgaacgctgcctgtgagctgctgggccgcctgcaggctgaggtcctggagtgcgtgagcctggtggagctgacctcgcttaagggcagggagaagctggcacctgtacccttcttctctctcctgcagtatgagtgaccacagggcctcccagcccaacatctccagctggatcccagggaaatatcagccttgggcaactgcagtgaccaggggcaccggctgcccacagggaacacattcctttgctggggtt

SEQ ID NO: 19318 - DNA, 1033 bp, Homo sapiens
ggatgacgttgcttttgtaatgaaagaagggtgtgtcatatttgtaaatgtttacgtagtagtgagtgctggggagacccacaggccccagcccacatatcccgggtcctggtcacaggcagggacaggatgggacggctctactcacagcctctctgccagggcttggcctgctgagccttcatttcctctcttgcccgtgagtctgagggcagaggatggctcgggtgcctgctgcctgtcctagcgaggcccggggccgctgcaggcttgagcacatggtcccagtgactgctcactgtggttctcagcccgttagagctctgcagcctcagcctgtccaggccagcccctctccgtccttcgctgtcagccccagccgtgtgaccagagctctctgtccccagctttgccagcgccgagtaccaggaggccctcagcaggatcacctcggtcgtccagcagcaccaggaggccttggtccccgcgcagccccagctcaacgtgtgcaactgggcggtcatggtaagtggctggtgtgtgggcggccgtctctttgccggggctgcagccacccacccggggcccaggatgaaccgtggccagcacagggcagaggcaggcgtgcttccccgcctccgtcagtggtgaggccctcgtgcctcagagcacacgcggcggcgtccgggattcgggaggcaggagccaagcgactcggggaccagaacaacgctgcaccagggcagccgcaggtccacagccggccacccgggcctctgcctggctgagctgagactggggagctccaaggcccctctcctgccccccacaagtcactgagggacagcagggcgcgtgagagggtccggggtcccctggtcctcgactcccacacgggcagcttctccttgcaggggccctgtgatgacctccaaactcccgggctctgaaggcaccgaggcaggaacggcactgcccggtgggtcccgggtgggctggtgggcactgttgagtggcggcggccccagggccc

SEQ ID NO: 19319 - DNA, 1105 bp, Homo sapiens
ctgcagtatcaggctcagcaccacccaggtccctgaaccaagcacccgtgtgtcatactgcagctctcagaaaggtgctgatgtgggcacagatgagaaccaccagccctacccggtgggagctgtgggtatttggggagcgtggcccctgggggcttgtgctgaggaactcaggtctgaggcgtagctgagtgtgcatttctggccagccctaagatgatggtgcaggaagtcactcacaccacaccctccccaggccactaggcccttcctaaccagagccgtgagaaaaaactgaaagcttcataaagacacatggaagactttcctgtaagaagataaatgtttgactacattaaaatgggactttgggcggggtgcggttgctcacacctgtaatcccagcacttcgggaggctgaggtgggtggttcacctgaggtcaggagttcgagaccagcctggccaacatggtgaaacctcgtctctagtaaaaatacaaaaattagctgggcatggtggtgcgtgcctgtaattccgggagactgaggcatgagaatcatttgaacccgggagacagaggttgcagtaagccaagattgcaccactgcactccagcctggggacaaaatttaaaaaaaaaccttagggatatgtataaaaatattcactggaacaaaactggaaactcactcagaggcccatcagtaattcagtgactcaccggagtttggaacatccaaagggtattatatgattccatgtaacaatttacactggtgatgtctgagctgccgagtaaaagctatgaggcccattgaggaggattgtgaatccatcctgagcttcgaaaacgatttcatacatatatatatgttgagaaaaatttagagacagacatgatcacactgcagctcgccaacatcgcaaaaccccatctctacaaaaatcagctaggcgtggtagcacttgtagtcccagctactcgggaggttgaggagggaggatcccttgagccccagaggtcaaggctgcagtgagtcatgattgcaccactgcactccagccttgagacggtatctaaaaaagattctctacacggttgc

SEQ ID NO: 19320 - DNA, 1010 bp, Homo sapiens
ggtcctcggcccccagcctcaccttgttccacctgaccctgtcagcccagttccccaggcatcatccctacctctgcaggctcaggtgaaacatctcggaatcacccccactcccccagctccttgcgctacgtctgggcccaaaatagatccctccaaatggggccctgctctgagcacattcccatgagggctgcctgccctgtgcactctctgccctgggccgcggggcctgactgggttcccacctcctcctacccactggggtctttcccagcaggcacagggattcctcatgggggaggcagagcccacccgtctgtcctcggtgacggcctgagctgtgcacggcctcccctgccctcctgttctcaggccccccagggtccatccagccccagcgtgtggcgttctggctcttccctggagtctcctcccagaccacgcgactccactcacactgtgcctagcggactgtgtggttgatgcagccgtctcgcttgagtgtgttgtgttatgcccagaacaggcttgccgtcaccaatggccatttccttctggggattcctgggcactgaaactcgcaggtggcgtgaggtacagccaggggccctccacacgcgttggctctgtgggcccaggccgcctgaggcccctcgccgtgctggccctgacctggctcagctacccagcacccccctggtgaggatgacggggtctgctgagcttgccctgagggtgaggctgggtctgtgctgctggccgacatgtcagggacgttgtgcaggatccaggagcgggcgccctcgggccccaccctgccaagctctgagctctgctcccagggagcacgaggggcactgcacccacggtgacctctgcggtctttcccttccccgcgagcctgaccccagccgtccccggggaggctcatccacagaagacagagacggcagttgggtcatgacattcagaaaaacctgccccaggatctctcctcagtaagacct

SEQ ID NO: 19321 - DNA, 1055 bp, Homo sapiens
tacaccaagtggaaggaggcctgcaggagttgctgccggtccccgtcaccactgtgggactgttagacctgcaaggcagacccaccctcgtctggaatgaggtaacaccaagaggtgtggccagtgcacagaaccatagactcaagctttagaaagtggccattgtggccggcccaggagcagtgggcactgagaggtctcagcctctgtgggggtcgagagaggtcgtggtgtgcctgacagccccgtcctgccggaaagcaggggtgctgcctggagatgcggcgggtctcactgatgtcttcatcagagctccgtggagagcccctggttgcaggcaggacagcaaggctgaggggtcacacggggccacatctgctggtgcccgtcgtgctcctctgcagcaagcccagcctggccattgctggaggtcctggagcccacagtgccttggccttaaagagctcacttgagaaacggcttgttccggtggggtggggggtggattgaagactctgagacgagcagggaactcagaacactgagtccctatttgatgttaaaatatgaccgttaaacttctgggtaagataatgaatggcactatggtttatactgtttctgttttatgggctcttccagagacgtgaactggaaaaggctctgcagtgtctgggattcgctcagtgctgcaggggagggcaggtgtgaggggaatggccctggagggtgatggggctggggcatccgatgcagctttatagttctgtaattaccacttttaaactttttattacgaaaaatgtcaaggaccctggaattacggtgaggtaggcaggataatggcccccaagatgcccgtgttgtgacccccagaccttgtgagtgcctcacatggggagattgtcctaggtcatcttgcaggcccagggcagccccatgggcccttaaagcttgagagcctttcctgctgagtctgagagatgccagaagcaggagaggttagaacccgaggagggccgcacctgcgctgctggccttagaggagggccgag

SEQ ID NO: 19322 - DNA, 1053 bp, Homo sapiens
tcccccgctggagccctgagcctcaccccattggagccctgagcctccccccattggagccctgagcctcccccaattggagccctgagcctcccccgctggagccctgagcctccccccattggagccctgagcctcccccgctggagccctgagcctccccccattggagccctgagcctcccccggctggagccctgagcctacccccattggagccctgagcctaccccccgctggagccctgagcctcccccattggagccgtgagcctcccatcgggttggatgggctgtggcctcgtggggtgcgcgtctgctctgcagggctcggggtgttcacagccacactcactccagtggggttccctgttgctgagaagaaatcagtgtttcttggaaagtatttcaaagtaaacttgtttgctgggttttattgttatttttatttttagatagggtctcgctctgttgctcaggctggagtgcagtggcgtgatcacgactcactgaagctttgaactcctgggctcaagcgatgttcccaactcagccttccgggtgcaggcgcacgccaccatgcctggctaatttttttattttttgtagagacggggtcttactaagttgcccaggctggtttgaactcatggcctcaagcagtcctcacgccttggcttcccaaagtgctgggattatagctgtgagcccccatgcctggcctatctgtaagagaactgaggaattttaaattttactctgctgtgttccataaacctcactccaggcccctggagggacctgtccctggtgtgtctagcacatggctgcattctccagcagagggcacctctgagccgggaggccggctgggtcgacaccctggactggactccctcacttcacagggctgggtcctggggcttgcctgggacccggagagaactgagcgagcctccccagacctgatacggcccaggggcttaagagctccatgattagagtttaatattccctttctttacataaaatacccccatcaaaccatgagtgg

SEQ ID NO: 19323 - DNA, 1026 bp, Homo sapiens
atgacggtaactgacagaaagaaggcagaaagagagagaaacctggagattggaaggagaagccagtctcaccacaagatggctcacagtgctcagcgggcgcccgccagcttctcttgttggcccaggacaggctgttcggagcttgtcttgctgccccaaggaggatgtcagtgggaatatggttgcgccctcgtttggagttgtgcgagcgttgagctcagtgcccgggtaggaacttggcgttgtggaccatccgcctcgtgtagatcggctgtgatttagacttcttggccagaagtgctgtatttcatggctttgaacatccggatgaggccagatgtttggtgtggacagcatggtttttagtcaaatggaagagaatctgtgagcagcagccgtgctacaaagctgcacccggccctgcccatcagttccatgagctgtaaccgccatcggccgtgaactttctgttgtttgaaaatatcgccatggaaacatccctttgtggagcagaatcaagaatgtattttgacgtcttcgagttttacggtgggacgcaggagttgcacattttcctatgttgacagtatcgtggcctgtgtctcctaaaagactcttgctagaaaagcctagaaattagaggtgctaaatgattgatacaaaaggcatttgttcagatgagcagctgaggccacacacctccacgtccctggggcccaacctcagggtctctgccttggagcccagcttcagacctcccagggaggtagaggaaggggctttgggcccagaccccacggaaagcttgtcccctcgagagggccacacttcctggacactgggctatcagggtagacactgtccccccagctaagagggacaggtgctgaggagggatgaggggctttgagaggtcaccaatgagacttctgacccattcctgccctctggtggggctggcatttggatttgtgctgttttatgctgctggaagtgccccacactccctggggcccccaccac

SEQ ID NO: 19324 - DNA, 1049 bp, Homo sapiens
cctggcatatgaaacaaaatcttgagagcttgagaatgtaatttggacatcacgactgaaagcatccctttcttttctaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggtaccagcccgcggcccctcctgcagtcagccctccacaggcagcccggagcagcccaggcagggcgtccctggcccccgcacctccggctttgcactgggacgcactctagcaccctgcacgccgtccaggcaagaggcagcaggggcggagcacaggcccccacatgccacctcctttgcacccgaggctcaggcccatggggccgattggagagcttcactcttgggtcccacacacgtggagatgcacccggtgcatgtccagccctgggcgaggtatggggctgctcacctgtgggtcttctgacagctggacacgggagggagacagtggttcccctcagggccacaaaggcacaggaagaaactccattgcttgtagtaaaaaccaaagggagccctaaaagtgagcaggaggcagggaggtcttcccaagcacaggcggggtctgaggctgcagagcaggaatgtgtgtgctgtgtgcctgtgccagagtgtgtgcccaagtgtgtatgcctgtgtgtatgtgtgcccatgtgcacatgcccgtgtatctgtgtgcatgccctcatgtgtgtgcctgtatgtatgcccgtgtgtgtgcccgtgtgtgtatgtacttgtatgtacccatgtatgtgtgtgcccgtgtatgtgcttgtgtgtacccatgtgtgtgcctgtatgtgtgcctgtgtatgcgtgcccgtctatgcccgtgtatgtgtgcccatgtgtgcctgagtatgtgtatgcttttgtgtgcctgtgtgtgcctgtatatatgtgcgctcatgtgtgtatgcccatgtgtgcgtttgcatgtgt

SEQ ID NO: 19325 - DNA, 1024 bp, Homo sapiens
caacattgtgaaaccccatctctactaaaaatacaaaaactagccaggcatggtggcgcatgcctgtaatctcagctactcagggggctgcaggagaaccgcttgaacccgggaggtggaggttgcagtgagccgagatggtgccactgcacttcagcctgggcgacagagcgagactccgtctcaaaaacaacaacaacaaaaattacaacagaagacatctgccctaatcaaaagtgaaagatgacatgtttgtgaatgactatacagtgtgacatttcatcagatattttacaaagcattttacagtttcttgctagaaattccatttctagttataaactttagatatgtaaagaaacagacaaatactcattttagtgttgtttgtattcgcaaaaagttggaaaaaacaaatgttagtcaacaggagaatggatttttcagacaacgaggagcgcacactgcagttgtcataagaatagtagaactgcctgtatccacacagatagaccccagagcacaacttgaagggaaaaggtacggcaggaaccgtccaatgcgttacctgcaaagacagcggccggctttggtgtaggcttgtgtgtagcgtgagtatcaaagcgccgagaggaatgcttagccccaaaatcagatcgacgctgaggagcagccacagcagggtggggcttatataaggggcttcaaccattatgtaatttgtaatttttaaatgttagaattctaaagcaaatatggcaaaatgaacagatggtggatgtgtgtttgtattctccttcatccttttctgtgtgcttgaaaaattttaaaggaaacattagctattgctaatttgttataaaatgatatggttagaaaatattttctgtgtagaaattataaaatataataacccattctaaataaattgagggttcgtctaaatttccgaaatggtttgtgaaagagccacctttatatctgactcttcacatgcgctgcgtgcactcagggcaggatgggc

SEQ ID NO: 19326 - DNA, 1028 bp, Homo sapiens
tgtcctgagccagggttgcccgtgtgtgctcctcccagagcacagactccagggtttgttcccagcctatagatgaggagattgaggcccgggaagtcctgcaccaaaagcttccgctgggagcaggaggggcggggccgggcttgaggagtggctggccgcctgcaccgatatttatgtctgtgatgtgcccctgggttcagtcggtcagagctggccgtgagtgtgggtgggtggatttcccacacccaaaacagcccgtgatccgtagtttccaacgtgccttcgttttccctactctgttggtccatgggagtgaggagcggagccttaccgcctgcgaagcataaactgtgtcagacatgggcgacgcggggaccgctggagggaggcgcgccctgacgcaggctgcactggtgactgctcagttggagacccttccttgaaaacatgagctgtgactcatctgtaataaacctgttagtcgtggtctgtgaaggtaattggtggtttatggatgtgactgaccaagttccggccagttgctgccttgtgttttctgactggggtgaggttctgaacgaggtgaattctggcaactccaagaggaggcactgtgtttcgcgtgcaccctcacatgcctccagcccacctcgagctctgtctcatttgctcgctcactcactcacacatacattatgtgttaggaatacctgtgtaccctggcttttaagagattacacataaaaacacaaatctgagctgatttttactttgaaataatttgccacaaattcagtttaagcaattaaagtgttggagcttataactaaatgtcaatttttctgtttttgggaacacaggtattgctttttaaaaaatgcgctcaggcccagtgcggtggctcacacctgtaatcccagcacttcgggaggccgagctgggtggatcactcttgaggtcaggagttcgagaccagcctggccaacatggtgaaaccccgtctccactaaaaatacaaaaacatg

SEQ ID NO: 19327 - DNA, 1035 bp, Homo sapiens
cctcatgagcaagcggggtttatctcagaagttcaaatttggtttagcatttaaaaatcaatgtagtgtaccatattgacataaggaaaatgaaatgccgtaagatcatctaagaagatttttttaaaaaatggtatttgaggccagatatggtggctcatgcctgtaatcccaacattttgggaggctgagatgggaggactgtttgagtccaggagttgcagagcagcttgggcaacatggtgaaaccctatctgtacaaaaaatacaaaaatgagctgggcagggtggcgcgcctgtagtcccagttaccctggaggctgaggtgggaagatccattgagcccaggaggtagaggctgcagtgagccgagatcatgccatttcactccagcctgggtgatggaatgagatgctgtcaaaaaaaaaaagacaaaatcccatacctattcatgaggaaagtgctctgcaaagtaagaacagaagggagtttcctcagtctgatggaggacgttctgagaaacacccactgactgacaccattcttactggtgaaaaactgaatatgtttttcctaatgttggagatgcctaatgttggagatgtttgtggtcatctctttgtattcttttttaaaaagtaacctttattactgaagcaatactcaacattttagaaaattaggaaaaaccgataaggagaaatagaatgtaaaatagtcacattttcacaacctggagaacagaacctttttttttttttttttacggagtctcgctctgtcgcccaggctggaatgcagtggcgtgatcttggctcgctgcaacctccatctcccaggttcacgccattctcctgcctcagcctccctagtagctgggactaccggcgcctgccaccacgcccggctaatttttttgtattttttagtagagacggggtttcaccgtgctagccaggatggtcttgatctcctgacctcgtgatccgcctatcttggcctctcaaagtgctgggattacaggcatgagccagt

SEQ ID NO: 19328 - DNA, 1013 bp, Homo sapiens
tgacagtgagaaggaaaaggaggcttttcaaattctagggtgagatacagtgtttcaacatgaagttttctttttttttttttttttggctgaatgcaaaatttagttatatatatgtaaaatttgtgaaaatgcgtgccttggaagatttgaatgggtaaaggtatactttcctccatctgtgcagtgcattatttagaagcagtggagtgaccttgcaggcggcacctgagggagtgccaggcatgggactgttgggcgggcagctcccgagagccctgcagggctgggtgctctggctcccatcaattatttacagacttggggcattcagctgggctggttcacaaggctggaagccagctccgcctttatgtctccatctctgcccgccgcccctcaccctgtggcagacatgccccacgctccctgcatgagaggctgcagaggctgctctgtcttgtttcgggtgtctcagggctgatgtgtgttgtgttcccatagtggctgttgatcatgaaaaacattatgttccataagatatgtgaccagttcgggcgtagtggctcacgcctgtaatcccagcactttgggaggcccaggcaggcggatcagctgaggtcaggagttcgaaaccagcctggccaacatgatgaaaccctgtctctactaaaaatacaaagaaattaggcaagcgtggttgtgcatgcctgtaatcccagctactagggaggctgaggcaggagaattgcttgaacccggaaggcggaggttgcagtgagccgagattgcaccactgtactccagcctgggtgacacagtaagactctgtctcaaaaaaatgaaaaagtgaccagttccttgtagttgccttggactggtgttcctcttactgctggtatttccagctctacttttgagatcctctggagaaataaatagaaactttgtttactttctctctctctctctctctctctttttttttggagttggagtctcactctgtcacc

SEQ ID NO: 19329 - DNA, 1082 bp, Homo sapiens
caggagagccacagacccttgccgtgaaccgccgtggcagggcctcggtgcagatgcgattgtcaggctgcgctcagtaacacaagacctgccctcgacgggtggatgctcataacaagatgaagttcaagtgagcatctttgggttttttcttgttttacttattaatggaagaaaccctttatttttaagagaccttcttttgatcctggcgatactgtgacatttcagtctatttttgagttggttgtgatactcgatgtctggggccgtccctgctggaagagagagcgttcagagcagagcatgtgccggacatggggccacgttcacccctgaggagcactttgaaatggctttgaattcttgtcagccttgattaggtctttcaggcaaacagtctggctgatgaaaagtttatggtacaagcagcagaaacttaatcagctcttctgttctgccatcgtcctccgtttgtgttggagtcctgcacgttcctctttggtccttgtgggtctgtgtgagccgtccgcccgccttccgagcctcagggtgtgagccctctgcccgccttccgagcctcagggtgtgagccctccgccctccctccgtgagccctctgcccgcctcccgagcatcaccagcataggttcgcctgggatgggagtatgttgggagcaactgggttgaggctccttggccagacgggagaccacagggcagctgcccaggaaatgtcagcaacatttagactttttctgatgtttttagatgaaagcaaacatgttgttctggcgtttccttcctgcatctggtgggtcttcagcatgtgaatctgtgcatttcctgggacttggaaagtctgttgccctcactcctttgggggcattttctttgccaaaggagctagaagaacgagcttccaggccactcacagcctttgtttgtttgagagtgtctcactctgtctcccaggctggagtgcagaggtgtgatctcggctcactgcaacctccgcctcctgggttcaagcgatttctcctgcctcagcctcccttatgagtagctgggattacaggtgc

SEQ ID NO: 19330 - DNA, 1003 bp, Homo sapiens
gcctcactcacttcctccattgttcaaagcagtaagagggttcagtctttggaaaggaagcatttactggctatttgaagagattgatttcagaaattgagcatcataactaaatctgattgttttgaaaggatttactacttttcattactttcatcccagtgttcaataaaaataggaaaagaaaggaaaggtgtccccagaaaggggcagccagcaccctggcttccagtaccttcagcagcgttgtcctgtggccatggattggcttgccgatgagcagtggttcctcccagactcctccctcagggcccttcctcttgtgcagctgctgtttgtccctggaccctgtgagtggagtccgcagcattggctgtgacaggcattcctcgttagggctgagtcgcgttatgctgtgtgcagacgcattctgcttctctgtcatccgccaggggacactcgggtttgctgttgggaaccatgctgtgtgaactgtgaacgtcgaagtacaactgtcttttgggggccctgctttcagttcttttgtatatctacccagaaggggaactgctggatcatatgcttagtccttttgtaatttgttgaggaatcgtcacactgtttttttttggcagttgcaccattatatgttcccaccagcaatgcacgaggattcctgtttctccacaagctcacctgccccctggttccctgtgaggtgctggagactggcagcaagtgtcctgtccccgggacacgtggtgagcacagtccctgactgcccttccttcatggtgtgacttttatcagcagatttgacagatgagaggtgaatcctgggtgtgttgaagctgactcaccccgcccccaaccccactcatcttcgaaggtgtgttgtagctctggccgagcctacctctgagcagtgcccctagatggctccaccttccttacactgtccctcctacagactcatcctcatccccaccactgccctttggct

SEQ ID NO: 19331 - DNA, 1160 bp, Homo sapiens
gagaacaaaggaaggaggaagtaatttgtggaatgctgagaaaggtaaaaacaccttcaactaaggaagaggaacaggccgtgacctaatgcttgcttcgaccagtataagcatgccagggcagatacttaggctaaattgtgggagctaagaacataaagtacattgatttctttattaaggctagcagatatttaggaatgtcagcacaggtctttgaataaatgttgcttttaagagaagttactatttatttttaattagatggggaggaaagtctttgaagaggaacttctactttttacacagctgagatgtgtgctccgcccagtatctctggtgctggacacatgggttcagtcacgtgggattgagtcttgtcccttccggcttcagtgctgttcacttcattctgtagctgtgcaatttaggtttgggtctagatggaactttcgtgcactctctccagctcaggttttggttctgcttccagtcagcaaggactgcgggctgtgcaaggtgtcgtgaggtttcactcaggcagacagaggagcactcttcatccctagcagtgggagctgcttacgctgagatcccgaaaagcatatgtgccgttcagtttgtccagtggttgtttcagaaggggaagaagaaggcagttggtatttcagaagaataaaacaaaaatcccctaatccactcacatttgttaagccacatgtcagattgggtaaataattgtatctcatgttgaaacttgcatcttttacaaaactttcagtgcatttaatgaaacgtatctgaggagcacttgagggttagtcttgccccctcccataaattcagggtcctcctgcctggagccactctcacaagcccctggccgcccatccagggtgttgcaaggctgtgccagctcataccccattgctgccccgtctgacctttactgtccctctgacaggcatgctgttttgaaggtcttatctagagtgcggattttttttgtttgttttgtttttaaatgtttagggttaattttcccaagcttaaatctttttactttgtacttctcccttagtccttagagacatttatctttgtaacttgtgatccttaagcttgaaagtgatatttctgggtggtgatcttctactgat

SEQ ID NO: 19332 - DNA, 1090 bp, Homo sapiens
aagtgggacttggtgtacccatagcacacattcaagagagctgctttgttagggccaagtcatggatggtgtccagttgactgtgccgcacctctgtctagacatgtctcagcaccctcatgacagatacaggaaacagctcgggttagccaaggcaagatggcagccttttcaacaagagtctgctgatttcagcgagtggaaaccagctgatcgtgaaaactgggtttctcacagcgagacaccatctcacaccagtcagcatggctgttacgaaaaggttaaaaaataacagatgctggcgagtctgtggattaaagggagcacttatacactgttggcaggagtgtaaattagttcaaccctgtggaaagcagtatggcgattcctctaagagctaaaaccagaactaccatttgacccagcagtctcattactgggtatatacccagaggaatagaaaccattctaccataaagacacatgcgggcgaatgtccattgcagcaccattcacagaagaagacatggaatccacatgagcatctatcagtgacggattggataaagaaaatgtggtgcatatacaccgtggaatactgtgcagccatgaaaaagaatgagatcatgtcttttttttttttttttttttttgagatggagtctcactttgtcacccaggctagagtgcagtggcgccattttagctcactgcaacctccaccttccaggttcaagtgatcagatcatgtcttttgtggaacatggatagagcctggaggcccttatccttaacaaaccaatgcagggacagaaaaccaaatactgcgtgttgtcacttatgaatgggaacgaaatgatgagaacacgtggacacagagagggaccagcagacactggggtctgcttgagggttgggggtggaggagggagaggaacagaaaaaataactgttgggtactgggcttaacacctgggtgatgaaatagtctgttcaacaaaccctgatgacacaagtttacctacgtaacaaacctgcaacccgaacctaaaacaaagttaaaaaaaacgttgggtttctgcggagagac

SEQ ID NO: 19333 - DNA, 1156 bp, Homo sapiens
ggcaggtaccgggcacgcctgtctccccttctggactgcactgtggctcacagctccttccagaaacatcttctcatcctcagagctgccacatagttgggcacaggcccacactaaagtgcaggctggccacccctggacatgggctcccctcgcctgagtcctgagaagaagcagctccaccccagctccagggcagggaggggcgtggggaagaatgcaaagagcattttactgagtctgatccttttccagttgaacagcagtgtgtcttcttcctgccatgcctgagattcttcctcagtgagagctctgaagccagaaggtttgcgttctcgttactggatggtcttggcctggctcttcctgaaggggccaggcccccagcctctctgagcttccatcctgcagctggggtttgaggtgggctgggccccccgtgtttggtttttgtttgttttcttctgagataaccatagatgacatgagatgtaagaaagaacagggagcagtcccttgtacacattgccaagcttccccagtggtggcattttgcacactgaacagtatcacccctagggtgtatatcggcattgatgaaaccctctggtcttagacagctgtttcacccttacttggaaagggtattgagttctgtacagttgatcacagatgcagatgcctgtgtcccacagtcgggaccttaaaacccttgcgtcaccacaaggacccccctggttgtccttctgtgaccgcaccccctccctttccaggatcctctttccaccctggcaaccactagtcttgttttctgtctgtggatttatctgcctattccagacgttcatgtgaaggacaatctgtgggcctttgtgtctgatacggcagagctttgtgctgttgcggcgcacccatgctgcggcagagcttggtgccgtggaggcgcacccttgctgcagcaggcatcagagcacagccctccctgtggcagggtcatgcgggtcatgcacccatcagctgatggacacctgaatggtctctgtttggccctttgcagcgctgctgtgaacacagacctgcgagtgtcgtggagacgtgtgggcatttctcgggcgtacctaggtgtaggtcgctgcactgccttttgtttggagac

SEQ ID NO: 19334 - DNA, 1052 bp, Homo sapiens
tagctcacacacacagcggccggcagaggccatcggctctgaattctctcacagagcagggcttgacaggctttttctgtactgggccgattagtggtattttaggcttttctggatgtacagttcctgttgtatcgttcagctctgcccatgtagaacagaagtagtcatagattttatgtaaacaggtgagtgtgattattattattattattttttttacaaaaacacatggtgagccataactcgctgacctcggctctctagtaatattttttaagtgaagagaattactaggttcaataagcataaaatctcattgatttctatgaaaatactgtaaatctttgaagtctgatattaatgtttttaaaaagaattgccgtgaataaaggatctctttaagggatgtcatggggagaggggagggtgaagaaaatcaccagtaaaactattgatcatttttgtctcgggttaacacccctctctgcgggcctcacacttgcgtgttgtctccactctggctttgcagaagtgcggagctcctgtcctgcaggtattgtggtcgtcagacccttctggagatgtcgagtgggccagggccccagcccgcttggtggtcactcctgatgaccctgtcccgtgtggaccgcctgccaagactcaggccccacctctgtgtcaagtgcaattaatagcagctctaactaaaagtaagaataaggttctaccaatcttgtaaccctacacaggcgtctgtcaggtgtccctgggtgctgggttcttgggggatcccaggtaggtgtgggaggggtgtcgtgtgcatgcctcccgcgtggggttgtgtctgcagcgtttctgcaggtcttccttatgcatcagcgagagttacatgatgttttcatttcgtgaagtaaagcagctcgtgggaatgtgaacttccgacgtcagcctcagtcacatgccgatgttttctctcgaatcgctggtgtctggtactgctatgagccatatttagcctccccttgcagccgtccactcagcagaactgg

SEQ ID NO: 19335 - DNA, 1068 bp, Homo sapiens
atcaatggaagcagtccggaaaaaggggttctttccagccttgttgcaaaaccaaatacctggcagctggtgtttatcttttcccttcaaggttctgaggtaggcagctttatagataaaggcagtccttatcataaaccctactgcatttgcacaaaacagtagcattagcttatcccttcttgccttctatcccagtgctcgcttctctttcttactaacaaatgttcttacaggatttttttcgccagaataggggagtttcacctgcattcaaaacctgttcaggcagggccaggcgtggtggcgcacgcctgtaatcccagcacttagggaggccaaggtgggtggatcgcttgaggtcagaagtttgagaccagcctggccaacatggtgaaaccctcgtctctgctaaaaatacaaaaattagccgggcatggtggtgggcgcctgtggtcccagctacttgggaggctgaggcaggagaatagcttgaacccagcaggtggaagttgcagtgagctgagatcatgccactgcactccagcctgggtgacggaacaagagtctgactcaaaaaaacaaaaacaaaaccctgttcaggcacatgtcctttttcctcgatgatattcctcatggtgtctgggacctcatctgctacctcttggttggcagaagctgcttctcctgttatcttgacattgttaaagccaaacgttctaaaactgtcaaaccatcctttgctggcatccacttctccagctgcttccccttccttttactttcagttgttgtataatggcttcacttttctggaatcagactagagtctattggtatttgcctttcttatagcaatcctgcacccacacattttcatatatccgtgctgtttgggaattaattttaaagctgcgttttcagtgagataaaaaggtatttcacaaaaaaattttcaagcctgttgctgtagctgcggtgatggcttcacggatgtcctgttctttttttgtgatggcccttctgctggatttatcgattttgaaaagcatccacagcagagcacag

SEQ ID NO: 19336 - DNA, 1050 bp, Homo sapiens
cagctttcatcgttctcctcttgttggaaagcgtatcatcgcatgtaagttacttgtttggataattagaaaatcatagtgcatgttttataaactagaatgcttaccctcattttgctttttattgatgatttaatgttggggctgttacaatgtgaaaagctcttgctccttatacaataaccctaaactggtaggtgttggtgtctgggagtttcttggtgtcttgcttctaatagtctgaactcttgcttgcccttctcacccctttttttttttttttttttttttgcagcagagtctcgctctgtagcccaggctggagtgcagtggcgcattgtcgcctcactgcaacctccgcctcccgggttcaagcaattctcctgcctcagcctccccagtggctgggattaccggtgcacaccaccatgcccagcttattatttttattttttaattttcagtagaaatagggtttcgccatgttggccgggctggtctcaaactcctgatctcaaatgatccacctgcctcggcctcccaaagtgctgggatgacaggcctgagccacctcgcccagccgcccttctcatccctttttggatcgattgtttaccgtgtgctcaggggcttcactcggagccccttagaaccttgcccagcagagtgggcccacactgggaagcagggatgcgtgctccgtctgcctgcctcagctgtcctctgcccacgacctctgagctgcattgccccgtgtaggcctggtcacctttggggccggaactgcacacactccttcctcccataagccccagtgctcgtggtggttacgcagccctgctgcccgtgcaggagatgccccacgaggcctccagcttcttctctgcctttgctcacttctcttccctggaaagcaggcaggtactcgtcaggctttccttcatttatttctagagtttctgcagatctagaagcctgtctcctattggttattgtcttttaacaaagacctgtttggcattacacaaaaaatgctttcacaagtcccaa

SEQ ID NO: 19337 - DNA, 1798 bp, Homo sapiens
gcacacagctctggctgtgataggactgagtcttcaggcttctgctttatggagatgctgtttacaagtcattgtgccatctggaaggattctacagtgctattttggattgatgaaatccaacagtcaatggttttaataaaaaacttgagtagcttataagcgtgtctgcttttccacctagcagaaggtaagggagtcaagtttcctggacgagaagagatttgtgattctgtcttgactcgtgtcctgtagggtgcttttggatacactcctccccgcgggcatcttgcaggatgcaaggtcgttgcgggccactgccatccttccagagaagagccccctttcccccacaccctcatgctgtgtgccgggttctatcctccactgtccctggtgagaaaagagggcctcttgctagggaccagtggctgggtttctggcgtctccttgggtaaagggtggggcagcagggcagtgtggacggtccctggacacacgagtaacgttgggaattggtcgtgctgccctcagaagggagaattagtgcattgtctgtcttaataatcaagctttaaaaaaaaaaagtgactgatttttaacatggagtcattttttatttggtcattatgttaatggaaaacttgtagtgtggatttccattttgttttaaacttacattaaaagatgaattgttcattggaagccggtattgtattttcttaatctgtaatgactttacttaaaaacgaaaatctgaggaataggagaagccctggcatcccctttgcttctcttgcagacaaattggacccagtttgcgggcatggcggcgcacacccgtggtcccagctacctgggaggctgagcgggaggccggcttgagccagggagttctggactgctgtccgctgtgtgctaagtttggcatccgtgtggtgacctcctgggagtggggaccaccgggttgcctacggagggaacggtcacaaatggagctcttggcgagccgctggtgtctggcctaatccccggcctctggctgcgcagcggcgggggtgaggcaggcaggctctggcacggtctcactgccactcacgttagccttctgtcgtcagacgtgaaagtggtgctgagtggggttttctttgcagactgtacgtgatggactgtacctaaagtgaattcgtagttttgaaatctttaaagcatttgagtgaaatgtggaaatgcatcatcgtgagtgtgttgtgttgggaatatggtgactgtcttcttgctcactcagtagagttggagaattggtagggagcagcttgaggctctgacacagggatacccacagggtctcggtgtctctggcgcccttccctctgcccggtgctggcttgtggacgggctcagtctgctctgccatagaaaaccatttctgtctgctgggtccggtggctcacgcctgtaatcccagcactttgggaggctgaagcgggtggatcacctgaggtcaggagttcgagaccagcccggccaacatggcaaaacagcgtctctactaaaaatacacaaattagttgggcatggtggcagacacctgtgcagtgagctgagacgggccattgcactccagcctgggtgacagagggagactccatctcaaacaaacaaacaaaaaaacaccatttctcaaggccgggtacagtggctcacgcctgtaatcccagcactttgggaggtggaggacctgaggtcaagagttcaagaccagcctggccaacatggtgaaatatcgtctctacta

SEQ ID NO: 19338 - DNA, 2023 bp, Homo sapiens
tccaggagggctagggaggcggggaggagcaccctgtgagctgcaggcaccgctgtgttgcagtcagcaaacactggggtctgggaacccactttcatgtttggcacctagtggtttgagcttcacttattcgtagccctcacaagtaaactagtctctattacaagcactttcttcgtgactttttggcttttgttttttgacacattttcctcatgcagatcagcatgattattcccactgtctgacatgtctcctcctattcattaaatacttagagcctgtttcatgcgagatgccatgcagagctctgccagattccagaatgaagggcaataggcccagctgggatagttcctgcatgtttccatcggcccggctgcttccccttctaacccttacaaatcctctgaggtggacgtgattactccacctaagaggaaactaggccgggcgcagtggcttcctcctgtaatcccaccactttgggaggctgaggcgggcaaatcactctgaggtcgggagttcgagaccagcctgggcaacatggtgaaaccccgtctctatttattaaaaatacaaaaaaaaaaaaaaaaaagcagctggatatggtggcacacgcctgtaatcccagctacatgggggactgaggtgggagaattgcttgaactcaggaggcagaggttgcagtgagccaatattgcgccactgtactccacctgcctgagtggtctcgcactacagagcaagcctccgtctcaaaaaaaaaaaaaataaaaataaaaaaagtaaaaaaaagaggaaactaaagtttaatgtgtacagtggactctcttggtcccagggtgggagccatgtcacctgtgggaacaggtgaatgaggctggcgtcgtgctctcaaggtatttatgatgtagcaagaaggtgccaggtcctgagggagacttccagaggctcctgtgagagaaggtatgcaggtgaagaagagggagggagaccgtgtttcctggggactgggcttgccggaggctccactgagggttagcatttgcataggccttgaataagaagtagaatgtgaagaaataggctggagtttagaaaaggaatttttggggaaacagaaagggccttggtgactgtagatcactcactcatttcagatgcaggcaggtcccaaggtggtgattagacacaagttcactctcaaaggtgctttcttatgtagttgatggagtcggttaaatgtattcccagttttcttttttcctaacctagtgtttagagaaaagcagccttgggggacttcctatccacgagtttgcttaagtgcaggttctgggtgtgccggacatcctagataccgttgtctgtgaactcaaccatgttgattgggtctgctcttgtaggctgacatccgaagtgcattacagatgctgagttgatcgttaacttctgtagctgggatctgagggacaaccaagacaggtctgcttcaacacatcacgaccatgttcttgaactgcatggaccctggagcatctcagcgtggcatcacagtgctgctcatggaaaacatgaactggcagacccattgagacattttcaaaacataaacattgtttttcttatttccatcgtttacccattgtagaaaatgtaagaaaacatgaaaagggtgaaaatctaacttaaactcccttatacaggtaatgaattttagcttcttgtgatccttcaggaatgggccatcagtgtgtttgaaatgcttgctccctggtgccgtaaagaaatagcacttgaacgtaaatttaatttcctcagcaaggccattttttataccttctgcagaaagggtacactcgcctgcagttttgccacgagagtacaccgaatgaaggagaccagggtcatttataacctgacgctgtgtccggtttttttataccaactgctgtgtccggtttccattggctggaacgggacctcacattctgtatttgtcccgattggctagcaactt

SEQ ID NO: 19339 - DNA, 1032 bp, Homo sapiens
gcttgccgtcagggttccttccacaccgacgctgctcccaggattacggagctggaaagagtccagcccattcctctggcagtacgcagcccttccctggggctcagccagtttacttggcttgcataattctttctgttaagacgctgccttaaaattgaccaagcctctaactttttagaccaggagtctcttggatcgtttgagtggtggtgttgcctgttcttggccctctttcatcttgtcctgtgcttcagcctggtcacttggtttaataatttgtctttgtttttccaaatcctgcagaacttttaagatgatctggattgcagtgacttaaaatcataccgtgatgtatttgctggtttggagatctttttaacagggggttctctcatcagctctaagtagccttggaaaaactgtcgcctctgaattggctgcaaacaaagctttaggctttccaacagtgctacagccaacctgccttaattggaaatgaggagtctggacgtttgaaaaataactcaataacctcatgtgtgtaactctcggggccatatattatggagatggctgtgtgtaattttacagcatccttgatggagcctttgtcataaaacacgactcctgtatatgaaagcagtcttcgcaggttttattgagacgaggagtggaaaatacactcgtttttccacaaaaggttgtttgtttttttttttttggagacagagttttgcttttgtcgcccaggctggagtgcagtggtgcgatactggctcactgcaacctccgcctcctgggttcaagcgattctcctgcctcagcctcccgagtagctgggattacaggtgcctgccaccacgcacagctaatttttgtattttaatagagacagggtttcaccatgttggccagtctggtcttgaactcccgacctcaggtgatctgcccgccttggcctcccaaagtgctgggattacgggcgggagccactgtgcctggcccacgagctgtttttctgatgagaag

SEQ ID NO: 19340 - DNA, 1045 bp, Homo sapiens
caattagaggagcatttccttaaaattgtacaaaccccattaatgtgtggcttcatagaagacagcagggttctcctcgctgttcctgcatcagtctgtggtaaatatgttgttctagttgaagtatacaaaaaaaaaatctagtgggaaaatggaagcatatttttaataaatagctttttgatataattatggagattttcattgatacgacaccaaaacccagcaggtgtttgtgctgtgagcgtttccagcagcaggggagtctcagggcttccctttggtctctcttgcggcgagtgcggctccgtcgcgtgtgtgtgggagtgtgcctgtgtgtccacatctggaggtgacccaggtcagcacacagtgtgcacccaagggccgattgggtgcccgggactcgtgtgcatctcccgacgtggatccacttgattttactacatcagaaagcagcacctgtctcttccagggagacttttagttcttcagaagctgtctgctcttggagttttccaaaattcttatctttgaaagcttgaattttcacattgacaacaagttgttgaggtgttctggctgaacttgcagctgtctttccttcattttttagaaatgatctgccagtactcatgtccgaacaaccagagtttgcatgtcggtcggtcattctttgactgaagattggtgcttcctgtccagaggccgctgtgtctggtgtgcggcagcagtgctttgtgcatacttgttttgtcatgaaggatatgcacaagatgaatgctgcgtgctcgggacgtagtgcgttgaaacagtcttgccgcaccaccccagcagtcctccagtgaactggctcatcagtgcggtgtcacccagctgagaaggcattgttattaagcaggtagttttacacctgggaagcaagtgtaccaagctattcagtctgtgtgctgggtgagaaaatgttgttgaatgaatcaggtcagtctgtgtgcttattgacaacttttcaaacatttcacacccttagaagagtctgtatcac

SEQ ID NO: 19341 - DNA, 2027 bp, Homo sapiens
aagggcctggggaggcagcccagtgttgctggggcttcctgcttttatctcgttgtctctttctttaaacctctggccatatcatctattcatcttttccttttaatttttttttctttttccccccgtgttccttatataaaaatatgagtctttttctgtcagtcctttgctgatgttcctcgtgtgccttcttaggtcattcttttctgtctgcgtgttcttttttttttatctttttgagacggggtttcgctcttgttgcccaggctggagtgcagtggcacgtctcaactcaccgcctcctccgcctcccgagtacctgggcttcaccagcctcagcctcccgagtacctggggttacagatgcctgccaccatgtccggctaattttttgtgtttttagtagagacagggtttcaccatattgtccaggctggtctcaaactcctgacctcaagtgatctgctcccccttcccctggcctcccaaagtgctgggattatgggcgtgagccaccacgtccggcctgatgttcttaatgttgctgatttgtctcctgttcccttttccttttccccttccatattccacagctgtcctttctgctgcctcccggagggcaccctgtcctggacacaaggctttgtcctgtgctgtgggtcatgcttggtgggatcgcttatcagcgtgaaggaggcactgaggtccatcttcttcagaagtctgtccttccttcctccaggcagatgccggcatcacagtcctggttaactaaaaccctgtgtctgatgtcctgccctgggccttccttgtctcttttctgtccccacccagaccataagcactggggaagcacatctgtcttcctcgctgcagcctctggtgcctgtgtgtctgcgtgctgacaccgggcatggccaacgaacatgttgtcttgtcacggtgcacggtggctcctttgcccgtgcggccttctcagcagctgctgcttctcctctaggactgaccgcaagtctcagagcgcgccggctggtgttttgtcgccctcaggagtgtggccgaggcccaggtgtgggtttcccgtgcccgccgtgacctggcagtgagggtctgtgcttctgtcagtgccgttggcctgagacatgtctgtcctggagaccagcacgtgtgggtgccgactctcagagagccccttgctcacagcaccaaaccccttgctgtgtttttattattaagaaatagaaaacaaagggcataaccagacttaggactttggtgattttctggctgaaggttttttttttttttttttttgagatggaatctccctttgtcacccaggctggagtgcagttatgcgatcttggttcactgcagcctctgccttcggggttcaggtgattctcccacctcagcctcctgagtagccgagattgcaggtgtgtgccaccacgcccggtaagtttttgtctttttagtagagacggggctttaccatgttggccagactgctctcgaactcctgtcctcaggtgatctgccggcgttggctcccaaagtgctgggattattcttgctggagctaagttgggattgactgcagtgcatcctttgtgaggagcgctgggggaaggtgtgaggaatttgacccctaagccccagggtctggctggaaggaggagcttcgtggacaggccttgaggacgctttggtgcatttcctgaattgtccctgtgagaacatgccttatctgcagcagtcaggaaggctgataggaaagttacctagaaagccgggcatggcggctcaggcctgtaatcccagcactttgggaggctgaggcgggaggattgctgcaacccaggagttcgagaccagcccggacaacatagtgagaaccctgtctctaccaaaaaaaaaaaaaaaaaaaaatgagccaggtgtggtggcacgtgcctgtagtcacagctagttggggaagccgaggtgggaggatcgcctgagcccaggaggtcgaggctacg

SEQ ID NO: 19342 - DNA, 1024 bp, Homo sapiens
tgggcatgggaaaataagggaaatgagaagcgagggttctttgtaaatccaaggatgctttcatagcttttggtatcgttgacgttttgctaaatggatgatttatttattaggaaaaataaaactgggattcttgttcatatctgatggtgtcagcacgtcagcaggatagcaactgctttagggacctgcttgtgtctggagggcagaaccagagcagtaagcagagggcagagggtggcctttgtagcccgggggcaggtgtttcccttccgtggctctgcgtggttcctgacagcctcagctctgcagggtgtcttagtctggtctgagggctaagaccatcactcccaacaccagtgtccatgagtctttttctgtttattatctccatttccttggtacagtcagcctttgtttaaaatttattcttgcttgttttttgttagtgggaaaagtttctaaatatcaaatcctggtggcttactaactacagcttttggggatgggcttggtgatgatgttatgaggctttaggtgacactcaaagggccgtacccaccgggttggcatctgtgaggtgcctgctccgtgtgaaattctgccctgtagctgaacagcaaactgtgttttaaatttagattgaggctggacgcggtggctcacgcctgtaatcccagcactttgggaggccgaggcgggcggatcacgaggtcaggagatcgagaccatcctggctcacaccgtgaaaacccgtctctactaaaaatacaaaaaattagccgggcgtggtggcgggcgcctgtagtcccagctactcaggaggctgaggcaggagaatggcgtgaacccgggaggcggagcttgcagtgagttgagattgtgccactacactccagcctgggcgacagagcgagactcccatctcaaaaaataaataaataaataaataaatttagattgaaattgagaagtgagcagaaagatgccagtttagatgtgatcagattttgttaaagaaatc

SEQ ID NO: 19343 - DNA, 1044 bp, Homo sapiens
gtacctggctgaggggagggatggggcacggccaggagactctgggaggcatctcagcccagtacctggctgaggggagggatggggcacggccaggagactctgggaggcatctcagcccagtagctggctgaggggagggatggggcacggccaggagactctgggagacatctcagcccagtacctggctgaggggagggatggggcacggccaggagactctgggaggcatctcagcccagtacctggctgaggggagggatggggcacggccaggagactctgggaggcatctcaccccagtacctggctgaggggagggatggaacatggccaggagactctgggaggcatcttcgttactggccattggattcctcaagttctgctgagaattctagtctctttttttccccactctagaataaggatcttaattatttatttgtgttgtccattgggaaaaatgatttgggatgtgcttactgtcaacaaggggatagtggtgggttccgaatgtaaactggccgtaatcccagcactctgggaggctgaggtgggaggattgcctgaggtcaggagttcgagaccagcctgggcaacgtggcaagaccccatctctccaaaaaatacaaaaattagccaggcgtggttgtgtgtgcctgtcgtcatggttactcaggaggttgaggtaggaggatctcttgagctcgggaggcagaggttgtagtgagctatgatcacaccactgcactccagctctaggtgacagaaggattacaagaaaaagaaaaaaggaagaaatgtagaccatctcgacagcaagatgtgtagcgtctggcccagccagggcagcctgctcctcttccggtgcagtcaaggtttcccaccgctgtgtgcagggattctgaaggcagtgctggctgctggcacagggctgcaagtttgaaagagaagtagagcaaaaaggtccctgggcccccgtggtggcaccagcacacacgagaggggatgtggtggagggcaccgtcatggaggcgt

SEQ ID NO: 19344 - DNA, 1078 bp, Homo sapiens
gtttcttacgtataaaaagccccagagcctctaaaatctggttttatggtgatttcacaagattgtatcagtgtcatctactcttttttgtgctggactttggatttacctttaagttgttgcaattgctgcattgtgacgtaaaggtatttgatgaatgaagttaagttttggccttggcacagtgaccaggagctgagcagtgggtcatgggagaggaagggcgatggaataaaccgtgtggaccaaatggagggagacgagagcgatgaaagaactgaggctgaaattattattgacatgagctaatctcactctcttgtttcagaatatatacagccctgctctgggacacacctccattggatttaaaagacagtcctcgtcagcactgactttcagctatggaatcggtaaatactcactgcattctctatcaatttatgtttttgtcattgatttgtaaaaataagtatcaaaataatgcgtgagtgtccaggttggttttcttggacttgatagagttttgtcgaaatgttgtgaattttgttctggatttcacttagagtgtattcagagtggtaacaggtaagcatttttggattaatgaatgggatccttggtgtcacagtgagaagaaatctgctgaaaaattaaataggttgttaatagcctataaaagaagtttatttcctcttgtcctcctttaattttcttcatcctcagatggtctggtgatgactgagacccccaccctgtgctgtgtgttgtgtgctctgagcatgttgtgttaacagtttgcgtgaggattctgtatcctgggagctgttctgctcgttaggatcctggtggtcttgcctggttgtccttggatgaggattctgtatcctgggagctgttctgctcgttaggatcctggtggtcttgctgggttgtccttggatgaggattctgtatcctgggagctgttgtgctcttgttaggttcctggtggtctcgccgggctgtcctgtgcttctgggcatagtgctgttgctgaaccctctagatggctattctggcttttcctaggagctgg

SEQ ID NO: 19345 - DNA, 1035 bp, Homo sapiens
aaagtgctgggattataggtgtgagccactgcgcccagccaggaagcaagatttttaatggcagtcttgcaagatcaggtgcctggtaggcaggtacacccggggcagtcacagcaggtagtttatctcctctaatgcaagtccctcccccagttcctcactggtcgagtactatggggttacaatcttcccggaggtcgcctgagtttcattatcccgttgtacgccgtccccttacccgcttacaaggttgtaccctgtcctcttacccgcttaagttttgatttcccaatactgaaactttcttcccatttatgggctgacccctcttctacattttgttcgcttattgtgaccttctaggtgcacgagccgtgcggtttgttacatccgcaggctggctgccattgcgtagatttatcatgcctggaaaacggaccatttaaaacgttttcttacaccatcgaagcacatctgggctgattccagtttctggtgcttatgaataaaacagctgtgaacaactgagtggagtttattggaccatttttgacctctagtaatggtgggctcacatgtttgagttgagttgggtcaggtgctgagtgcctgctgctgcaggcaccaccttgtgctttcaggttaactctaaccacacatctcatgccttctctgtgcatgtatttgaagttactgaaaaagtatttgtcaagaaagccacagctccgcactagtctcttaaaacccatccgtatgctcctgtactcatgaaaggaatgcactgcgggccgttctgtgggaagcagggaaaagacagacctggccctgagacaggctggtgtgactgccgttcggagcccagggttaatggtgctggttagtcagccagtgtcgggggcagatgcccatcgtcagtggctcccctgtggaccctcccacccagcctaacgcgaatgaaaatcattgtttgcataaggtcatagctctggctagcagcgttttgagaccaaggccagtgtagggacctgtctttgc

SEQ ID NO: 19346 - DNA, 1030 bp, Homo sapiens
tgtggctggtggcactgtcattgtgtgtccagggtcctgccacaaggatctcagggcttcacttcacagcccttgatggcctggcagccagaattgagtctgtgggttttttttggtttttgtttttgtttgagacgggggctcgctctgtcacccaggctggagtgcagtggcatgatcacagctcactgccacctctgcctgttgagcttaagtgacctttccttcttagcctccctgtcagctgggagtacagatgcttgccaccacacccggataagttttgtgttttttgtagagatggggttttgctatgttgaccaggctggtctcgaactccagggctcaagcgatctgcctgtctgggcctcccaaagtgctgggattaggggcgtgagccactgcgcccgtccacctcagtgttaaactgtttagatgcagctgtcacagaagctttaggagaacctcatctgttttcatattagaagctgttttcttgttctcgacactctgtatcccaatagctcattcatggaaaacacacccaattagggactgatcaaggattttctacccactgccttcatgaaatgcaattggaagtcctttttaaacagttttttttttttaaagatggtggttctaagtgtggatccatctgaagaacaaaacaaagcttcatattctcttaggcaggaacatatactaggctggtttttttttttttttttttaacaaaaaatttttttttttgtttttgtttttgagacggagtttcgctcttgttgcccaggccagagtgcaatggcacgatctccgctcaccacaatgtctgcctcttgggttcaagtgattctcctgcctcagcctcctgagtagctgggattacaggcatgcaccacctggctaattttgtatttttagtagagacggggtttctccatgtgggtcaggctggtctcgaactcctgacctcaggtgatctgcctgcctcagcctcccaaagtgctgggactataggcgtgagcca

SEQ ID NO: 19347 - DNA, 1073 bp, Homo sapiens
tctgtgtgctccatgtaggtccactcagacagtcttgggaactcccgaggtgcgggtgctcctctgccccttgtggcagagataagtcagttgaggcacaaggaagttgggccacttgcccagggaagttagaagttgggagtggacgccagcactggaccctgggcaggctggctccagagtcctgcctcgaattcacaagttctgtctccagtcatgttttacttcctgttctccttcatgtaatacttcctgttcttcttcttggacaggtcagtggcatccggtctcttttgtttgccgctgtgtcttcagcacatcacattgtcctgagtgtcctgtgcttgtattttcccatatgttttttcgtgcttgaacagatgctttgtgcttttatttaaataacatctgtcttgcctcctttctgttagccacactttttaaagtatgcaatacaagtgatggtcagctggcaagcagctttgtcctaggggacaccttagcaggcaggacgtgttcctgtgaaacgtggtttggcttgtaatagtgtctgggaaggaagagaattctgtcttgtcctacttaaattagtactttaacttagttgaaattcctattagaaattttgaggaaacttccataaggaaatgtgtgttctccaagggattcctcttccattttaagttggaagttgttataaacatggttattgacctcgaacaataattttcttatttctgggttttgaaacgttgatgtaagcaactgaaacaaaatttaatgtcagagaagtagtgagtatctaagaaatgcacttaatccctgaagggcagggcaataaaaacaaaaaggagccaagatatttatcttgttaaatactattatgaaaacggcaacaacaacaacaaaaaagaaatgtgcttcagatgttctgtgcagccgggcgtggtggcttacatctgtcatcccagcactttgggaggccgagtcaggaggattgtttgagcccaggagtttgacaccagcctgggcaacataaggaggccctgtctctatttagaaaataaaataaa

SEQ ID NO: 19348 - DNA, 1070 bp, Homo sapiens
cagttctctggtattagattcacacggtgcaaagccatcaccaccatccctctccagaacttggtcttcccagacgacaccggctacccattaacactaactcttcatccctctccccataacctcgactctccccataacccctgaccaccaatctgctttctcttatgaatgtcaccactcaaggcacctctcctataaggggggggggggggtcatacgatatttgtcctttcttctcttatgaatgtcaccactcaaggtgcgtctcctatgggagggggtcatacgatatttgtcctttcttctcttatgaatgtcaccactcaaggtgcgtctcctgcgggggggtggtcatacgatatttgtcctttcttctgttatgaatgtcaccactcaaggtgcgtctcctgttgggggggggggtcatacgatatttgtcctttcttctcttatgaatgtcactgtccaaggcacctctcctgtaaggggtggggggtcatacaatatttgtcctttcgtgactggcatatttcccttttggatcagtttgttcctgtgggtcagaatcttcatttgaacagtttgccccacagctcagattcctcaattgtgactaccccctgcaggtcaaattcaatttttgtttacttatttttgagacagagtcttgctgtcttgctcgggctggagtgcagtggtgtgatcgtggatcactatagcctcgacctcctgggctcaaacaacccgcctgcttcaaccttccatagtgctgagattacatgcgtgagctgctgtgcccagtgtcaaatttaatttttgttttgttttgtttttgagacagaatctcgctctgtcaccaaggctggagtgcaatggcactatcttggctcactgcatcccccacctcccaagttcaagcaattttcctgcttcagcctcctgagtagctgggattacaggcacctggcaccacgcccggctaattttttgtatttttagtggagacggggttttgccatattggccaggctggtcttgaactcctgacctcaggacatttataggat

SEQ ID NO: 19349 - DNA, 1927 bp, Homo sapiens
agcaggtgggggctcgttgcttgtagggggtgggctgcatgcgctctggtgtttacctggtgtgcctgagcccacggccagtgcagcaggttctgccagcatctttttctgggcagcttgttgagtttatgacacaatctccttttactggtccctgttgtgattggcaccctgaccttttagaaagtgtgatggtggccaggcgcggtggctcacgcctgtaattccagcactttgggaggccgaggcgggcagatcatgaggtcaggagatcaagaccatcctggctaacacggtgaaaccccatctctactaaaaatacaaaaaattagccgggcatggtggcgggcgcctgcagtcccagctactcgggaggctgaggcaggagaatggcgtgaactcaggaggtggagcttgcagttagctgagatcgtgtcactgcactccagcctgggcgacagagcgagactccgactccgtctcaaaaaataacaaaaacaagaaagtgtgatggtggctgtggagcagaggagtcttctttagctcgtccacgtgacgtgcaggagtacatgggagtcgtgtgctggtggacacacagaagcgactttttcctttgtctcatggtggaatgctggaggagcaagtgttcccacctgctgagcagctgaaagcaggctttccgcggatgtgtgcgggcgggcggtgtggcacagaaaggcctcgatggactgtctgctcttcacggcaagagtgtgctgcccctgttctctgtcgtggcctctgctgtaaagatgagagaagtccaacgccagtctaattcatgattcttttttagttaagctttttaggattttgtggaaacttgtaggattttctgttgatatgtgggagtctgacattttgctatttttagggtttagattgtgacttttttatattggttagcatcttgaagctcttttaatatgcagacttgtctttttaactccatctcagtttttctgtcaagggccagttagaccttgtggccgcatgttctctgacagctcttcagctctgctgttgtatcatggaaggaaccggggccacacttaaaacgagcctggctgttttccagttacaactattactaacactgaaattagaatttcatataattttcacttaccacaaaatgttattttctttttcaaccaggtataaatataaacctcattcttagcctgtggactgtctaaaaaagacattgggccagattcggcccctgacccccaggtggtttccccatcatagtaatcatagtagatgaacttggaactgtgtagctttattggtttttcatccttgaagcttgcttttcctctgcagtggtcctgactttctgtagagtttgatctctgcggcttcttccttctgtagagtttggtctctgttttctctaaacttaagttatttgtctgatttcatttactttctgttaatttaggtgcttaattctggtcaactattgacatgtcattcttctgttttccagtgctgttacagatttattcttttctttttttctttttcttttcttttcttttttttttttttttaagatggagtctcactctgtcgcccaggctggagtgcagtgttgcgatcttggctcactacagcctccacctcccaggttcaagcgattctcgtgcctcagcctcctgagtagctgggattacaggtgtctgaccccacgcccagctaattttttgtatttttagtagagatgaggtttcaccatgttggcctggctggtcttgaactcctgacctcgtgatctgcctgcctcggcctcccaaagtgctgggattacaggcgtgagccaccacgctctgccagatttattcttttcaaaatgtttgttactttaagaaattttagataa

SEQ ID NO: 19350 - DNA, 1057 bp, Homo sapiens
atgcacatattaatagatacctaattaatatttggttggaaatcttaaaagttaggattttttttttctttttttttgagatggagtctcactctgtcgcccaggctggagtgcagtggtgtgatctcggctcactgcaacctccgcctcctgggttcacgcgattctcctgcctcagcctcccgagtagctgggactacaggcacccaccaccaggctcggctaatttttttgtatttttaatagagtcagggtttcgccatgttagccagaatggtctcaatctcctgaccttgtgatccacccgccttggcctctcaaagtgctgggattacaggcgtcagccatcacgcctggcctaaaagttaggatttttaaaaaggcttgtggtctgagaaggaaggcaataatacttggcaggaaagacttaattttttttttttgagactgagtcttgctctgttgcccaggctggagtgcaatgacacgatctcagctcactgcaacctctgcctctcgggttcaagcatttctcctgcctcagcctcccgagtagctgggattagaggtgtgtgccatcacgcccggctagtttttttttttttttttttgagatggagtctcgctctgtcacccaggctggagtgcagtggcacaatctcggctcactgcaagctccgactcccaggttcatgccattctcctgcctcagcctcccgagtggttgggactacaggcacctgccaccacccccggctaattttttgtatttttagtggagatggggtctcaccgtgttagccaggatggtctcaatctcctgaactcgtgatccgccccctcggcctcccaaagtgctgggattacaggtgtgagccactgcgtctggcctttttaaaatttaatttaattttttttgggggcggagtttcgctctgttgcccaggctggagtgcagtggtgtgatctcagctcactgcaacctccgcctcctgggttcaaatgattctcttgcctcagcctccagaatagctgggattacaggcatgtgctacca

SEQ ID NO: 19351 - DNA, 1046 bp, Homo sapiens
gcctcagcctcccgagtagctgggactacaggcccataccaccactcccagttagtgtttttttttttttttttttaaagtagagatggggtttccccatgttggtcaggctggtctggaacccctgacctcaggtgatccagccgtcttggcctcccaaagtgctgggattacaggtgtgaactaccgcgcctagccagaaaccccacagtgctaaagctggctctgtgaataaagggttaagagggttttcagtgtgaaaataaaagtaagccgtcctgtctgtatggctgagatttttcaggggcctagaggaccgaatcctgttgagtgaaaatccagtcttctgggcttccccacacccgctttctctcttcctcttggaggtcaaggttgagacagctgtcagggtgctgctgtctcagttacagcgtccttgtggctggtggagggtgagacctgtttccaggcctgtccttcgcatctgtgcagtgaattatttattatcctggaaatctgtagggctcttttttccacgtgtaaagcaaccaatgtgtacctgttcattatttgaaaatgttggctttttctcaacaaaccatttttataccatatgaaaatttcttttgtcatggtaaaattcagaagactttccccttcattacttaactctaaaaaatgtgacttttaagaatggctgaaattgaaatgttatttgtaaatgcctaataactttatgatatcagaggttattttttatgtaaaattagcaaataaacctcttttcttggtgcattgatagtaagttgcccttcctcgactccctatggctcttttcagacttaggatgctaatggcttagaataaattttggaatgcagtatttccaagtaaagggaagattgcgtaggctgcttggttcctgaggttttactagagttaggattagcttactgctgcattcatatctgacacaatcaaagaagactttggtttaattctggatgatgatgtaaacttgaaatcattatggctgtactgtttaa

SEQ ID NO: 19352 - DNA, 1014 bp, Homo sapiens
tcccaagtagctgggattacagacacctcctaccaaacacggctaatttttttttattgttagtagagactggagtttcaccatgttggccaggctggtttcaaactcctgacctcaagtgatccacctgcctcggcctcccaaagtgctgggattatagacgtgagccaccatgcctggcctcaaatgttatttttatgataacgtcccaaatggtgactgtggcctaactctgataccatgccccattcttgaccctgccccaagcttccagtcattctggctgcgttggccttgcctttcctcagttgggccatgtgccatagtttgtggcatggcctcgacatacctcgctgccatctcatgcagatccccccaaactccaagataactcctactcagcctttgcgtcttagtgtaatatcacttcctttagtaagtcttttttttttttttttgaggcagggtctcggtgtgttgctcaggctggagggcagcggccagttgcgtgaacgtggctctcttcagtctcgactccctgagctgaagcgatcctcccacctcagactcctgagtagctgggaccacaggcatgtgccgccgtgcccagctaatttattttactttttgtagaaacagggtcttcctgtgttgtgtaggcctcagccttctggggttggcttacctcagtctcctaaagtgttgggattataggcatgagccactgtgctcagcccccttttgttttcattacaagtttgcttttataacttagataaaggtgggaagacagttttcacaattaaggcagaacaagagataaagaaacataaagggagagttgtctttgtgggaagaaagtgctttctgtgaaagcacttttagcaggactgctgttttcaggccagagtagaagggccagaagcagtttttattcagatttcctcatcgtttccatcaaggtctcagtgactgtaaaggatgggttgaaatcagtctggactaagtgtggtt

SEQ ID NO: 19353 - DNA, 1073 bp, Homo sapiens
tgctgaggactaataaagtctgtggtaaaagcatgactggctgctgagagaatggactctagagaggccagaggtgggaatgtgaggccagggaggagggaggcttttgcagcagtgccagaaggtaaggatcctggcaggaccgaggcatggggctggttctcccagaggatccagtaaagcctggggtgtcttggtgcccactctgggctgcgttctctgatctgcagcgccaggaagagagaagccagcagaggccagcatgtggctgctggtggcccagctgctgagggcgatgagggtgagtctccagaccggcctctgaaacgccaggacagggccgcagacaccaggctcagtgtggacatggagcaggaggagggctttctttttgttgtaacttaaagggctggtttgacaaggaacaggtggtcatttcatttttttttttttttgagatggagtcttgctctattgcccaggctggagtgcagtggctcaatctcggctcactgcaagctccgtctcccgggtcacgccattctcatctcagcctcccgagtagctggggctacaggcgcctgccagcacgcccggctaatttttttctatttttagtagagatggggtttcaccgtgttagccaggatggtctcgatctcctgacctcctgatccacccgcctctgcctcccaaagtcctgggattacaggcgtgagccaccgtacccagctacaggtagtcatttctacataaaatccgaaccccggctggcccacttcagacctcctcacctcgcggacccatggacaaacagaaccacatgagtggacttgggctggtgctgggattttcctggggtgctttcagcagccttccagagaccagcatgcctttctggtttctggaacgctcagtgagctttggctggggagcacaagggctgatcaggttaagttcaagattatctggagatggacaggtacttttgctttatacacaccttgaaaccttgaacgaaagcatgcagtttgggtttaccatccccgtccctgctgtgtattttttttttt

SEQ ID NO: 19354 - DNA, 1047 bp, Homo sapiens
cctcacctcccacccagctgagcagcctgtgattcaaatgctcaaaggaagccaggtggccactccgagcggctgtgcctggggaggggcctctccaccgcagtgaggctgggctctgggaaacggtctggacagtgtgggtggtgagggtccctgccccccgtgcagagatcagcaccttttcttagggtcgtacatgaacaggaagtgcagcaggcgcagcccggcctccgacagccatgggaacttgtgcttcaggttgttgtagggctgcttccggaggctgtactggccgaccagtggcagcttggaaaagccctatgggaggcaggagctgaggcgcagagggcgtgggcacgggcgggggctgcgggcgcagagggcgtgggcacgggcgggggctgcgggcgcagagggcgtgggcacgggcgggggctgcgggtctgcccaggacgcccaccggccagatgttctcactgggcgtgcccagcagctgcacgatcaagtcgatctggtggatctcggaagtgccggggagaagaggcctgtgcgccagcagctcggccagtatgcagcccacagccctgcagagaacagtggacctcactgcggccagacgtctgctgaccccgccagcgcgaggaacagaggacctgactgcagccagacctttgctgaccctgccagtgtgaggcacgctgggtcagggacactgtgaaggacaggcagggaccactggctcccctcctgggccccgcaggcctcccggggtgacaagtgcaggggcaggcgtgcctcctccagacctctgtgctcccagcctgagaacagcaagctaagttctcacacctcctcctgggtttccaggctcaggcccacctccctgggagtgggaggctggcaaagaccccactgcactcctgcccctcccctgaggctgagctcaggaaccaggtgacccggctcctgtcccagcccttcctgaggccccaggagcggtaaccgtatctcctcaccacatgtcgatgctggtggtctgcgtggtgg

SEQ ID NO: 19355 - DNA, 1137 bp, Homo sapiens
gggtggtctcaatctcctgacctcgtgatccacttgccttggcctcccaaagtgctggcattacaggcgtgagccaccgcgcctggccaggttgcccaatttcggttgttattcctttatttaagaaacatttactgagctcctaccatgtggcagacaattctagagtgttctagaagcagggagtatagaggggaataaacaagcctgcccatatggcacctttgtatcaatgagggcagatgtggcacgtataaggcacccacttagacttcaccctaccctggctgggctatggctgctgtccgggagctgtacacctgtgtccaggccctggcaacacacaggtagatacagaagtggattaaaggtaggaatgagccctggagataacagacagggccgtgtgagaggaaatgaccaggcaggagcagaggctggtgtggagcaggtggtgcagactttgaggagtgatgccagccttgacttgggggcaccaagaagtgggtaaatgaagcagtgaacccccatgagtcccagggctgatgactgagaccatttgagactatttgagaggccagatgtgctgttctgggcataggagtagggagcccagaggaccgttgggtttaagggtgtggagtttagggtggaggtcagggagaggggaatgtggtcactgcagatatggagtatcctggtgggtatatgggcctcagggtgcctgccacacctagactcaggagagggttggcaacagccaccctgtgctcctcgtccttccggccatcaggggccttccaggcacatgcagcactgtcgcctgcacctggatcctggtatcagattctggatgaaaccaatggaagtaataggaaaaggaaaacataggggccacaaaaagaaaactcgctgctgcctgcggcaaaacacgtgctgatggttcaggtcgtgccaagcccgctctgcaggcgcttccttcactcacccccgtttctcctcccggctgctctctggggtggagtctaaggaggaggtcagagggaggggcttgtctgctgcatgaggtcatgctgcatcaggtcaccgctgcgtggaagttgtgttgagatgtgttgcgggattttctttcttttc

SEQ ID NO: 19356 - DNA, 1034 bp, Homo sapiens
ccaatgctcaggccatccagttcggaatgcactaaattcagttttatgaaattcaaagtaactttttccttcatcccttattttgtatggattacatttatatgttataatttctgttttcagattttgtacagcagcaatttcttactctctctgcaagttttcttcccagtcacgagatactttgtgcagctgcttatctccaggccttattaaaaaggtaggttcactcttttcctatttttccattctgccatacgtttcaggtttacgcagctttcggaccggaaggccgaggtctgctgccgctttgtgcccatctcaggggcagctcctgggtcaggctggctgtcatggggcagctcctgagtcaggctggctgtcatggccacctctgctgtctgcttaggcagcctgactgctgagtgctgcctttccttgtgttctctgagtgtaaagtgaagttgtatgaagacaactacaagtctgtaattgtaatgaaatagatgttggcatttataggatagatgaattaaaagatcagtattcataataagtatctttccctggaaagaagaattcttattcctctcatctagtaaatgttccttacattgttcagacaaaggaatttttttttttttttgagatggagtcttgctctgtcgcccaggctggagtgcagtggtgcgatctcggcccactgcaacctccacctcccgggttcaggcagttctcctgccttagcttcccaagttgctgggattacaggcacgtgccaccatacccggctaattgttttgtatgttttttagtagagatagggtttcaccatgttggccaggctgttttcgaactcctgacctcaagtgatccacccgccttggcctcccaaagtgctgggattacaggcgtgagccgctggtgcccggcccagacaaaggaatttaaagatgagcattggaaaccctgaatgtcaaaagtaaaggtgaaatggcactgcaaaccagtgttgtccttttataggattttaa

SEQ ID NO: 19357 - DNA, 1085 bp, Homo sapiens
ggctgtttctggccccaaaacctaaaatatttttctggccccttacacacaaggtttgccagtcccgcctgctgctgtagaattttgtgattggcgattacttgagggctgctattcccaagattggggaatgggggccctgggcaccagtttgcattgtaacatgccctccaaacaagcctgttttggaggtctttttgcaaagcagaattgcgatgtctgtggcgggagcgctggccggcttccttcctgctgctcccgtccccaggacaccacgctcatgagaactgtgtctctgcaggctgtggacctcctgctgacgtctttctgtcagaacctgatggctgcctccagtgtcgctcccccggagaggtgaaggcgcgggcagctccctgagtggtggggctcctctgggtgccacctcttgctgggccaagtctgcagaccagggactcatgagctcgtctccgcaggagcatgcggcgatgctgagtttcatcaaataggacgcagcagaagttgggaagcactgcagaagatgggttgtcttccagaaagaccactgttttggggaacagcttggctctttcttcggccgctggtggttggattagctgttggagggatgtgcaggactgaatggctagtactgatggtttcacggctgtctctgcaggcagggtccctgggctgccctcttcgtgaggaccatgtgtggacgtgtgctccctgcagtgctcacccggctctgccagctgctccgtcaccaggtgaggctctccttcatgggggccacccttgggggcccactctgagggccaggctgctacttctcaattcgtcttcagtgccctggaaaattccagcttggaagagggcagtctgctctgccaccctcattctcgttgcagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttg

SEQ ID NO: 19358 - DNA, 1010 bp, Homo sapiens
ctgcaagctctgcctcctgggttcacgccattctcctgcctcagcctcccgagtagcctatagtgggcctacagatgcctgccaccacgcctggctaattttttgtatatttttagtagagatgaggtttcaccacgttagccagtatggtctcgatctcctgacctcgtgatccgcccgtctcggcctctcaaagtgctgggattacaggcgtgagccaccatggccggcctaatgaaaacattctttactttttacttttttttttttttttgagacggagtctcgctctgtcgccctggctggagtgcagtggtgcgatctcagcttactgcaagctccgcctcccgggttcacaccattctcctgcctcagcctctccagtagctcagactacaggcacctgccaccacacccagctaatttttttgtatttttttagtagagatggggtttcaccatgttatccaggatggtctcaatctcctgacctcgtgatctgcccgccttggcctcccaaagtcctgggattacaggcatgagccactgtgcccagcgtattgtttttttttttttttttttttttggaatggagtctcgttctattgcccaggctggagtgcagtggcgcagtctcagctcactgcaagctccgccttccgggttcatgccattctcctgcctcagcctcccgagtagctgggactacaggcacccgccaccacgtcaggctaattttgtgtgtttttagtagagatggggtttcaccgtgttagccaggatggtctcggtctcctgacctcgtgatccgtctgcctcggtctctcaaagtgctgggattacaggcgtgagccactgcgcctggccctccattctttactttttaagacctttttattttaaagttacgagttactgaagaacacttataggtgacattaaagtgttaggtgaaaatatttaatataattttccatttataatttattgctgtttataaattacttttt

SEQ ID NO: 19359 - DNA, 1026 bp, Homo sapiens
tagggtggcaggagctcgtctggttttgcaggtaagcggttcagtgttcacagaggcccacattctgtctgcaggttcactatgatgcgttcagggccatgcccatttaaaatctccttccttccctgactcactgcagcccccaggactttgctgcagcccccttcgttcctgggagggtttgctcatgttcctcgcttgctctgctagggtcttgcagcttcattgtctgaggggtggccctccttggcctgtgttccttacccacctctcttgcagtgatctgtccactggtggatgaggttagaagttaaagtgtgttcagaagtggcttcatcccacaaaatcaatttgtttgctgtgcacaaacacttcttagggcatttagcaaattgtacccctaaggatcccaaaaggatcccatagttagtgtttgttatagctaatgatttttaactgtttttcttcgaataacttttagatatctcttcagtcaaagcgcagtcgtgacatctgtaaatgtatgaaccacatgactttttggtgtttctcttttttcctttctgtttaggaggccgactacagcagccgcccggacactgcctaggtgggcttcacactcttctctccacacaggacactgcctaggtggtgcagctgcgcctggctgtcctgggcttcacgctcttctctccacacaggacactgcctaggtggtgcagccgcgcctggctgtcctgggcttcacgctcttctctccacacaggcctcctttgggagcacacgaggctaccatggctgcagcaagaaggccctggtcttcctgtttacgttcttgtcagaactcgtgccttttgagtctccccggtacctgcaggtgagaagctggctgccacatccatgatttctggtgcttcgctcacctgctgcatctgaggactgccttggcctccccaagagcctcctgcagatctgctctgagcctctcagccaggcccttccccttccccttccccttccccaagc

SEQ ID NO: 19360 - DNA, 1064 bp, Homo sapiens
ctcctgagtagctgggactacaggtgcctgccaccacacctggctaatttttgtaattttggtagagatggggtctcaccatgttggccaggatggtctcgatctcttgagtttgtcatccgccccacttagcctcccaaagtgctgggattacaggcatgagccaacgcacttggcctgaacatctgttttaatttttacttttgagggcaaataccagcactgtgggaggacgaggtgggccgattgcttgagcccagtagttcaagaccaccctgggcaacgtggcaaaaccctatctctaccaaaaatacaaaatttagctggtatggtggcaggtgcctgtaatcccagctactcagaaggccgaggcaggagaattccttgaacccggaacgcgcaggttgcagtgagccaagatcagaccactgcactccagcctgggcaatggagcaagaccccgtctcaaaaaaaaaattttttttttttacttttaggaaatgttaatataagtagaccaaatgatcgtgaatttgagccctttggggtaattaatataattctcagcatatcacattatgtagttaaatgtaatttgtggggtttttttgtttgtttttttgaggcaaggtctctgttctgtctcccaggctgggatgtggtggtgtgatcatggctcactgcagtctcaaccttccaggctcaaatgatcctcccacctcaacttcccgagcagctgagtccgcaggtgtatgtcaccacacctggctaattattaaaaaattttttgtggacatagtgtctcactatgttgccctggctggtctttttgtttttttaagatggagttcgctcttgttgcccaggctggagtgcagtggtgcgaccttggctcacggtaaccacctcccgggttcacgccattctcctgccacagcctcctgagtagctgggactacaggcgcctgccaccacacacggctaattttttgtatttttagtagagacagggtttcaccgggttagccaggatggtctcgatctcctgaactcgtgatctgccc

SEQ ID NO: 19361 - DNA, 1197 bp, Homo sapiens
ttggccaggctggcctcgaactcctgaccttcggtgctccacctgccttggcttcccagagtgtcgaagtgttgggattacaggtgtgagccaccgcacccagcgtaaaatagaaatatctttattttatttatttatttatttatttatttatttatttatttattggagatggagtcttgctctgttgccaggttggagtacagtggcgtgatttgggctcactgcaacctccacctcccgggttcaaaccattctcctgcctcagcctccacagtagctgggattacgggcatgtgccaccatgcccggctaatttttgtatttttagtagagacgggctttcaccatgttggccaggctggtctcgaactcctaatctcaggtaatccgcccgtctcggcctcccaaaatactgggattacaggcgtgtgccgctgtgcccagccgctgtctagtcttttaaaacttggtgtttgagcatgcacattctccttctggaatacctgatcacccagcacaactcacgttatctttctgctggctacccttgccttgctgtgactgtgtcatggttctcagctagactcggtggcgtgtttgatggcccaggcatcgtctgcccagtgggtgtcctgttacccatgtatgacagactgtacccaagatatcagtcttacgaataaggccacgatgaacactttgagctttttctgtatctagcatatccccagggtagatgctcaggcaggaaactggtgggagatgagggatacacagatggctcccaacaggtgctgtgaggtgctcaggagtttatcatcacttgactgagctgagcttcctttgaacagcatccccaccatgattggtttattcccagtttatcttattttatgtatttatttatttttttgagacagagtcttactctgttgcccaggctggagtgtggtggtgcgatctcagctcactgcaacctctgccgcctgggttcaagctattccctgccaagcttgaattacaggcgcctgccaccatgcccagctactttttgtattttgagtagagacagggtttcaccatcttggccaggctggtctagaactcctgaccttgtgatccacccacttcggcctcccaaagtggtgggattacaggcgtgagccacctagcctgaccttactgacagtttaa

SEQ ID NO: 19362 - DNA, 1034 bp, Homo sapiens
tgagggtggcctgcctgagtgtgcagcagggaggtgtctgccaaattaaagagccaagatattttaaacacttccagagcttcagcagcccgctcctgagcacacttcctctgccagttacgataacgtgcgtgaggaggaggcgaccatgggaaagcccggggaacgctctggtcagccttttcctgtgaggatgaggtcggaaggtgcgcccactgcagtatcctgttccgcctctggaagtcctgcaccaatgtttgtcccactcactgtgacctcctcctgtgtggagtctccccttgctcctccttccctgggtgtgattcaggctctagagctggccctgcctctcagccccccacatttctagaacacactgtagctgtgcctctacagactcccgctgcctggcctccacagatcctgctcagattcaccagtaggcaaagcttggccctattagctttttctctccatggctctgtggagatgtgcggagacccttacaggtcgggaggcggaagctgaggagtgggggctgggtggaaggtggacatcggggtttggtggaaatggggctctggggtttgcttccctctagtgtgggcaggggaccttgaagtgaagtcttgagaaaccagtagaatttgccactgtttccaggccttgtcaaccttttcattctttattttgctcctcatttcccatccctcacagtaactgtttaactgctcaattaaatgtgttgtaccgttcggtacttttactgaaacagtgaataaagcactgtgtgatttcctgaatgtttacatgtgcatcagttagcttgggctgctgtaacaaagtgccagagactgcggtgtggacggcagatgtgttctcacagcagtggaggctggaagttggaggtcagggtgcccctagggttgggttctggtgaggaccctcttcctggcttgcaggagacctactttttctgtgtcttcatgaggtagagaggggagagcaagccctctggtgtcttctccgggcag

SEQ ID NO: 19363 - DNA, 1026 bp, Homo sapiens
aacttgagactgggcacagtgccacaccagtcatcccagcactttgggagggcaaggtgggagattgttttgagcccgggagtttgagtccagcctgggcaaagtagtaagacctccagctgggcgtggtggtatgcgcctgttgtcccaactactcaggaggctgaggtggaaggattgcttgagcctgggaggtcgagggtgcagtgactgattgcgccactgcactccagcctcagtgacagcaaaaaactgtctcaaaaaaaaaattgggacatatggctcaactcaatcccctgatgatgggatttagttgagccttacgtctgcctctgtgtgtgtctccagccatcccgacatgcatgctgtgggatcgtggctcttcaggaatctgtgctgcctttgtgaacagatggaagcatcctgccagcatgctgacgtcgccagggccatgctttctggtgcgttcatgacaagatgcgggttcttgggtaaaactcattttgatctgtgataatgccttctgctctcaagagctctgcgaggcagaacagcctgtctctccgtggccgtgggaacctggcatgacagactcccagtctcagcctgttgtggggttgcattttacttgactgatgtggaaatactagtaagtcggccttgacatgagtttaagtgtttccattcacctttcccatagagtgaccgcagctgcttccttctgtcgcccaggctggagtacagtggcgcgatctcagctcactgcaacctccgcctcctgggttcaagtgattctctgcctcaacctccttagtagctgggactgcaggcacgtggcaccatgcccggctaattttttttttgtatttttagtagagacggggtttcattaggttggccaggctgctcttgaactcctgacctcgtgatgcacccccctcggcctcccaaagtgctgggattataggcgtgagccactatgcctggccttcctgaggaatgatattatgagaaaaacttgggact

SEQ ID NO: 19364 - DNA, 1025 bp, Homo sapiens
actgcactccagcctgggtgacagagcgcgactctgtctcaaaaaaaaaaaaatagagtgtgagttagggggatgagaaggggaggctgcagggagatcagggcagtgtgacaggcacagtgttcacagtgagtggctaaagcagatcctgttttatcaaatgggagagggttgagtgagaaagacaagggacatgcacagggcacactgaagcctgacctttgtcctggcagcttcgaggagccagtgaaggcttctgaaggagagactgtcatgtcagtgtgtgtaatactgtgttggctgtagtgtggagaaagggttagaagtaggctacagtgcgtaggaagagagaaggaagagaagcaagtgttgggcaacggtgtgtgggtgcccaaaggccagggagtttgaaaaccagtacagctttgtaaaaaaagatgtgtttcaggctctaagtttttgcttgaggttaattttcaatacggcatggttaagaacctaagttgaacattttgtaggaaaatgcattcataaaggactcagaatgctgggggtttttttgtttttgtttttgtttgttttgttttgtttttcagagttctttgttgcttgaagcggtgtggcatcttcacgtacaaggcattgtgagcctgcaagagctgctggaaaggtagcgtgctaatgatgattcagtgttactgtttttgcagtctagtctagtataaattatatttcaaagcccagaatcagacgggtttgatttctggctttgacatataatttgtactagactagattgcattgcatatttatactagactagacctggaggaactattgctttattatttcaagagaacgtttatggtgttttggttttgtttgctttttgtctgttttttttttgagacggagtctcgctctgtggcccaggtgggagtgcagtggcacgatttcagctcactacaacctccacctccagggttcaagcaattctcctgcctcagcctcccaagtcgctggga

SEQ ID NO: 19365 - DNA, 1009 bp, Homo sapiens
cggcctcctgcagtgttgggattacaggcatgagccaccgcaaccagcctgtaaatgtttttacttatgtattgataatgtgtttttagagccagtacattacaataacaggttcgtactgcagttaacagttttttttttttttttttttttttgagacggagtattgctcttgttacccaggctggagtgcaatggtgtgatctcgactcaccgcaacctctgcctccctagttaaagtgattctcctgcctcagcctcctgagtagctggtattacaggcatgcaccaccacgcctggctaattttgtatttttagtagagatagggtttcaccatgttggtcaggctggtctcaaactcccgacctcaggtgatccacccgcctcggcctcccaaagtgctgggattacaggagggacccactgagcctggcctccagtttttttttgttttgtttttttgagatgaagtctggctctgtcgcccagactgcagtgtagtggcgtgatctcggctcactgcaaactccgcctcctgggttcacgccattcttcgcctcagcctcctgagtagctgggactacaggctcccgtcaccaaacctggctaattttgtttttgtgtctttagtagagacagggtttcaccgtgttagccaggatggtctcgatctcctgaccttgtaatccgcccgcctcggcctcccaaagtgctgggattacaggcgtgagccaccgtgcccggcccggtttctttaaacaattaattttggctcacgtggtggctcacacctgtaatcccagcagtatgggaggccgaggcgggcggattaatgaggttgggaattggagacgagcctagccaacatagtgaaaccccatctctactaaaaatacaaaaaattaactgggcgtagtgacgcgtgcctgtaatcccagctacttgggaggctgaggcaggagaatcgcttgaacctgagaggcggaggttgcagtgagctgagatgg

SEQ ID NO: 19366 - DNA, 1076 bp, Homo sapiens
tttaaaaacagcgtctgattcaacctgcgactcagaagcagtaggacccagagtgtcccttggaaaaacatgggacatagcaacagcagggatgtgccccttgctcatggaagtagtgagacaggctgtggtgtgcccaggagagcagacgggagaacaattttctaggtacctccttctccccccagtttgagagtgggagatagggtaagttctgggtcaacaacagtaagttattttctgatccttcacgtccttatgtgatgacttgtttctgttaaaataaccttcagtaatagcgctcccttgacaactggtcactgaatgtcattggcaaatgatacagattttcactgccatgattgtatttgaatttcacaaattgcatattatcattccaaggaaccaagctcagccacacagataaacctttaattcattaatttttgagtttgtttttttctgctaaagatatagttagtacatgcacgcacgtgcacacggacacacacacacacacacacacacacagtaaaagacttgtagataaaaaaactttcctatggagacacattggaaacaaatgactagaaattggcattgttggcctggcacagtggctcacgcctataatcgcagcactttgggaggctgaggtgtgcggatcacctgaggtcaggattcgagacgagcctggccaacatggtgaaaccctgtctctactaaaaaacacaaaaattagccgggtgtggtggtgggtgcctgtagtcccagctattcaggaggctgaggcaggagaattgcttgaacgtgggaggcagaggttgcattgagccgagacccctccattgcactccagcctgggcaataagagcaaaactctgtctcagaacagaaaatggcattgtctacttttttttttttttttaacagacagggtctcactctgttgcctggactggagagccgtggtgcaatcacggctcactgcagtcttgacctcctggcctcaagtgatcctcccaccccagcatcttgagtagctgggactacaggtgtgcgccaccatgcctggc

SEQ ID NO: 19367 - DNA, 1025 bp, Homo sapiens
ggtaaggacatcaaaggccaggcatagtggctcacactcgtaatccagccctttgggaggccgaggcaggagggtcacttgagcccaggagttcaggaccatcctgggcaacatagtgagacctcatctctacaaaaaaaactacaattagctgggtgtggtggggtgtgcctgtactcagtcccagcaacttgggaggctgaggtgggaggattgcttgagcctgggatgtcaaagctcatcacatgtcaagtgagctcatcactgcactccagcctgggcgacagagtgagactccctctcaaaaaaataataaaccaggtggattagttggtctggtctttttttttttttttttttttattaaagagatggggtctcactatgttgcccaggctggtgttgaactggctctgactcaagcagtcctcctgcctcagtctcccaaagtgctggaattataggcatgaacaactatgcccagccaagtcaatcactgttaggtgagctatggctctgggcaggcagacatgcattggatcttgggtctgccttcactagctgtggtccctgagcagtagctggaatgacaggcatgaataaccacgcccagccaagtcgaccattgttaggtgagctagggctctgggcaggcagacacggctttggatgggtctgccttcactagctgtggtccctgagcagtagtccctgaagtgtcagcttcctcgttggtgaactgggaggaataacagaatctccctggtcactgtgaggattaagtgagatgatgcacagaagttacttcataccttacctgcctcacgagtaattcagtcaatgttgattctcttttttaaaaattatgttttttgtagagacggggtcttgctgtgttgcccaggctaatctggaactcctaagctcaagggatcctcctgcctcggcctgtcaaagtgctgagattataggcattagccgccatacccagccatgtttattatcttttaaaattatcatgaaac

SEQ ID NO: 19368 - DNA, 1042 bp, Homo sapiens
ttggggactttcattatctttgcatcttctgcgcagtgtctggcacgtgtgaatgggagatgttgaagggatgcataaaatatcttcagcactagcaggagtgactcctatagtcgctgtgctggatgctgtcagagagaggcagaaggtcccatccctcaagaaagctatcatagaagaactggtttatctcctgatccaaaattgatcagacttactccacagtcccctggtctgggaagatttgtaacatcttgattgtttcctttttattttccaggctgtgtggatgcctgggagcccaaagtgctccgggcgggtatgggcgcacatttccggatgcccattatcaataatctggaatgggaaaccgtgcccaattacctgccccctgacactcgggtctatgtggctgacaactgtggcctttatgcccaggctgagatgtctaataaagctagtgaccatggctgggtgtgtgatcaacgagtgatgaagtttcacaagtatgaggaagaggaagatgtagaaaccggagccagtcaagattggctgcctcatgttgaggttcagagttacgactcggactggacagaggcgccggcagctgtggtgattggcggggagacctacggcgtgagcctggagtccctgcagctggccgagagcactggtggcaagaggctgctgatccccgttgtgcctggtgtggacagcctcaactcggccatggcggcaagcatcctgcttttcgaagggaaaagacagctgcgggggagggcggaggacttgagcagggacaggagttaccactgaggacgcagaagtgacttctgcttgaggacgtctgcagctcctcctacaccagcacactggtgggaggctggcggagtcagtgactatggcccccacgttcaggaggaaggtgtgatgccgtcatacagttacaggaaaaataagaacttcctcagaaagaacaggtccgaattcttcctgtcgcgtcactgattttgaggttcttttttctcttggtgacaatagg

SEQ ID NO: 19369 - DNA, 1052 bp, Homo sapiens
ggcaggtggatcacttgaggtcaggagttcgagatcagcctggccaacatggggaaaccctggtctactaaaaatacaaaattagctgggtgtgttggcgtgtgcctgtaatccctgctgcttgagagcctgaggcaggataattgcttgaacccgtgaggcagaggttgcagtgagccgagattgcaccagtgcattccagactgggcgacagagtgagactgtctcaaaaaaaaataaagaatgatcatggagatatttaaataatttgataagtttttttattttttagagatggggtctcactctgttgcccatgctagtctcaaactcctgggcttaagcgatcctctcgcctcagcttcccaaagtgctgtgattatagatgtgagccactgcacctggccatgtttttatattcaaaattttataaacctatttccagcgtaggtgaagtattttgttcataaatgaagaatgaaagtttcacatgtgtttgtggtgatggaatgagttggagaacctttgctgactttcattatcagctaaagcaggtatcattttcgttcaaaagacacaggccacaaagggtacgcaaataccacacacatgtgaaggcgtttgggcaagagtcacatgataaaataagagatgatgcatagaactcttgtggtcaacagaatacatagcatttgtatcttaattatataacgaaaggggaagggaactaatgtttttgactatttctaatgtgacagatgctttagtagtcagtacttaagtaaccctagaagatagctattatactcccattttacagaggaaggaagtacagagaggttgaataatgtgtccatggggtgaagatttgaacacatgtgcccttgagtattacatttgttgctttatatacttactagggattttttttttaaagggtctcactctgttgcccaggctggggtgcagaagcacaatctcagctcactgcaaccttcacctcccaggttcaagtgattcttttgcctctgtctctcgattacagacgtgcg

SEQ ID NO: 19370 - DNA, 1035 bp, Homo sapiens
taaaaaaaaatttttttttttttttttgagacacagtcttgctctgttgccagactggagtgcagtggcgcaatctcagctcactgcaacctctgcctcctgggttgaagcgattctcttccctcagcctcccgagtagctgggattacagccgcatgccaccatccccagctaatttttgtatttttagtagagacggggcttcaccacggtggtcaggatggtctcgatctcttgacctcgtgatccacccgcctcagcctcccaaagtgctgggattacaggtgtgagccaccacgcccggcctaaaaatattttttgtagcgatggagtcttggtgtgttgtccaggatgatcttgaactcctgggctcaagtgatcctcccaccttggcctcccaaagtgttggggttacaggcacaagccaccactgtggaccaaaatggtttttgagatttacccatgttaattcagtaatctgcacctttttatggctcagtagtattccattgtatgactataacaaaatttgtttatttacttattattgcacatttgggttattttcatcttttggctattataaatgaagatgctatgaccatttaagtacaactctttttgtggaaatatgttttcgtttctctgggataaatatctaggaatgtaattgctgggtcacaggtaactgaatgtgtaaaagaaatcgccaaccttttccagtgtgatcatgagaattctagttgctccatatccttgccagtcatcagtctttgatttcgagtattctagtgaatgtgtaatggtatctcactgtgcttttatttgtatttctctggtggctagtgacgttgagcatcttttcgtgggcttactggccatttgtatatcttcacgaaagaagtgtctgttcacatcttttgttcacctaaaaattgggttttgtgcttattaatgagttgtgagaattcttgattcttgctaggtcttttgttaaatataaatattacatatattttttcccaatctgtgact

SEQ ID NO: 19371 - DNA, 1042 bp, Homo sapiens
gggactggaggcaggagagtctgaagaactcttagagtcaattcctagagggatcttggagcaggggtgacagtcaagctttgtggtataatatcacctgctttcgggtccacgtttctttcctgtgatccttcctgcaaatttaagcgcccacatatcaaaaagatgttttttgagatgagcgttagtccgcctcaggtcagacatgaggcagtttcacgggtgctgttcctggctgtagaatagtgtattaacctcataggctgagagctgccggcattcccggacaaggattggccctgacatttgacttttagttgcagctttttcctttcagtgtttgtatttaatgaccctcctcccatcttgatctaagcctgtgttctgccagcagtttagtatttagatcatttatttctcctttacgcctgctcttttattttcatcatatacagtgtaggtttcattcctcctgtctcatttcactgtatacccttatccatcattgtcaacagcagctcttaagtgctcttatagaacatctcaagaattaaacactggacagatcctcgttgtcctgtcatgggacacccactctttcggttctctgtaatcccagctacccaggaggctgaggcaggtggattacatgagcccaggagttcgactgagcaacatggaagaccccttctcttgaaacaaaaactttattgctgaaaaatgctgacaatcatctgagtcgtaatcttcttgctggtgggggtttgtttcagggttgatggctgagcagtcacggcgatggttgctgaacatcggcgtgtctttggcagtttcttaaaataagacagcagtgaagtgtgccacattggttgactcttcctttcacaaaagctttctccatagccggcgatgctgtttgacagcattttacccacaggagaactttttcaaactggagtctctccctctcaggtcctgtcactgctttatcagccaagcttatgcaaattctaaatcctttgtcgtcatttcaacaatgctc

SEQ ID NO: 19372 - DNA, 1046 bp, Homo sapiens
acgaacagtgtggccacagtcagtggggttctgagtcaggagggcagtcttttaagttagtattcatgtttaacggtttgcttatagacctcatatctagaagctcaaaacttcaaggtgtcctcaggaggtgggagaggggggacattctcccaggctggctgggctggctagactgactcttaggttttccgcagggctgttctctatcagggagcagtatatggactcagactcattctttgccccttagcccctggtgtcacctctgttctcctgaggaagaaggtgagccatattctattcatgggctcaagtcttcgattcccagtgatttcacaacatggaaattataccggttaccttctggcttaatgaattgtctctaccttcaggatgaattcagtgagaacgaaagctgggccaacccccttggtgtctggatctggcccttaaacttggtggagttaacagcttagctgggtcttgttaccaaactcaacttgggtcttcccatccacacaaagcaaaagccaaacactgacatggagatttgcagggagagaacaagcatttattgtaaggcaccaagcagggagactgggcagctaaagcttaagacctaaacttcctgatggcttacaagcaaagggtttttattttatttatttatttatttttgagatggtgtctcgctctgttgcccaggctggagtgcagcggcgtgatctcggctcactgcaagctccgcctcccgggttcaccccattctcctgccttagctgggactacaggtgcctgccaccaggcccggctaattttttgtatttttagtagagagtagtatttccccgtgttagccaggatggtctcgatctcctgatctcgtgatccgcccgcctcagcctcccaaagtgctgggattacaggcgtgagccactgcgcccggctgcagagggtttttaaaggctgggcttctggggatctttaaagtgaattaagggctggggaatttctggaactttcttacctattttctggcttca

SEQ ID NO: 19373 - DNA, 1400 bp, Homo sapiens
ccctgtccttttacccccaggctgaagccactgcgcctggctgctcagagacctgagcctggccgggccctctgctgctcctgccttcccaaacagcccctgaactcctccctcccacagttcccatggacacctcggcccaagacttccgggtgctgtacgtctttgtggacatccggatagacactacacacctcctggactctctccgcctcacctttcccccagccactgcccttgccctggtcagcaccattcagtttgtgtcgaccttgcaggtgggtggaacgaggatcctcggcctcctgcagggtggacagcggccactctccagctgttgcgggatccccaggtgctccaggctgtttctcagccctggctctcctgccccagccgctggcttcacttccctcgtcattcctacaggcagccgcccaggagctgaaagccgagtatcgtgtgagtgtcccacagtgcaagcccctgtcccctggagagatcctgggctgcacatccccccgactgtccaaagaggtggaggccgttgtgtaagttaaaaatgggggccaagtaagtcctagagacatgcgtgtaccctgggagggagcctgaggttcatcatccaggaaagaaaccaaatctaatgctccttacctgtgagcccgaggtcacactgcaaggtagggaccaaacagggagcagacctcaggtttactgtcgctttctccactgcccagtccatcatccagaaggctgtgcagggtgggggcaggaatcagagggcctgatgggggttgagggtgggctggaaatggtgggaatataattggagaagatggatgggcacgcccaggctgcagccccattaatttaccatccggacagctaacaagcagaagcagcgtgtctcctgccgcctaattattttaggtaatggaaatgcttaatgttgtgtgaatgcagccagcctgagagccgacggctcccccgactgggactagggaagggagtcccgttccgtactaatggcagggagggagggtcgctccctgactcagtcccacctctggggctttggaggctgtttccacaggcctgacacccctgtccctagacaggcccacatcagggccttccccagcccagatctggcagccctgctccccgagcagcactgagtggcattccccctgtgcccacgtcactcagtctctacccttggggtcttcaaagtgtatgttggagggagggacaccctgagtgttagccattcatcagaatgaagtgtggtctccaagagggagagaaggagctgccacaggcaggttatcttccacgctctgtaatcttcatgggctgggaagctactgtcagggacagcatgtctgggggcacacttg

SEQ ID NO: 19374 - DNA, 1029 bp, Homo sapiens
cctgcctccctctcccaacagcacctggaatctcgactccgagccttgggcctttcctttgtgaggctgctgctctctgagatcttccccagcaagcttagcctacttcctgaggtggatgtgtgagtatctgcctggctatgactggctaaagaagcttagaagctgggtcttgcccagctcgtcttgaaggctggagccaacaggaattgcttccatggtcatggaattttactgtttacagagacctccctgggagggctaactgggtcatacctgctttgggactttggggctcagaggcaatggcaacatcacatttgtccttgtgagatgagtttgagcggtggctgacacctgccctgtaccaggtactaaatgtggttctggggatactatcaccagtgagctgccctggaaagctcattgtcggcagaggaaacaggagaaaacacgcaacaatacagtattccaaacagcagtgggtcactgtctttactttaggattcataaagcctgttaatgaatgggtgtgctgggggcactgtcatgttcttcagcatgctgcctgggcgacgaggaggcccttcctagggtctgacctggcttcccttcccaggtgggtgcaggtggcatgtccacgtctctccattgactggggcacagccttccccaagccgctgctgacaccctatgaggtaacaccaagctctgggagagagtgggctttggacgtggttctcaaaggtgaggtctggagtggagtggggtgggtgggcagcacttcgttatgttcgtagattccggagtctgtctcgatttctccagcggagtcacttcctagctgtgtagccttaggcaaggccctgaaccacacagttcccttctgtggcaggggacagtgtgcccttcacaggccgtcgtgaggactgaattcagtaatccaggggcagaaaaacactggcagatgttattgtccctccctcccctcccctaggcggccgtggctctgagggacatttcctggca

SEQ ID NO: 19375 - DNA, 1029 bp, Homo sapiens
ggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcggtgagacaagccccgctccggaaacgcactcagtttcctccatcttgtttcgtccccctcgacacccttcagcatcccccaccctgcgtccacccgcattcctcccacccagtccacacccttcatttctcgcgacccataccctctttgctcaaactgcagcctgtcctcccaggcttccgccttcaccgtcttcctccgctgtctcctgttcaggccaatccactcatttcccccctctcatttcccccagacttttgcctcgattccctttttctctctgtcatctcgaaccctcctgccctttctcatttctttccttcctggagcctcccatgccctaatcccatcctttttcctcatatcgctgtagggtcctgccctccggaggagcagcctcgaggctggtggttttcagagcaggaggccgacgttttctccgcattggaagagcccgccgtctgcaggggcctggaggaatcactggggatggtggcacaggcactgaacaggctggggccttttgacggccttcttggtttcagccaaggggctgcgctagcagcccttgtgtgtgccctgggccaggcaggcgatccccgcttccccttgccacggtttatcctcttggtgtctggtttctgtccccggggcattgggttcaaggaatccatcctgcaaaggcccttgtcattgccttcgctccatgtttttggggacactgacaaagtcatcccctctcaggagagtgtgcaactggccagccaatttcccggagccatcaccctcacccactctggt

SEQ ID NO: 19376 - DNA, 1030 bp, Homo sapiens
ctgccaccgcgcctggctaatttttctatttttagtagagacagggtttcaccatcttggccaggctggtcttgaactcctgacctcatgatccccctgccttggcctcccaaaatgctgggattacaggcgtgagccaccgcgcccagcctgaaactttctctttttagaggggcagtgaagaagtagtctttgagcacccatcaacaaatgaacacatctgggatgaagattgtacctaacatgtttgatcagtctggtgtggcaataaggatgcacccaggaggtgataaggaaatccaggaggtgataaggtagacagactgagaaagaagacacaaggagagaaaagtaaagagaggaaagatgagcattaatgagggtgcttacaagcggcagaggcagtgaatacaaaaacttagtggaaagaaagcaacgacgaaacaagaataggatgagttctcagttacctactttattcttcaaatagcccttattcagcacatctttcttgtttgttgtagaatggagagcagtttattacatttgataatccttgaaagcattaatttgcttggagggtacccagggagtagagttcaagcagtatgaagagtgaagaatattcattctggtagagtttagtgacagactaagcttatattaataacggttctatattatagaagaatactactgctggagtatggcagtatattaggtttctccagagaagcaaggccaatagggtgtgtgtgtgtagagattgactggttgattgatgtttgaggaattggctcatgctattgtgaaggcttgcaagttcaaaatctgtagggtaggctgacaggccggggacctggggaagaggtgatgttgcatctcaagtccaaacgcagtcttttggcagaattctatcttacttgggaaatcagtcttttctttttctcttaaggtcttcaactgatagaataaggcccgcccacattataaagataattgactttactctgagtctgctgacttaaat

SEQ ID NO: 19377 - DNA, 1025 bp, Homo sapiens
gctatttggctttgcaatcctgtgttagtttgttaaggataatggcctccagttccatccatgtggaattactattctaaacatctggtaacttgcaaggtgtcatggaacccagcttatcaggaaacattgcttaacagattcttgaaagcaactggcctgaaaagatacttagttcttgactgagaataacttctgccttgcttcattgctgcatctggaaaatatttggattaagagccataatatataatacgtgctattcaagcatggtagataatctgtcttttttttttttttttttttttttttttttttttttgagacagggtcaccctctgttgcccaggctggagtgcagtggcgtcatctcagctcactgcaacctctgcatcccaggtgttgccctcccacctcagccttctgagtagctgagactacaggcgtgcgccactatgtccagctgatttttgtattttttagtagagatggggtgtatgtattcgttcgttttcacgttgctgataaaggcataaccgaaactgggaacaaaaagaggtttaattggacttacagttccacatggctggggaggcttcagaatcatggcaggaggcgaaaggcacctattacattgtggtggcaagagaaaaatgaggaagaagcaaaaccagaaacaagataatcccatccgatctcgtgagacttattcactatcacgagaatagcatgggaaagaccagcctccatgattcagttacctccccctgggtctctcctgcaacacgtgggaattctgagagctacagtgcaagttgagatttgggtgaggacacagccaaaccatatcattccacccctggtccctccatatctcatgtcctccctttcaaaaccaatcttgccttcccagcagtcctgcaaagtcttaactcatttcagcattaacccaaaagtccacagtccaaagtcttatttgagacaaggcaagtcccttctgcctatgagcctgtaaaatgaaaagc

SEQ ID NO: 19378 - DNA, 1018 bp, Homo sapiens
gcttttccaggcgacagtgcaagctgtcggtggatctaccattctggggtctggaagacagtggccctcttctcacagctgggactcacagtagggactcgtatggggggctctgaccccacatttcccttcagcactgccttagcagaggttctccatgagggccctgtccctgcagcaaacttttgcctgggcatctggacgtttccatacatcttctgaaatcaagttggaggttcccaaacctcaattcttgacttctgtgaacccacttgctcaacaccacgtggaagctgccaaggcttggggcttccaccctctgaagccacagcctgagctgtacgtcagcccctttcagccacagctggagtggctgggacacagggtaccaagtccctaggctgcacacagcatggggaccctgggcccagctcatgaaaccacttttttctcctgggcctccaggcctgtgatgggaggggctgctgccaggaagttctctgacatggactggagacattttctccatagtcttggggattaacattaggctccttgcttcttatgcagatttctgcagccagcttgaatttctccccagaaaatgggtttttcctttcttttttttttttttttttttttccctgagagggagtctcactctgtcgcccgggctggagtgcagtggcatgatcttggctccgcctcctggattcatgccattctcttgactcagcctcccgagtagctgggactacaggtgaccaccaccacacccggctaattttttgtatttttagtagagacagggtttcagcatgttagccaggatggtctcaatctcctgaccttgtgatctacccgccttggcctcccaaagtcctgggattacaggcgtgagccactgcgtctggccaaaaaatgttgtttttttttctatcatatagtcaggctgcaaattttctaaactttcatgctctacttccccgttttttttttttttaaagatggagtcttg

SEQ ID NO: 19379 - DNA, 1031 bp, Homo sapiens
tatgttaatttcatatcatttggaggatgatttttttattgctttgaattgcctcttccaatcaaattttatatataccagtagcctctattttaagtaagaccatctcaaatacatttcttaattaggtacattggttaagagagcataagattccagcactttgggagactgaggcaggaggatcccatgaatacaggagtttgagaccagcaatgtagggagacctgtctctacaaaaaaaaaatttaagaattagctgggcatggtggtgtgtgcctgtcgtcccagctgcttgggaagctgaggtgggaggatcgcttaagcccagagggggaaggctgcaataagctgtgatcatgccactgcactccaacctgtgtgagaacctgtctccaaaaaaacaataaaaagcgtaagattgctaagtagtgtatgttataaataccggccattctaaggttattggtgactaacactcaaccttgaaggttacttcagttatagttggcactgttcggcttgtgcagttcatgaaacccttatctgttttaccttttataccttttttgtaaatttgaaattttactttttgtctctaagagagaattacattcgtttagagttacatgttaatatttgaaatcaaatgtatctggcaggttaacatgattgggagtgggtaaatgtatgttaaatttaaaagtaatgctgttttggctcattgaattattaatttaaaagacaaaacagtatggtttttgacattagttgactttcactataagtggaaaatcatcatctaatatttatactaacatcacaataaaatttatctttgaaaatgagtactgtaactaataatttagaaataaattttaagtgaaataatctttttttttcttctctttctccttaggtggaatgaatcttacttgttgaatatcttctggttactagttggattcatttgtgaaagaatcattttcccctgtgtggaagacacttagtggcatatttaaattataagt

SEQ ID NO: 19380 - DNA, 1050 bp, Homo sapiens
aaggcatttatgaaacaaatgaatttcgtgtttagacttggttgagtctcatatccgagatacctcgttagatacatgcaaatattccataatttagaaaaaatgtcgaaatctgaaatacttctgatcccaagcatttcagataagagctactcaacctctacttctcaaatagttttagaattgtttccctcatacttccacgaagaccagacatccgggaaaggattgagaattcgcatgcagctctgctcctgcctgtcctgcccacgacatgatcatcaaatgtgttaataggttacttagaatttgttttgttgttgttttccctctttgcatgatggtattactcatttgaaatatagttgggttcatcttgcttgttttcatcctccccctcactccccgctgtcctatctttaatttttttaatatataaaccattatctatagaaaaacatgtacccagaagtgttactctcttctgaatcccttccaccatgttacccccaactcctttcatcccttgagggaaccaagcttattgtttttaaaaatatgagatagatatatatcttcttatttctccctctttcttaaataaaagtagcatactgtatatgttctttgtttgtttttttgttttggagacaagagtctcattctgtcttccagtctggactggagtgcagtggcatgatcatggctcactgcagccttgacctcctgggctaaagcgattgttacacctcagcctcccgagtagctgggactacaggtgcatgccatgccaccatgctcagctaattttttcctttgccttttttgttttcccccttttgtggagaacggggtctcgctatattgcccaggcaggtctcgaactcctgggctcaagctattctcctgcctctgcccccctaatagctgggattacaggcatgagccactgcacctggccacactcagctaatttttctttagtttttgtagagatggtctcactatgttgcccaggctgcctctgggctcaggtgatgcttgcaccta

SEQ ID NO: 19381 - DNA, 1019 bp, Homo sapiens
agagaaaatttataaaaccaatttaagaaaatttataaccaatttaataaagagaaaagacataaatgaactttataggaatgagaaattcaacataaaatgaactcagatgattttcaaacttatgagagtacggtatcctattaggtttgaaacaatctgctgggcgcagtggatcacttgaggtcaggagtttgagacctgcctggccaacatggtgaagccccatctctactaaaaatacaaaaattagccgggtgtggtggcacatgcctgtaatccccactactcaggagctgaggcatgagaattgcttgaacctgggaggtggaggttgcagtgagccaaggttgcgcactccagcctgggcaacagagtgagactctgtctcaaaaaataataaaataaataaataaatttgaaaatctgaatgacctgggtgctttttctaggaaaatatgtgataacattggttcaagaaatagtaggaaacttgaatagatcattaaatatagagaacattgtaacattaaagatttcaagcccaggcagtttttaagcctagatgctaattttttcaaatcttaaggaccatttgcttcccagattacattgctttttccgggacataaaggtagtaaatttaggagcttattttataaggtgggcaccaccttcgtagaaacactgggtgaggccaggcatggtggctcacacctgtaaccccagcactcagagaggccgaggtgggtggatctcttgagtccagcctagccaacatggcaaaaccctgtctctattaaaaataaatttggctgggcacagtggctcatgcctgtaatcacagcactttgggaggctgaggcaggtggatcacctgaggtcaggagttcaaggccaacctggccaacatggagaaagcccttctctactaaaaatacaaaaattagctgggcgtcgtggtgcacacctgtagtcccagctacttggggcggtgagggaggtgcgagctgaggcac

SEQ ID NO: 19382 - DNA, 1048 bp, Homo sapiens
ctgcactccagcctgggcggcagagcgagactccgtctcaaacaaaacaaaacaaaaaccaaaaacatttctccatgtgttttcatgactgtgatatatttttaagcatttttgttgttgtttactttattgctttaaaaaactgacttttgcagttagttgaggtcctgaggtttctcctgtgaatctgtttgaacatcatatatatttggcattgattggaaagcggtttttccctggcctgtgtgaaatacactgaaggtctgcacctgcccgcgcacttcacgttgtacatgggaatgtactatagctgcacatgttcatgtagtggcgttagatgccaaatagttctagggcttagtttaagattgggtactttttgtcaggaaacaacaggtgctggagaggatttggagaaataggaacacttttgcactgttggtgggactgtaaactagttcaaccgttatggaagtcagtgtggcgattcctcagggatctagaactggaaatatcatttgacccagccatcccattactgggtatatatacccaaaggattataaatcatgctgctataaagacacatgcacacatatgtttattgtggcactgttcacaatagcaaagacttggaaccaacccagatgtccaacaacgatagactggattaagaaaatgtggtacatatacatcgtggaatactatgcagccataaaaaaggatgagtttgtgccctttatagggacatggatgaagctggaaaccatcattctcagcaaactattgcagggacaaaaaaccaaacaccacatgttctcactcataggtgggaattgaacaatgagaacagctggacacaggaaggggaacatcacacaccagggcctgtcgtgaggtgaggggagaggggagggatagcattaggagatatacctaatgtaaatgacgagttaatgggtgcagcacaccaacatggcacatgtatacatatgtaacaaacctgcacgttgtgcacatgtaccctagaacttaaaagtattaaaaa

SEQ ID NO: 19383 - DNA, 1041 bp, Homo sapiens
taattttttttgtatttttagtagagacggggtttcactatgttggccaggctggtctcgaactcctaacctcgtgatctgcccgcctcagcctcccaaagtgctgggattacaggcgtgagccactgcgcctggccacaattagctatttaaaagggaaaaaaggaccagtctagacaacatattgagaccctatctctactttaaaaaaaaattaacccatcatggtggcatgtgcctgtagttccagctactcaggaggctgaagcaggaggatccattgagcccaggagcttgaggatgcagtgagccatgattgtgccacagcactccagcttgggtgacagagcaagacctcatcttttttttttttcaaagagtgaggaaaggggcccgggacaagtaaatgattcatcaggtggcagtgaatgactaccatatactatgacttgacctatcctaattctaaaaatataaatacattattagcagtattgtagataattgaatatcctgctcttcagtgcagagtaaaaactgctccatcaacaattggaagctatatttaatcagataattctggggatgcctattatgaatatgacctgattttaagggatcttcattgttttttagggcttgacttactatacagtggtcttcctttgtttagtttgctgtttcatgtaatctgcctgtatacttctgacacttctgataaataggtcttttaaaattactgttttcattcaattgctttttcttgccttgaatgtcctacatagtctgtttctgtttctagccatttctctcattattttaatgccacctgatttagagcagttttttttttgagacagagtctcgctctgtagcccaggctggagtgcagtggcgcagcctgggcccactgcaagctgcgcctctcaggttcacgccattctcctgcctcagcttcactagagcagttttaagtaataggaatgattatagcatctttgccttgttctttgacacaagtgtttctagtgttctgccatt

SEQ ID NO: 19384 - DNA, 1019 bp, Homo sapiens
gggattacaggtgtgagccactgccacctgctgaggttcttcagtctttacttaacttattacttttagtaacggtagtacaccttgctgaagttaaaggttctacattaactggatcagattgttggcttaaatattgagaggcagggcatcaaaggtggtagtgctaaaattctctggattttttttttttttgagacagagtttcactctgtttcccaggctggagtgcagtggtgcagtctcagctcactgcaacctttgcctcccgggttcaagcaattctgcgtcagtcttccaagtagctgggactacaggcgcataccaccacacctggctaatttttgtatttttagtagagatggagtttcaccatgttggccaggctggtctcgagctcccgacctcgtgatgcgcccacctcgggctcccaaagtgctgagattacaggcgtgagccaccgctcccagcctctggtcttgaacttctgaccttgtgatttgcccgcctcggcctcccaaagtgctgggattacagacgtgagccactgcgctggcctaaccctgtaattattatacgttgatttttggcatgctcataattacctggaacataaagtttttgctggtaattccctgttatctttctttgctgatttgttttaaacataccattgaattaaagccagtaatcccaccagttatacaatactactggagtgtgttttgttttgtattttgagacgtagtttcgctgttgttgcctaggctggagtgcagtggcacgaactgggctcaccacagcctccacctcccaggttcaagtgattctcctgcctcagcttcccaagtaggtgggattacaggcatgtgccaccacacctggccttttttttttttttttgagaaggaatcttgctctgttgcccaggctagagtgcagtgatgcggtcttggctcactgcaatctccgcctcccgggttcaagcaattcttctgccttggcctcccgagtagctg

SEQ ID NO: 19385 - DNA, 2048 bp, Homo sapiens
tgtcagtattggtggaagagcataccatgtagatagtccagggataagccacagtagttgagagtgctttctattaggaagttttaagtatcttttagtactttacataaaatatttgtatgagtatttcttggtaagaaaaactgccaggtcatttatctgtatttgagttaaaaatggttttgtttgtgttttaatttttgttagttgggaaactgaagtccagagagagtaggtcgagtgaaaacgagcccagattctcttgctcacttaagtgaaatgagctgagcgcacagaccccatgccctcgttcattatttcccgggtcttgttgtgggaactgttttctgaggcagtatgttttgtggaaagagagtaatttgctttggagtcagacacctgggttcaaattcctacttgtctacttacggtattagaaaatttaaacctctttcatctgcaaaacagaggtaataataccagagtcatagagttgtcatgaggataagatgaagtcataagataaatcatcttggtgtagtacctgccacataggagatgctcattacttagggatttttgttgtttctttatacatgatgacatttgaatgttgggattttgtacaaggaacacgttaacacatgagtaaactgtgtttacctagagggcataatttgaaggttgtgttttctctgtcccaaattaaatgcattggggaagtttataattacaggaattccacgcatgaacactgtttttttgttgttgttttttggttgttttttttttgagactgtgtctcactctgtcgcccaggctggagtgcagtggcacaatcttggctcactgcaacctccgcctcccaggtttaagtgattctcctgcctcagcctcctgagtatctaggattataggcacgcgccaccacgcccgtctaatttttgtatttttagtagagacggggtttcaccatgttggtcaagctggtctcgaactcctgacctcctgatctgcctcagcctcccaaagtgctggaattataggcgtgagccacgtaaggtctatcatttatttttctttaagttgcctgtatcttctagctgtaactttaaaaagagttctttctaatgcattttttttttttacccccaacaccacctttttttttttttttttttttctggagatggcctcttgctttgtcacccaagctggagtacagtggcacaatctttgctcactgcaacctccacctcccaggttcaaatgattctcccacctcagcctccaaagtagctggcaatacaggcaagcaccaccacacccggctaacttttttatttttagtagaaacagggtttaaccatattggccaggctggtcttgaactcctgacctcaggtgatccgcccgcctcggcctcccaaagtgctgggattacaggcatgaaccactgcgcctggcccaccattttaaacagagaaccaattccccattttttgtatccatttgctttatcttttttatatcttagaatatcaacctagaagctaggcacagtggctcacacctataatctcagcacttttggaggccaaggcaggaaggattgcttgaggacaggagttcgagaccagtgtgagcaaaatatggagaccttgtctctacaaaaaataaaatagttgtgggtgtggtggtaccagatgtggtggtacacacctgtgtagttccagctacccgacaggctgaggcgggaagagctcttgagcccaggagttcaaggctacagtgagctatgattgcaccactgcactttagcctgggtaacagagcaagtccttgcctcacaaaaaaaaaaaaaaaaaaaaaaaaaaatgtttccctagcgttcatatgtaaacattcagactcactgaggtaagtatatgaatatattcaaatgttgataatcgtgatgccttttgtttttaaaccatttgtacaggttgaaatttaatcctaaatggagttgactatttccttgtgggttgttgttttactgattt

SEQ ID NO: 19386 - DNA, 1033 bp, Homo sapiens
tgaggtcaggagatcgagaccgtcctggctaacacgatgaaaccccgtctctactaaaaatacaaaaaattagccgggcgtggtggcgggcgcctgtagtcccagctactcgggaggctgaggcaggagaatggcgtgaacctgggaggtggagcctgcagtgagccgagatcgcgccactgcactccagcctgggcgacagagcgagactccgtctcaaaaaaaaaaaacaaaaagtaaataatctttgtgctggtatacctctgttaggctgaatttggttgtgcatagaattacacttgatttttgtagtacaaagttactagttttactcagattagtagagcatagcttttttccaatatggctggaaatacttttaagtgtgcatttagttttgaaagattttatttcttatacatattttatcttctagatgttgattttattagctccttaatgatatgtctgttagcttattgttcctactttaattaaccaggattgtacatttattctgtcgacttgcatctctaacttggtaccattctcttcatcccagtacatatttttatatcacttctgggaagtgtcctgatgattgtcattcacagtgtaagttattatttatattgacagctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgaggtactgtatatacaaatgtcttcatggttttattgctgatatctgaagtccttagataactttgctaattccctgtttcagggctgttaatgcatttaaaaatctgcatccagcaattctgaatcttgaaattctctactcttcacagcttgctgatgtgtttac

SEQ ID NO: 19387 - DNA, 1072 bp, Homo sapiens
gcacgtctgtaatcccagctactcgggaggctgaggcttgagaatcgtttgcacctgggagacggaggttgcagtgagccgagatcgcaccattgccctccatcctgggcagtgaagtaagactctgtctccaggaaaaaaaaagaaaagaaacaagaaaaacatactcttggccaggcacagtggctcacacctgtaatcccaggactttgggaggccaaggcaggaggagcccaggagtttgagaccagcctgagcaacataacaagaccctgtctctaccaaaataaaagtttaaaaattagtcatgcatgatgatgcatgcctatagtcctagctacttgggaggctaaggcaggaggattacttgaacccaggaatttgaggctttagtgagccgtgatcatgccactatactccagcctgggcaacagagttgctgtctctttttaaaacaaaacaaaattttgcagtgctgtgctataactgcactatccagcgtggtagctactagccacatgcagctattatactcttgaaatgtggctagtgagactgaagaactgaattgttggttgtatgtaatcttaatattatatattaaagtaggcgtacatggacagtagctaccatgttcaactgtgcagttctaagcctttttctttaatgtgtagatgaatgtgctattttttataaaaatggtatcatgccccttaaggtagctttgtagcaaacctttaatttagaaagtatgtgatccttgcttatgttgttagatgctcttctacactgatctacagacaatgctttgtgaacatctttgctaactaaatctctgggcatgtccttaaagataaattgcaagaacagaactgctgcgacaggggaaatatggatggatagatggatggatgattaaatggatggatgattagatggatgaatgattggatggatggatggatggatgattggatggatggatagatggatgattggatggttggatggatagatggatgattggatggatggatggatgattggatggatggatggatggatgattgga

SEQ ID NO: 19388 - DNA, 1020 bp, Homo sapiens
tatagttttatcgtattatgaaatagatgctatttaaacattttgccttttactgagtcaaataacttttttgtttttaaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttgggtatgtacgcctcgcgaggtctctgaacattagattttggagtgccagacaaactgtgttttacataatcgtgtggactttgccaggtaagaaatgactgtgctttcagggcagaatagagaagacatgaaaatcttgtggattcctaccatttgttttaaattctcctttcccgttaactctttccatcgttagccttataataaaaacattactttctccactgcacaacattggttttggaaaccacaatttgtgaagaggttacttaccactctgatgggtaatttttctcccctattagtttgtttctcaaacaaaatcttcctcaacctttcccactggcaggtgtatactatcagatactagaaactcagaaaattgtatttgatttgagtaaacatcctcactatcatctggacttgaatctggaatttaagagagtgaatacagtcaagtataataaatgcactaaagtataatggaccaaagcctgcgtaaggtgggctaatacctgcctcacaggattggttcaaggattaggcacaaatacggagcatttatgccatgcctggaacatcgtgttcagtaaatggatatggcgagactgtgtattgttagatttgagccctgctgtgccttagtcccagctactcaggaggctgaggctggaggattgcttgagcccaggagttctgggttacagtgtgctgtgctgatgggatgtttgcactaagtgcagcatcaatatggtgacctcctgggaacaggagactcccagg

SEQ ID NO: 19389 - DNA, 1059 bp, Homo sapiens
ccctaactgaattggcaaactagataccttcttgggttatggtatattagagaaacacgaaaactactggcatttggactttcttagaattttgtggctcattaaaaattgtatctggctcagtgtgatggagggttgggaccgggcagggtcttgctctgtcacccaggctggagtgcagtggtgcagtcatggctcgctgcagcctcgacttcccagctcaaacagttctgcatcagtctcccgagtagctgggactacaggcacacactaccatgcccggctaattttttttttaattttgtattttgtagagagggggtctcactatgtttgttgtccaggcttacgtgtgagttttaaataaaccatttctttttctttcagatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggca

SEQ ID NO: 19390 - DNA, 1049 bp, Homo sapiens
gtattcatgaaactccagggtttttgagaattgtgcctagtggcccagtgcagctgaagttggaagcccgtgcatgttgctaatgctactcataataggaagctcagttttaaccctgggggttggggaagagcagcaagcctggggttagagaaacagacacgtataaaaagcatcatccagccgagtgcggcggctcacgcctgtaatgccaacactttgagaggccgaggagagcagattgtatgagctcaggagttggacaccagcctgggcaatatggcaaaacctcatctctacaaaaaatacaaaaattagctgggtgtggtggtgtgcgcctatagtccctgctactcaggaggctgaggtaggaggatcacttgagcccaagaggttgaggctgcaggatctcgccactgcactccagcctgggcgacagagcaagaccctgtctcaaaaaaaaaaagaaagcaaagaaagaaaagaaaagaaaaaaaaatcatcctctgatcacattctccatagtctggtggtctgacctctgaccacacattaagcagactgattcttgctttcacacagcttccaccaaagtcttttcatcatagtctttttttgggacagcatctcgctgtgtagctcacgttggagaacagtggcaagatctcagctcattgcaaccccgcctcccgggttcaagcgattctcctgcctcagcctcccttgtagctgggactacaggcgcccgccaccatgcccgactaatttttgtatttttagtagagagggggtttcaccatgttggccaggctggtcttgaactcctgacctcaggtgacctgcccaccttggcctcccatagtgctgggattacaggcgtgagccaccgcacccggcctccatcatagtcttaacagcacatactcccattttccccagctatttccaccattgcctataacaatgtgctatggttaaggtgatcgcatagtttatcattaaaaccagaacacttttgagagtgcaagtggaacctattaataatgaca

SEQ ID NO: 19391 - DNA, 1047 bp, Homo sapiens
ttacctccactccccttccctcccttcccctcccctccccttccctcccttcccctacccttccctccacttccctcccctcccctcctctcccctccctttccttcccctccctcccctgcccttccttcctctccccttccctctttctttttctttctttctttttttgagatggagtcttgctctgttgccaggctggagtgcagtggtgtgatctcggctcactgcaacctctgcctcccgggttcaaggattctcctgccttagcctcccgagtagttgggactacaggcacctgccaccacgcccagctactttttgtatttttagtagagatgggatttcactacattggccaggctggtcttgaactcctgacctcaggtgatctgcctgctccagcctcccaaaatgctgggattacaggtgtgagccaccatgcccagcctcctatttctttttcttaaataaaaggtaatatcctacaaaacactgttttacatcttgcctttttctctggagaattcctgtctgaccactgagagctgctgctgcctctgccccattccttttaaaaataactgtgtagtatttaacggtgtggatttaattttagagactgatgattcctttcagaaatttaattttgtataacgtaagtaatataagaatacatttttggctgtgcatggtggctcatgcctgtaatcccaggaccgtaggaggccaacgtgtgtggattgcttgagcccaggagtttgagaccagcctggtgggggggcagcatgacaaaacctcatctctactaaaaataaaaaaaattagatgtggtggtgcacacctgtaatcccaggtactggggaggctgaggttggaggatcccttgagcccaggagtttgaggctgccatgagctgtgatcatgccattgcaatccaggctgggtgacagagtgagaccctgtctcaaaaaacaacaacaacaacacaaaaaacaggctgggcgtggtggctcacgcttttaatcccagcactttgggaggctg

SEQ ID NO: 19392 - DNA, 1080 bp, Homo sapiens
tatggaattagtggtggtggttacataacatcgtgaatgtacttaatgctactgaattgtatactttattatttatttatttatttatttttgagatggagttccagtcttgttgctcaggctggagtgcagtggcgcgatctcagctcactgcaacctccgcctcctgggtacaagtgattctcctgcctcagcctcccgagtagctgggattacaggcatgcgccaccacgcctggctaattctgtatttttggtagagacgcggtgggggggggcgggtttcaccatgttggccaggctggtcttgaactcccgacctcaggtgatccacccgtctcagcctcccaaagtgctgggattacaggcatgagccactgcacctggcctggctttctcattttctagctctctgactgtggacaagttacctgatttctcaaagaatcagtttctcatttgtaaagtgtggataataaaagagtctgtattctgcagattaaataagaggcataagattgagctctgtgcctggggaacaatgggtacaccctccctcccctttctcccctctgccaactggacatttgcatttaaatggggactcttgaagactaaaaacactctaaactccaagggaggaatggttggaatttcagaaaaattcatagctcttatctagggtaaggtctgggtcttttcctgtggagagttaagcttttaggtcctcctcacctgaggccccgggctgacggaggcattggaagcttgtaaaagtcagggctgagatgacctatctacaaagagcatttctggcaccctcatttcaagcaggtattcagtgtatgtgcataagaatgacgtggagaggaaaggagaaagaggtggaaaagggggagggagaaaggacccgatcaaggtcaacagcctgaaccagtcagaggcctcagcctggggctggattctggaggaaatgagacggtaggtgctacatcacccatggaaacaaaggagcagccacccagccaggaaaagccccaaacccttgaaaccccacgtttagcttgcgagctctctgctc

SEQ ID NO: 19393 - DNA, 1051 bp, Homo sapiens
ccactggggtggtggagcagacccaggtctgggatccaggtgttctgcaaagagccagatagttccacatataattggccttctgccctggtatctctgtacctttctgtaccaaagtgaacagctggttcttaaggtcagactatgcagctgattctcaaagtcaaacggtagagctccaacaacctgggataatatcttaaagactggctcaggctggagcagtggctcacgcctataattccagagctttgggaggccaaggcaggaagatctcttgaggccaggagtttgagaccaacctgggcaacgtagtgaaaccccatgtctactaaaaaataatttttaaaaattagccatatgcagtggctcgtgcctatagtcctagctacttgggaggctgaggcaggaagattgcctgagcccaggaagtcaaggctacagtgagttatgatcacactactgcactccggcctgggcaacagagttgagaccctgactttaaaagaaaaaaaagaagaatggcttatgcctctgccctgtggacctcacagagagagtcttgggtcctgggaaacactggggaagcagaagaggtagccaccctgttgtacccggttctgccaggcacagatcacctgaggagtctgcccagcatccccttgtaagatgagaaaacctgtcccttagagaggggctgaggaacagggtgcaacagcccagcagggctaggggtcagttggaacacaggctgggatggagtttacacgtccttgtaggaggaatgaccttcagtgcaggcctctttgaggcccgtgcccttctagcaattctcccactgcccaaaacatctctggaattccttccataaagagccatgtttagcacttcaaaggtgccaggcccattcatttgatcctcagcttgcctcttgggtcaaatacaaaaatcagatacatatatatatatatatatatatatatttttttttttttttttttttttttgagacagagtctcactctgtcgctgaggctggtgtgcagtggca

SEQ ID NO: 19394 - DNA, 1051 bp, Homo sapiens
gtcacatgttacatcgctcacacagagaagcagaatttatcaattttcaaagggaaaatgtctctgtctactgacaaggttttaatttttgcttttttttttttttgagatggagtctcactctgtctcccaggctggagtgcagtggcaggatctcggctcactgcaagctccgcctcccgggctcacaccattctcctgcctcagcctcccaagtagctgggactacaggcgcccgccaccacgcccggagaattttttgtatttttagtagagacggggtttcaccgtgttagccaggatggtctcgatctgctgaccttgtgatccacccgcctcggcctcccaaagtgctgggattacaggtgtgagccaccgcacctggccaatttttgcttatttttcctcaaagggaggaaaactgacaggttgctttaagagctgagtgattgagagtccttctgaacaggacttcgggaatttactcctaatcttttcccatggttaacttgtcttcactctgtttctagaactctggtttttatacttgagactctgtagtcactgtggaaagaggtgtgactgataaagaactgcctttaaatacctgagtcctcgtcagcttcttcactgctacaacctggagacctcgtaatttggttgggacgcaaatttgcaactggtattctgctccaaagaggttctccccatgtacctgcaaattaaaatcagagtaggaaatcaaagctggtattgctttgccatctacagctttacaataataagtacttacatggaagaggaattctttgtggtgagaaagcccctggcctgtgttcacgtacattatggatggtctgcaattgacaggacatgcgtcagcccttgaggagtctttctcccttttttggagacagggtctcactctgttgcccaggctagagcacagtggaacaatcatggctcagtgtagcctcaacctcccaggctcaagtgatcctccacctcagcctgggaaagtgttgggatgacaggcatgagccactacact

SEQ ID NO: 19395 - DNA, 1053 bp, Homo sapiens
gcggcttccggcttcctggccgtcaagcgacgaccgctgtcgcaaaggcgccgtcacgtagataggcggcctctaccaactcacgacagctaggcggggagcgccgcctcaaagggtgcaaccttgatttcccagaggacgagtctgtctcagtatctacgtcattccgtagcctccgctgccgccatctttgttggggctgacaacctgcaagccaagaagtacgagaagggccaggcgcggtggctcacgcctgtaatcccagcactttgggaggccgagacgggtggatcacctgaggtcaggagttcgagaccagcctgaccaacgtggtgaaaccctgtctctactaaatacaaaatattagccggacgtgggggcgcgtgcctgtaatcccagctacttgggaggctgaggcaggagaatcgcttgaacccgggaggcggaggttgcagtgagccgagattccgccagtgcactccagcctggacaacaagagctaaaactctgtctcagaaaaaaaaaaaaaaagtacctggaaaaagtcgcagacagcgagcttttcgccagtgccaggaatacagataaaacgagagagactaagggagggagcgcgagcactagcgcgcgagagagagagcgagagcgcgcgcgccgatgacgtcacgctcggcgtctcggccatcttagctgtagatagaggcggcaacctcggaagtgcggagcgggtgggcctatatagatgttgaggtgcggaggccgtgggcttttgttgggcctggctgtagccgcagcagcggtaatggcagcacggcttatgggctggtggggtccccgcgctggctttcgccttttcataccggaggagctgtctcgctaccgcggcggcccaggggacccgggcctgtacttggcgttgctcggccgtgtctacgatgtgtcctccggccggaggcactacgagcctgggtcccactatagcggcttcgcaggtatcagcgaggctgctcacgcctttctctccgctggcgcgagccagtagccacctgcgcg

SEQ ID NO: 19396 - DNA, 1032 bp, Homo sapiens
tgacctccaaaatttaaaaagaaaaaaaaagtgcagggcaagcctaagatcagctactaggctgacattaaataagcattttccacttgtcattatcttaggggaattgggaagctgcctctagcacttaaaatacaagccacttccctctgtctaggaagtactaaagaaatacaaaagttgacagaaaaggaatgaagtccagttggtctcgcaaatcccctgagatagtccagcaggggaagggacttactcaggggtacacagtgagttagaagcagagctgggactggaatcaaggtgttttgtcgctgctagttgaaggcagttttcgttgcgctgccctgctgcgtgctgtgggagctgtcgttggatgtttgcacaagtgtgggcataaaaccttcgatgtctggagtgctttttatttttcagtgtgctctgctgtttactgagctcccgtgttctggtattcattgaccatctttatttaccactacctaccttgtgtcaggggctgtggaatccaagatgtctgcaacatgctccccaccgcccacacagtctagttgggaagcagttatgtccacgtattcgttcattcagtattttatttctcattgagatgtaattcacgtgatgtaaagtccttttaacgtatacaattcagtggggttttttgttgtttagagacagggtctgcctctgtcacccaggctggcgtgcagtggcatgatcttggctcactgcaacctccgcctcccaagctcaagcaatccttccacttcagcctcccaagtagcggggaccataggtgtgcaccatcacgtgcagctaatttttgtattttttgtagagatgggttttcgccatgttggccaggccggtcttgaactcctgagctcaagtgattcagccgctgaaagtgttgggattacaggtgtgagccactgcccccaacctttttatttatttatttttatttttcgagataaactggttctttagcccaggctggagtgcggtggcgcaatc

SEQ ID NO: 19397 - DNA, 1036 bp, Homo sapiens
ggagggtacctgcagtgatggcttcaactgctgtcttaaaaacaggtgaggcgggcatggtggcttgtgggccacacctgtggtcctggctacttgggagactgaggcaggcaggtcgcttgagctcaggagttggagtccagcctgggcaacataacaaaaaaacagtaacaaacaaaaaaaaccactgcaaattcggagttctcagccttaaatgagcggagcaagggcaaaggtagcaggaaggaaagctccttctttcctggccgctagctttgaagagacagcttctccagtgtcatctcaagaaagaggggactgtgagaacctggcctgctcactttatggagagaagctaagataggcgtgggccttcctgtgacacaggcctgaatgcaggtagcctcagagagcactggtctctgagactccaggaggaggagactccaggaggcctgcgtgcgttcagatgcttgactttgcttccttgggccctgcctccttttccctccccacagccttcccctgtgtctcctgaacctcttcttgctttcatgactgagtagttcaggctctgccttccccacaaaacccttccagggccaccctagtgaactgcggggccctatccctgtgcctcagctcagtttgttgtcttctgttcacctgtgtgtgtcccattagactgagaggaacaagtgccgaaggcagggacaaggtgtggagtacagatccccaatgatgggatggaggctgggtagaagagggaggcgtttgggtgacagccttgttcttggtaagctagaagtaggatgttttctcgctgggggcagtttctctgacagcaggcaccggaagctgtctgaggcgtcagttccaagaacctcagtttctttcttgcaaggcctctgagtccatcagagactgagcccagtgccctgaggtgggcaaggcccctgcccaagataggagggtgctcaggttgttgggccacagctgaatcctccgtgtctgaagcctagtgccatcaaggact

SEQ ID NO: 19398 - DNA, 1018 bp, Homo sapiens
ctggcctaggctgtcatttctcacttggattactgaaggatcctaactgtactccctccctccaatccctcctccacactgctgggagccgtctttctttctttctttctttctttttttttttttgagatggagtcttgctcttttgcccaggctggagtacagtggcgcgatctcggctcactgcaacctcggtggcacaatcttggctcactgcaacctccactccctgggttcaagcgattctcctgcctcagcctcccaagtagctggggattacaggcacgtgccactacacccagctaatttttgtactcttagtagagatggggtttcactatgttggtcaggctggtctcgaaatcctgaccttgtgatccacccacctcgtcctcccaaagtgccaggattgcatgcgtgagccaccgcacctggccaagctctttcttaaagatgatcaaggcatcccccatttaagcctcctcaggggctcccctgatctataaggactgagtgccagctcctctgctgcgtgccacacgaggcccttctgtggcctctctcctcttaggcctgtacctttcccatctcctcccatgtgcacctcctgtccagcctccctctcactgcgttatgtctgcagtgccttcacacaagctgtttcttttgcctggaatgacgcttcttcctccgttgaattaatccaccccgtattgcttcaatattcagctcaatcaggcccctcttgggagccttcattaactgttgggccagcagtgagctatagacgcactttccctgctccatggctgtgctcatatcacagtgggctcttaccatgaacttcctatcaacctcttgcactggacctcagacactctgaggacagagccccagtgtgattcagctccatacccctatatccacatgactcagctccgtacccctatatccacgactcagctccatatccctatatccacaactcagctccgtacccctatattcacatgactca

SEQ ID NO: 19399 - DNA, 1020 bp, Homo sapiens
cttgccgcagaggctgctcagcctgagccagccacagggctgggtggggcaggcttgggtccccaagcaagaccacagaggaggaggccaaaagcaagccatgtgcctgtagccctcctaggagccaacccaaggtgcgtggggctgggaaaacctaacagcccccgggctatggcctatttatcctagagccccttgaggggacctagtgagggtggcagctgctctctagctggctggttgggctgagttctccccgaggatccaaacacacacacacacagacacacacacacatacacacatacacacacacctggctggttgggctgagtcctccctgaggatgcaaacacacacacacggacacacacacacacacacggacacacacaaacacacctcgctggttgggctgagtcctccctgaggacacacacagacacacatgcacatacatgttcacacacacacctgactggttggctgaggacacacacacacacacacacacacacacacaaacacacacacaccgggctggtgggcagaggtgtgcagagataaaggagcagctcaaaagcctaaaggtccactagtctgagaaacgccaccaccctcactttccaacactattgggaggaaacctggaacaactccttcctgatagcccagcctggagatccccgggcagggcagccagttttgagggctccgatgccctgtcaccatcctccccaatctcccctgtgaccccttgacatcctcagctcaccgtgtacttgggcaagcgggacttcgtagatcacctggacaaagtggaccctgtaggtaagttttcccagaaagggacagctcgttccccaagaggggaagaagttcccgggcccaggaaagcggggagcggccctttcaggaagtgagctggtgtgtccccctcctagatggcgtggtgcttgtggaccctgactacctgaaggaccgcaaaggtactggccccaagtccagggggcccaggga

SEQ ID NO: 19400 - DNA, 1049 bp, Homo sapiens
tgcggcgtagactttgagattcgagccttctgtgctaaatcactagaagagaaaagccacaaaaggtaagggaagtgacctcctctgtggtgtaagaggaggctttcctccccgcttccaggagcccaggccccgtgcgggggaggagtagggttggggtgtgtgaggaatgacccctcctgcccctactctgatcccaggaactctgtgcggctggtgatccgaaaggtgcagttcgccccggagaaacccggcccccagccttcagccgaaaccacacgccacttcctcatgtctgaccggtccctgcacctcgaggcttccctggacaaggaggtggggcgtgagagggtgacacggatgccacggtgcagtttagaccctgggggaggggcgaagccacacatcaagaggacatttgtaaaggaggttgccttggctgggtgtggacagttgccgtgggcttgggtttgaggggagggggccagaacaatgtgtctgtgtttggggacacactgatgatgggaacagtgaaaaccagttccaattcacatgaccccctccccccaaaagctgtactaccatggggagcccctcaatgtaaatgtccacgtcaccaacaactccaccaagaccgtcaagaagatcaaagtctctggtaggaggtggggtttggaagggggtcttcggggagggcgttactgcacaggtggctcctggtgtgatctcagcccaggccatttcccagtgcgggagacccaccagggctcaaagaatttaggttgttccataatgatacggggagcctcggtgtttactgcttcagtggggagcatgggggggccacgccacggggtctggagttgtggtgtggtggtggcttgtgctccatccagagctgcctgaccccgtcccaccccacagtgagacagtacgccgacatctgcctcttcagcaccgcccagtacaagtgtcctgtggctcaactcgaacaagagtgagtatcgggagagacccatgttccaatctaggggagaagagcaggatca

SEQ ID NO: 19401 - DNA, 1042 bp, Homo sapiens
gttgcagtgagccaagattgcaccactgcactccagcttgggcgacaaagcgagaccttgtcttaaacaaaacaaaacaaaacaaaaaaacggggcgggtccaaaccacaacctttgctttgaaccttgtgggactctgcttgggtttctcttttagcctcttttggtagtttggcctggaccctcaacctgggatttccagcaattccacaaataccctctgaccttagatgtggtatttcccttctggacttctcggcttgaagcaatgttagccttcctcagttgcctccagccttactctcctctcccctcaggagaccgggtgacctgctcccagtgcttctgtctggcctgccttaagctgcttaagaaagcattctgcttccccctttccaccctaaaatgcaagggcttgagggagggctgtacctcctttgacatggggctagccagggcctaccttctccctgctgcagaccttttctcagtgcctgtccccctgactccacctcagagagctgtggcactgtcaagcagctagtgtggtcatctcttgtgctattcctgtctgttttccagtgagaaatggtgtctccctttactacaccatcttgtgttgggggctggggagagggatgggagaggaacatattcagtatttatttgctggccttaaggagcccaaggtgtatttctcctcttgtttcaagataaggcttggttttcagctggtgatgagggtaatcgtctgatattagggaagattgaattgcgttaatctcttagccatgtgtggggaggccagatggacctgctactttgtagccacagccacacttgacctctttgaggttccttttctccaccagcctggctgcagcgtggtgaggaaaagcatgtggtttgaagttgcagccctgagttcaagtcctagtttcttcccttacaatgtaaccctggccctgctccccttactgcagattctgccaagagccttaccctctctaagcttcattcagtcctgtatcgtgggcatggt

SEQ ID NO: 19402 - DNA, 1050 bp, Homo sapiens
atcaggttaataagtcaactctcaaagcatttcttgaattcacacagagtatagtaagatacaaaaacgtgacttggtagaagacttggatcctgtccacagctcacggccatttgctctctccagttcttttgccattctcctccgaaccaaccagtccttgacttgagactgggcttctcttatctataggaagctcttctagggggtaatggaaaaagggttttgaggctctttgttcttactaagggcgggaatagtaaagggaggagagaaaagagggatggaattgtagtgacccaagagagcccctggagattttgtccagtggctagacagcctgaggttgtacgtgctacgtgtgggtaggattttgtgttctgtttgaggaaagatctagaactaggcacagaggacacagtggtgatacagtctagtagtagggagagacattaatcaagtaattatttattaatgtgtgtgtgtgtgtgtgtgtgtgtgtgtgtgtgtgtgtgtgtgtgattgcaagccatgataaggactgtagtgaaaactttaacatgccgtgggcacatataacaagagttgttttgagcatatgttctcaggatctcctgagggctgtgtcatggaaaaaaaattgcttttacgagacaaaacttttataagacaaaaatatctagttgattgagagagacgtaaatcatgtcagaaagctaaactggcattgctgcagaaagatgagatagagttgaaccagcaggtagagtttggtgatggtgagaattgggagactctggaatggggccattcttatggtgaagcatttggtcaacaattgagggcaagaagcctgaggatggggtggaaactccaggcttaattccaaaaggatttcttctgaatcttcctgtgggaggggaaaaaaaatggtttatttgtttgtctcaaaagttaagagcatgtatatggaaagagcttatgactcatataatcctcatttttacttactgggggagggactctgggtcctgggtctgtagtttagat

SEQ ID NO: 19403 - DNA, 1032 bp, Homo sapiens
agtactttgggaggccgaggtggagtggatcacctgaggttaggagttcgagaccagcctggccaacatggtgaaaccccatctctactaaaaatacaaaaattagccgggcatggtggtgggtgcctgtaatcccagctactggggaggctgaggcaggagaatcgcttgaacccgggagatagatgttgcagtgagccgagatcgcaccattgaactccagcctaggcgacaagagtgagactccatctcaaaaaaaagagctatggggagagtggacaatgacagtgatctctgagatggccgatatgggcaagctcctaaagtggtaaagatcaggaccggaaggatggggcagattacagcactcattgtttagaggagggtactggaaagccggttagaccaccgcagcttgaatatgtcttcttcaaaagaaccttttcctggctccccagcctcggtcaggtgtgctctcttggcaccctgcacttcacagcacataagacagaccagagctctttccacgaccaaaaccttccttcctcctttttggtccaagagacacacttggcagcagcaggaggagtgtcactccatacgtttttatttttatctttacttttttatcttttctgttttacatgagatgtgtatttaaataaccagacactgggccgggcgcggtggctcacgcctgtaatcccagcactttgggaggccgaggcgggcagatcacctgaggtcaggagttcgagaccagcctgactaacatggtgaacctccgtctctactaaaaacacacaaaaaattagccgggtgtagtggtgggcgcctgtaatcccagctacttgggaggctgaggcaggagaatcccttgaacccgggaggtggaggttgcagtgagccgagatcgcgccattgcactccagcctgggcaacagggtgagacactgtctcaaaaaataaataaataaataaataaataaccagacactggactagagggggaaagtttcaaggatttttttt

SEQ ID NO: 19404 - DNA, 1051 bp, Homo sapiens
tcaagcagtcctcccacctcagcctcctaagtagctggaagcacaggtgcacactgccacacctggctaattatttatttatttatttattttttgaggtggagtctcgctctgtcgtgcaggctggtgtgcagtggcgtaatctctgctcactgcaagctctgcctcccaggttcacgccattctcctgccccagcctcccaagtagctgggactacaggcgccagccaccacgcccggctaatttttttttatttttagtagagacggggtttcatcatgttagccaggatggtcttgatctcctgacctcatgatctgcctgcctcggcctcccaaagtgctgggattacagatgtgagccaccgctcccggcctaattttttaatttttaaattattatttatttatttatttatttatttatttatttatttatttatttttgagacagcgtttcactcctatcgcccaggctgcagtgcaatggcacgatctcggctcactgtaacttccacctcccagagtcaagcaattctgcctcagcctccctagtaattgggactacaggtgcataccaccacgtccagctaattttttgtactttttatagagacacggggtctcgccatgttgctcaggatggtctctaactcctgggctcaagtgatcctcctgcctcggcctcccaaagtgctcacattacaggcgtgggccactgtacctgacgattttttctcttttggatatatacccagcagtggtattgcccgatcttacgatagttctgttttcagttttttgaggaacctgcttactgttgtccatagaggctgtactaatttagattcccaccaaaagtgtataagagttcccctttctccatatccttggcagcatctctttttttttttgtctttttaaaattattttatttttatttattcatttttattttatttattattttatttgtttatttatttatttatttatttatttatttttgagacagagtctcagtttgttgcccaggctggggtgcagtggc

SEQ ID NO: 19405 - DNA, 1050 bp, Homo sapiens
agacggagtctcactctgtcgcccaggctggagtgcagtggcgcaatctcagctcactgcaagctctgcctcccaggttcacgccattctcctgcctcagcctcccaagtagctgggactacaggcgcccgcaaccacgcccagctaattttttgtatttttagtagagacggggtttcaccgtgttagccagcatggtctcgatctcctgacctcgtgatccacctgcctcggcctcccaaagtgctgggattacaggcgtgagccaccgtgcccggccactcacttcttccaacttttcccgtagaacattcactctgaaccaatccaggaaaagggcagccagccaccagggttcctgccacgtgccctcctgatatgctggtcttcactcccatatcttgactggataccactttacccccctctagctctgtaatccttttctaaagtcttgacacagtattcttctgtctcctgcccctaggaccctgctgggatctttgagcttgtggaggtggtcggcaatggaacctacggacaggtgtacaaggtgagacgaatggtgtggaagtatgacctccacatctgcagggcagtcttgggaggagtggaaggaagtagattcctggtctgcaggtctgaagggggctatgggagatgctagagtctagggccctggaaaggtagagtgggggagaggaaagagcacccagaaggaggtactgttgatgcctctctctacctgagtgcagagccagtcccggacatggtgggaacaggccagcagccaggcagggtggcctgcagcagtgagagcaggtggaagggcatacggccttgtgtgtcagaactctcctgggattcagagagagctaaggccagagatgtgggtttggcctctccccagaccacaaagagacccaggactttgaggtagtgggacctaatgggtggccttctgcagaggggatgtggcctctgctcccacagctggcctgctggggccagagctcaggcttttggcttttgagctgcctctgtccctga

SEQ ID NO: 19406 - DNA, 1048 bp, Homo sapiens
tgtccagcatagcaacctggcacacgggcttgggagtcagaactcctggggtttgcaccctggctggctgaacggtagcctgtgatcttgggcaagtggggacctctctgaggttgttttcccatctgtgaaatgggaataacccctccctcaaggctgtagcaagggttaaatggggtcacttgggactgggcctggcctgtggctggacactttaggtgtgccctgaacaggagcttctctgtatttccctgtgtccccctccagctctgtgaggacctcttctctcgcgttagtgagaaccagagtgctcagctatcctactctgtggaggtaagcccgggtcttggtggcagggctgagaggggtccagactgctgagggctgtcgctggaatcagacagcctgggatctaatcctggctctgctggttactgactgtgactttggggcagtgattctgtccttcagcttcgtatgttcatctgggagacgctgttgatcggacacacctcctggcttgttgggcaggtcgctgagctagcatctgcagaatgcttcgcactgtgtattagctgcagtcacctggatcgtgtccagtggagtcagattaagttgcgttgtcattgtttttgctagttttgttacttctcatttgcttctcccactcaggtgagctatatggagatctactgtgagcgggtacgagacctcttgaaccccaagagtcggggttctctgcgggtccgggagcaccccatcctgggcccgtacgtgcaggacctgtccaaattggctgtgacctcctacgcagacattgctgacctcatggactgtggaaataaagcacggtgaggcaggctgatggagcagagggcaagggggccagggttgggaaggtgagaggcaggatccagtgactgctttctttaccctaaggactgtggctgccaccaacatgaatgagaccagcagccgttcccatgccgtctttaccatcgtcttcacacagcgctgccatgaccagctcacggggctggactcggag

SEQ ID NO: 19407 - DNA, 1058 bp, Homo sapiens
gcctgtagtcccagctactagggaggctgaggcagtagaatgacatgaacccgggaggcagaggttgcagtgagctgagatcgcaccactgcactccagcctgggtgacagacaagactctgtctcaaaaaaaaaaaaaagaaaaaatgttctcctagagatgctgtctaggagatgttataacacatgtacaggcatatgttatatagaactatacacatttactcacattcacggcctctctaatagttgtagttgcatatctattttatttatttattttgagacaagagtcacactctgtcgcccaggctggagtgcagtggcacaatctcagctcagtgcaaactctgcctcccaggttcaagtgattctcatgcctcagcctcccaagtagctgggattacaggcacccaccaccacgccgggctaatttttgtattttagtagagacagggtttcgccatgttggccaggctggtctcaaactcctggcctcaaatgatgcactggccttggcctcctgaagtgctggtattacaggtgtgagctactgtgcttggcctgcataccttattttaaagcttcctttatttttttcacggtgtcagggtattctattgtgtagatgtaggataatgtatttaaccagcttcccactgatggacattcagattgtttcccattccttgatactacaaaaaaaggctacaatgcatagtcttacaaatgggtgttatctgtagagcagattcctagaaatggagattttgggtcaaatggtagccatgtaaaattttaatctaggccgggtgcggtggctcacgcctgtaatcccagcactttgggaggccgaggcgggcggatcacgaggtcaggagatcgagaccatcctggctaacaaggtgaaaccccatctctactaaaatagaaaaaattagccgggcgtggtggcgggcacctgtagtcccagctacttgggaggctgaggcaggagaatggcgtgaacccgggaggcggagcttgcagtgagccgagatcatgccactgcactccag

SEQ ID NO: 19408 - DNA, 1029 bp, Homo sapiens
gggatggtcttgatctcctgacctcgtgatccgcctgcctcggcctcccaaagtgctgggattataggtgtgagccaccgcacttggcctctttctttctttttttggagttttgctcttgttgaccaggctggagtgcaatggtgtgatcttggctcaccacaacctctgcctcccgggttcaagtgattctcctgcctcagcctcccgagtagctgggattacaggcatgcaccaccacgcccggctaattttgtatttttagtagagatgggatttctccatgttggtcaggctgatctttaactcctgacctcaggtgatctgtccccctcggcatccaaaagtgctgggattacaggcgtgagccactgcgcccagcctggtctgtgtttcttttactgctgtcagtttcttgttcaggttcacaaatttgttatatatacataacaaatataatatttaatatatatatacttttttttttagcctcactctgtctccgaggctggagtgcagtggcatgatctcgggtcactgcaacctctgcctcccgagttcaagcaattctcgtgcctcagccttctgagtagctgggattacaggtgggtaccaccatgcccggctaatttttgtatttttagtagagatggagttttgccatgttacccacgctggtctcaaactcctgagctcaagtgatccacctgccttggcttcccaaagtgttggggttacaggcgtgagccgcggctcccagcctacggatatatatactcttaactacagtctgtaccagcctgggcaacatggtgaaacccggtctctacaaaaaaatacaaaaattagtcaggcaaggtggcgcgtgcctgtagtgctctgagcatgcagagcattatattaagtactttacttcagataactttgattttacatgtccacctcttccattagactgagtgtaactccagtgtgctcaataaatgcagagatcttaaaatatgtttgactgattttttttttctttta

SEQ ID NO: 19409 - DNA, 1050 bp, Homo sapiens
cactgtaacctctgcctcccaggttcaggcgattctcgtgcctcagcccctcaagtagctgggattacaggcgtgcaccactacacctggctcatttttttgtatatttagtagagacagggtttcaccatgttggccgggctggtcttgatctcctgttctcaatttatccaccctccttggcctcccaaagtgctgggattataggagtgagccactgtgcctggttgaagtgtggctttttaatttgcacttccaggataggaattatattaattatggcctctttgtttattggctggctggcttgcttccttcctttcatccatttttttctttctttcatttttttctttttttgcttgccctcccttcctccctccctttcttcttcttcttcctcttccttttctcttctactatgagttgctgtttcacatctttcttttgtggcttgtctgtttatatctgtttcccatttttccattgggttgtccttttctcagtaatttggaggagctctttgtaaattatattagccctttggtatgtgttgcaaattttggtctcacagtttgtcatttacctcgttttaaaaattttttgttatgcagaaagctttaatttttatgtagatctgaccttttttttttttttttaaatttatggtttctgggtttcttattttgctgaggaagacctccccaactctcatgtttatttaaagagaaaaaaccttatcattttcaacacttgtggttttttatattttgtagtccaatccatttgcaatttatttatttttaaattagagaagtttaatataaagaattattaactaaactggagatcacccactaagacaaaagaaaaccctaaagaatacaagactagtagacataaggaacagtctcgcttccagggctgaggcagagcaccctttatttttttttctgaatagatagatagttgtcttaacgtttattcaatagttcatgtttttgtttgtaaattataacttggtaaatctcccaacctttgaactagcag

SEQ ID NO: 19410 - DNA, 1043 bp, Homo sapiens
ggagtttcgcttcgttaccaggctgtagtgcagtggcgcgatcttggctcactgctacctccacctcctgggttcaagcagttctgcctcggcctcccgagtagctgggattacaggtgtgtgccactgtgtctggctaactttgtatttttagtagagatagggtttcaccatgttgatcaggctggtctggaactcctgacctcatgtgatccacccaccttggcctcccaaagtgctgggattacaggtgtgaaccactgcacctggcctttatttatttgcttttgagacagggtcttgctctgtggctggagtctggtggcatggtgcgatcttgcccgattgcaatctctgctttccgggctcaggtgatcctctcacctcagcctctggagtagctgagactacaggcatgcaccaccatgcctcgctagtttttgtatttttagtagagataaggtttttccatgttgcccaggctggtcttgaacttctgggctcaagccatctgcctgccttggcatctcaaagtgctggcattacaggcatgagctgctgtgccttgttcattttcttattaatttataaatattggccaggtgtggtggctcatgcctataatctcagcagtttggaagactgaggcaggtggatcccttgaggtcaggagttcgagaccagcctgactaacatgaaaccccgtctctactaaacatacaaaaattagctgggtgtggtggtgcgtgcctgtaatcccagctacttgggagggtgaggcacgagaatcgcttgaatctgggaggtagaggttgcagtgagccgagattgcaccattgcactccagcctggacaataagagggaaactctgtctcccccctcaaaaaaaaaaatctgtatatctttctctctatatatatctctttgtatataatatcttcatagacattggcctttgttttttatttgttacagatatttacaggtattttccatgttttttcttattttggcttttggggtaatttatttttttgagaca

SEQ ID NO: 19411 - DNA, 1027 bp, Homo sapiens
gcctcccgagtagctgggactacaggcgtccgccaccatgcccaactaatttttgtttttttggtatagatagggttttgccatattagccaggctggtctcgaactcctgacctcaggcgatccatccccctcggcctcccaagatgctgggattacagtcatgagccaccacacccggccagcttaccttagtctataaagttaccttataagctttttaattttttagactttttttttttttttttttggagtgtagtggtgccatcttggcttactgcagcctcaacctcccaggcgcaagcgacaggcacacacaaccacacctggctaatttttgtatttttagtagagatgggatctcactctgttgcccaggctggtctcaaactcctggcctcaagcagtcctcccaccttggcctcccaaagtaatgggattatagatgtgagccactgggcctggctaggaaaatcttaagtgtagtttaaaaaatgattttatagactgtgagtttcttaagagcaaaatttaaaaaatgattttttttgtgttgaaatattttaagaccattaaattatgaatacttttttatgagcaaatagattgaggtagagcaataaaataattcttaaaacaagaaagataaagcatctcattgccttttgatttaaatctcatcagcataattcttttactactctgaatgccattttggatattcattacagtctttttttctatataatttttgtgtagctcatactgtgctatgtataatgtatttacttaatataactttttctggcttggtattacttcactgaatgaatatgtaggatgggtaggatatacctaccatacttaatagttttattttattttattttattttttttgagataggatctcattctgtcacccaggctggaatgcagtggtgcgatcttggctcactgcaacctctgcctcccaggttcgagcaagtcttgtgcctcagtcccccaagtagctgagatgacagg

SEQ ID NO: 19412 - DNA, 1018 bp, Homo sapiens
tgcgtgttctcttgtttatatcaaaattattattaggtctttactccatttatttattgtattcttttttcgttttgtattgctgttgctatttgagacattctgaattgagtgacatagtcatttttccctttggatgtcaagcattataagtagccattgcatggctggatgtggtggctcacaccggtaatcctagcactttggacggctgaggcgggtgagtcatctgagatcaggagttcgagactagcctggctaatgtggtaaagccctgtctctactaaaaatacaaaaaaattagccgggtatggtggtaggctcctgtaatcccagctacttgggaggctgaggcaggaggatcgcttgaacccaggagatggaggttgcagtgagccaagattgcgccactgcactccagcctgggcaacaaagcaacaactctgtctcaaggaaaaaaaaaaaaagtaggcaatggattagataatttctccctttttcttattgctcaaatgaaggcaacaaatacgggatgtgtggaactgttgacaaaggctggcatactgatattctcagccttctaaatttcagaaggtttaattttgttgaaggctggcattacagtaattagtattagtttgttcatgatgctataaagatacatggtaatagggaaggatatgagctggaagtctcagcatggaactgagtcagaatcttgaggttggaagtgacttctggtcttttctggctacatacaaagtcatttgatcactactttttttctttattcattaaataaatactaccaatttaataatgacagctaacacttatcaagtttgttctatatgccacactaagtactttttacatgaactattagctaatgatagtgacctattagttaccatgttataaaaaataatacagcattttgtgtgatgagagctattttctccttgatttgtggttggttgctaatgcattaggatatgcttatttgtaaactttctca

SEQ ID NO: 19413 - DNA, 1028 bp, Homo sapiens
tcagttaggagaattgcttgaacccaggaggcagaagttgcagtgagccaagatcgcgccactgcactccagcctggtcgacagagcgagactctgtctcaagagaaataagttctatctggttattcagtatctttacatgaatttatcgtctcccttttaaaatttgttcatgtttttgaattaatcaagcaccactgtcaactctgaaatgctatattcttgtcaagatgacctgtaatacatttgatgtatatataaaaggttgtggtagtattttctctggtgataagttgaaacccagcagtatgatgctggctaatgatatccattttctcctttacctcttataccaaaacctctgtagcttgttcatcctgtctacagctaattgaagtcagtcttgtctaaaccttgtttgttttgctttctttttctctgtccccaataaaactgttagggttcctttgttttcttattttctttgaaattataaaatagaattttcccaaaaactctgaagaaatgaaaatgactaagaacctcccatttctgaaatgcattatcaactgcagttttagatctgtgaattaaagagcttgtaacatgggttggttcagaaaacatgcttggtttgttaagattgcattgatgcatctaaacccggtaaatgggctttttgtgtactgttgtatctttactgtccagagcgctcagtaaactcagttggccacagcgaacagttggggtagctttttacaaaatttcaaaaaaaatactgtgatcctttttgagtttttggtggcgttcctaaagaaaatgcatagtatataaaaggtcaatgctgattattagtttttgtcttggccgttagcctatatcataataaaaatcaaatgtgaagatttcccctgagacagcagcttttattgtatctactgtgaagtctaaatctagtctttaatgattgccacaggtgtttacagtataaaccaggattttgatgtggacagcagtctttgttttat

SEQ ID NO: 19414 - DNA, 1076 bp, Homo sapiens
ttataaatatttctgaaagttttttttttttttttgagatggagtcttgctctgtcacccaggctggagtgcagtggcacgatctcggctcactgcaagctccgcctcctggcttcacgccattctcctccctcagcctcccgagtagctgggactacaggcgcccgccaccacgcctggctaattttttgtatttttagtagagacggggtttcaccgtgttagccatgatggtctcgatctcctgaccttgtgatccgcccacttcagcttcccaaagtgctgggattacaggtgtgagccaccatgcccggctatatttctgaaagttttattgcttttctgttgaagtattttctgattcagcttttcctaaactaacttcagagcttggcattacagcagtgtttatgttttgtgctttggaaatttgtagtgttggcaatgagtaagagacggttacgtgaaacacagaacaaaaggccatatagttttcaatttgacgaaaaatagtaggaatagagcttatagctaatcaccagaggacactgaaattttctactggtgttcagaaggtctttatacatggttgtaatttatataaagctgttacgctaactaatcagaatttcaatagtgaaaagctagatttaggaagctatctgtggttccagtgccataaacttgcacttagatagggaaatgaaaacagagtatataaaattaacaaaacccattagtaatactgtaaacaaacgattagaaattaaaatagtgtttgctaatagatttaaccagtagagacgatacagaggttttagtaaattagaaaccagtactgagttcttcctcctagtgagacaaagagggaaatatgaaagaatataaagacaaagaggatgaattaagagccttcaacacacatctgaaaagagttccagggcaagagaatggaaggaatagtaaagaatatttgaagagataataacttagatttttactaataaaaaatgtgagtccttaacataaatactgagtaccaaacaggaaaaataatagtaaattcaggccgggca

SEQ ID NO: 19415 - DNA, 1041 bp, Homo sapiens
ccctccttttttttcctgttgttttttatcagatgacctttataagcatcctaaactagccttgactgagatattttaacttgtcttttccaaatagtatttaattcaaaataaaataaatgatggctttgtgtaaggacctgaaaacaaagtgaatctgaacctgttttttgaggggtatgttatttggggaaaatccccctcacgtttgggcatttatgatatttttccctatcgtgcacaacttagtataactttgcactcatttaaattcagtgaattaggttttcagtttctctagaaggaaaaaagccaactttttgagcctgcctttgtttctctgcgtgtaagtgtatgtgtatataagaaatgaaaattcattttctcaccagtttactagtttatgtaagttggttccttttaatccatgtttttgagaatggacttgggaaagcaatgatagttttaaggggtcactctttgtgtttgtttcatttagatggtaaaagtaaaatagtatttaaagtactctgtttaattggatggaagcctttttatagcaacataattttctaacattttagaaaacacgttattctattttgggtgtttaaaatgtaatcagccctttcattattcataagaaattattgtctcatgaacttactaacccaggaattttaaaaattatttattatgggctgggcgcggtggctcacgcctgtaatcccagcactttgggaggccgaggcgggcggatcatgaggtcaggagatcgagaccatcctggctaacacgatgaaaccctgtctctactaaaaataataataaaaaaaaaattagctgggtatggtggcaggcgcctgtagtcccagttactcgggaggctgaggcaggagaatggtgtgaacctgggaggtggagcttgcagtgagcggagatcgtggcactgcactccagcctgggtgacagagcgagactccgtctcaaaaaaaaaaatttatttattatgtgtatttccttttatatatgggatatttt

SEQ ID NO: 19416 - DNA, 1050 bp, Homo sapiens
aactacaaatcagtagaaatttaaaaataacaaatactataaactgtcacacaaataaatttgaaaacagatgaaaaaatttctaataaaagataattagcccaaattattccaaaacaggaaaggtagtcagtaattattaaagaaagtggatctagagtaaaaaatcttattgtctcttgcctcctctcaccaaaagatattaaactgttgattttacaggtaagtttttccagactttctggaaagagcaaattcttatattttacgaactctcagggaatacaaaaagagagaaagctctccaactgtttttatgagactagtagatcttcactacaagtgagcaaacacatagaaaggtagtatgagaagaaattatagatctgtctcaggaatacagaagctaaaattttcaacatcgtaggtaaaataaagggggagaaatacatcatgaccaagtagggtgtattcccagaaatttatcggaaaatctatcattgcagtgtacacgtgaaatgattgtagaagaacagcattatattcattttggattcagagaggtatttgagaaatttgaccactcaataacttagtaaagggctatttatcaaacctttggcaaacatagttaagggtgaatatttagcagccttaccattaatggtgggaacattctggggcagacccatgctcagtaattcagaaatgaggcataagaactggaaagaaagcaacgagactgattcaattgtctgtataaagaaaccagagaatgtacaacagattgttagacctaataagagttcaacaatttgaaagttgttcaaacaaaatcaacatactaagataattgtttttctatgccccagtgataaccagttgaagaatgcagtggtggaaaaaagattgatcctattcacaagagtaaaaaaaaagaaaaaaaagaaaaagaaaaactagttagctaccaatatagctaaataaagatgggcagggtccttatagactacataataaatgaggacctgaatctgtattttcctgaat

SEQ ID NO: 19417 - DNA, 1049 bp, Homo sapiens
ctattctggactttgatgtgaatgggattttataatatgtgcctttttgtgtctggcttcagtgaagggttttagactggagagcggtaatattagttttgcgttttagaaagttcagtctcatagcactgtggtgaatagaatagggagggcaagactgagggcagaagaataaaaaaggggcctctgttgtagttgtttaagtcataagtgctggtctaaggcagaagccagaagatagatatatcatattgcagagaaggccgagttagcaggtctctgtcatagttgaatatgttggggtgaggaaaaatcagaagtatgagttggcttgggtggcttggtagatgggtggatagatcatgctacctattctctttttagcagaagatggctgagctgatgagtatcaacaacacatacattttacaaagattccttgacttgtcataagaagtctatattaaccggacccaacgaggatttctggataacagatttatcagaatgtattaaacacaattaggagtgtttattccacctttggcctttggagcaatgtttcccaaagtatattccctagagtacttgttatttgagttgtactgtgaaaagtttttttttttcttttgtcaaataaatttgggaaaggctatattatatattaccttccaagaaaacatagacataattaagaccccgagttcaaagtcctgcagtaaagaaatctttaaaaatttatttaattatggaggagcctttgcaaaataacaataataataaatttctccctttaacttgaagtttctaagacttactaagaacagaaatctttctttgctgtattcctaggagtgcactttgggagactctgctttaaagagatggtgtggggataggttgccccttggtccagccaaggacagaatcctagagatgtggaccattggtcagacctgggctaggagccctgtgctaaagaaattgcctaccattggccgggcgcggtggctcacgcctgtaattccagcactttgggaggccgagac

SEQ ID NO: 19418 - DNA, 1058 bp, Homo sapiens
caactgttcgtatttgggagctctttgagctaccagagcattcagcacatagctccagcccatccttttatcacagtattataacagtctgcttacttatcttttttttttttgaagccgtatgtatctcgaggtcagggattatatcttgctcacagttgtatcctgagggcctggttttgtgtccagcatgtagaaatgacacttagtgtttgttcaatgagtctgtgaaggtagcacattaatgattatcatgtgtaatgagtggcggaatacatttattatagtttttgtctttaaaaacgcagagaattgtctaacttggccatatgtattttcacatttcaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtgagttacctttctcacgtttttcctcttgctcacgctgaggcacactgggaagctctgggatttagcgttcattcaacagacggttcctggagtcagtgcaggcacatgttgccagcaagtggatattaacgtgtgtcacctgacccttgtcatagtctgccttgggtattccaggtaattgtgacagagaaaggagctagctagttaatcacagtgaatgtgaacctccccacctgaac

SEQ ID NO: 19419 - DNA, 1039 bp, Homo sapiens
aggctcccacacatcctgctggttttctgtaagagagactggggatagctggggcgtattcactaagtttcctggtggatgcttgactgtggaggttgtcagaggaagtcctgtatgtatccctgttggtgtgacagacaccgatcttagcagctgttttggtgattatcgtcactgtcaccagctgctgggggtgggggagggcagcactttaatccatttcttcctttggcttttcatacccagttcatctcaggacttagagcaagtagtctagatggcctgcacgcttgccctatagataaagagattggtcgtgtataggagtgcgacggatatccacccacctttctgccctagtagtaggtaactacaagttactggatttcctaagtaattcggccctttggcattaatcttcattcaaaacttgtattttttaggctaccgttgaacaactaatgtttgaagagaagaataaagctcagagattacagacagaattagatgtcagtgagcaagtccagagggattttgtaaagctttcacagacccttcaggtgaggcatttggggaaccacatacagagcacgaaggcagttttgggggacagaaccttgccgatccctgacttgaccactggcagtagctagaggtttagagactggctgctcctacctccaccccaaatgtctgactcatcattcaagccagaaacctggtgtgttcttcacacttggcccatttttctttttctgtatgccttgccaattttgcctccttatgagtaaagtactgactccttagcataccatgtaagactcttcccaaccaggcccacccctgtattttgctcatctctctgccttgttttacatgtttaactgcttgtggttcctcgcccacagcgtggtgttctgtctggtaagcatcctcatctcatcccctcctgactcctttctttcaaggctcagcgtaggtctgtcccctctgtggagctcttctaggtccctgagctgggctaaagtgcccctccctc

SEQ ID NO: 19420 - DNA, 1046 bp, Homo sapiens
tttccatatatgtgtatgtatgtatgtacatgtgtatatatatcacacaaacacacataaaaccaatatgatacgtattattattgcttttagatcccaggcagggggagccttgggattaggagcacactgtacttcaggaagttcatagccatggctttctactgggaatttagaattccttcatggccctgtcattccaaatgcagttaacctacagaggtcatttttattataagcagcattgcctggtaacagccatttcacctttatcaagtttcttccataggtattctactcattcattaaaaaaaaaatgaattgaggactcattaacattgagaaatacacatctctcacagagctcaagccttgggttggtaataagagaacagaataaacaggcagtaccctggagagctgtacaaggagggcttatgggagttcagaggagggtgatctcctttatggtgacaccttcctggaggaggcatttaacttggccttgaagcatggaatcgatctggacagacatggagatctggtgagttgtgggggtagagcttaagtggaagatccccacatagaagaacaaggcagagaagcaggaaactggagtatatacaaagagcatcttgttctacttagctggagcattaggttcatgagggagaggatagttcctgttaggaataggaaacagattcagagaagtgatgtaatctggccaaaattttactactaataagcgatagagctggtgttagaccccaggtctttgtggttccagtgcccctgctgtttcctgctccaggctcaggccttggtggaaggatgccattttccatcagcttgtatggaaagagacatagcaggtgaaagtttaaataaaacccctcactacttcctgttgactacaagcatatgttcccttctgttccagctatccagcactggtagcagatgctcaaatatgcagtgctttcaggcctctgtgctgttgtttaggctgttctgtctgaatgactttgactcctcccactaca

SEQ ID NO: 19421 - DNA, 1048 bp, Homo sapiens
cttgttaccaggtgtaccgagtgtcatggccacctccagataacaccatgtgttcagaacatcatgatgacctgcatttgcatattaaaggactaaggtgggagggccaggtttttcaagggctacgtaaatgacacacctggtcaaaccaatcccctgggccttatggaacgcagacaccgcttcctccagcatcccaatataagcagccacttttccgctgcacacggggttttctctttgttcaaatcccccctccctctgtctctgtacggggagctgttttcttcttccttccttctttcttgcctgttaaacttttcactccttaaaatcaccccacatgtgtccatgtctaaaccggcacgagaccaagaaccctggtgtccctccagtcatcagagccatatagcttgaatgcctgcctcaaggttgagacttttttcagtgggtgggaggggctggtatggcttgtgtggcactttatagctgcaggtaggatgttctggagcacggagaggatgagagctaataaagaagggagtaggtctaagagacaccacagggttggaatccacaagagaggatgtgggggcatgaaagaaggagtgggaacccccagggaggaggatgaggcatggatgggtttgtgggtgagcggggcagctgacctgtccaatgtgggagggaagttctccttggatccttctgggatacagcatttctcaggggtaccctcagagatgccttggcaaagctgccacagaagtcgacctgtgacctggttctggagttagggatttcaggtagggcaagaacagtgccctggatgtcatgcctttaagtcaaaccgccatctgcccaacggagcgagcctttggctcccagattgtccatccattctcgcttgtctcgcccgtggatgtgggtgtaacttgaactcaaaccgtctgtactgttagcccctcagctctgagctctgcagatgcctggcaggggttttgctggaattctgacttcactctagagcaggggttcacagccttgg

SEQ ID NO: 19422 - DNA, 1035 bp, Homo sapiens
tgatctttgtctcccctggaattgggcacagagcacagtggtggaaggatggtggtcatccctgtggattccatacagatacagctggcaatacatcgtccatgttcatcccattcctgagccctgggaagcatgaccctcaaattcactcagtgtgcttctcttcttatcgttccctggcaggagttccccttggccattctcaggggctgggaatgctactgtgcttaccctaccccccggttcaacctgcgggatgccatggacagctcagtatgtggccaggaccctgaggcacagaggctggcagaatactgtgaggtctaccagacacctgtgcaaggtgggttctgcatccccgactggtagtggcatttggtctggggggtggggagagcttccagggtttggagatgccagtcatggccaagcatgcagttatgaggtatggcatgtgtctgtgtaaaggtcttggcatcttgatgggtgttggagataatggggagggtcagttttccaccctccacagaggctgaatcctggactcactttaaaaaacactggaccctttatctaagtctctctggagatgacaatggtaagaggatgaacagagaggggcaggtcctagagagatagcaacagaaaggtggtaggattgggaggcgtgggaagaatgagatcccaggagctgcaggggccactggtgcctccaggacctgggaaccctccttggtgtgagcatcaggtctgcccctgttgaccttaggaactgatgaaaggaagagccggggacgagggatgttaccacctttatcaagtgcctactgtgacccagcatggccctggatgttttggggctttcccctggtgatttcatgtgctccttgtagcagccctggggatgagacataacgaatgacttgcctgtcattagtccagctctggtttattgttggcagtacctgggtgtgttactttgctcagcctagcctcaatccccacccacttcccctattagaatctggaattatc

SEQ ID NO: 19423 - DNA, 1041 bp, Homo sapiens
acctcttcctgcacccagggaggcacattgttcgaagctgacttctccctgctggatgggatcaaggccaacgtcagtctctgtagccagcagcacctggctgcccctctggtcatgctgaaactgcagcctgatgggaaactcttgcccatggtcatccaggtgagaggactcaggatttctgctcccagtctccagccttctcagctcagccccttatcgaaatgcactaagcaccatcttcaaaggcgctgggctaaggcaccagggagacgcgaaaggaggaaatgcgccaagtctctattcgaaggccttgcaatgtagctggagagacacatagggctagtctgcagaagctccgggactgaggaagtcccggaggacagagacagcccaggagggatcggggagttgggatgtcaccagccttggaggagggccaggtctcagacaagcaggagggagaggaaggaccagtcctcaggggcaagacagactgggcagaggctaaggtagaggagtcaggagattcctaggggacagttggactggggccagactaagccaggctaaggagcatgaagtgggaagctggagaaggctgtgatgaaacatgctataggcacgcggtgtgggcagtggtgtttagggtgggttggagaggggagatgctagaaacagggactggggcaacatgccccagcactgaccccaggaggaggggagctcggatatgggtagtgaccgtcgggatggagaggaccggtggatgcgagtgcagagggagatgaaggagaggggaaaggggagccaggccaggtgcctgcagaaatagcaccaataaagagaacagggtgcccaggtagacttttgtctggccaatgttgaggtaacgggaagacatttaaattgtccagcaggcagctgagaacaagagattcagtcatttgtgtagaggtggggccaaaagatgagatttcgaaaaacagtgtgggatggaggaagcaggtggtttgaatcttgtccacaatgcggggactg

SEQ ID NO: 19424 - DNA, 1022 bp, Homo sapiens
cattttcaggtatctttatggcaatgctccacatcttggtaccattttattagtttgttctcacactgctataaagaaatacctgagactgggtaatttatacagaaaagaggtttaattggttcacggttctgcaggctatacagcaaggatggtggcatctgcttggcttctcgagacacctcaggaaacttacaatcatggcggaaggtaaaggggaaatatgacatcttacatggccgaagcaggaggaaaagagagcagggaggtgctacacacttttagacaactagatctcacgagaactcactaccatgacagaagtaccaagggggatggtgttaaaccatgagaaactgctcccatgatccatttatctcctaacaggcctccagcattggggatcgcaactgaacatgaggtttgagcagggatagattcaaaccacatcactgtcccaccactgctccaacacttttgcaagattttttcttgcaaaaaaaagactttttctctgaccatccatcactaaacctgtacctcaccattaccaccacaccactacaccccattatttctgtcttctctgtccaccccgtgaccctcactttgggatcggaccacacagatgacaaccaggagcaggaggccgaggcacagggacagcaggaggaggcagtcccagagtgcagatgctgcaggagggcctggggaggaggcagccctcaggaggagggggtgtcaagacgaggagcgtccaggacatgacagagacgggaagaggagaggggccagggagctgtctagagaggagggctgagcataaaggacaccaggaaagggcgggatgggaaggatttcagggtgggggatgcccaggcctttgacctcagggaccagcacaagtcctcagtcacacaggcccctcacacccgtggggaccaccaaacacacacacacagatgggggataatggagatatgtgaggtcccatggtcagagctgaggaaggggcagaagga

SEQ ID NO: 19425 - DNA, 1025 bp, Homo sapiens
gatcatgccactacactccagcctgggcaacagagtgagactccgtctcaaaaaaggagtaagtgggctgctctgcctaaggagtcgccatccttttattcctttacttccttaatcaacttgctttcacttttgaaaataaaatagaggctgggcgcagtggcttacacctgtaatcccagcattttgggaggccgaagtgggcagatcacctgaggttagtggtttgagaccagcctggccaatatagcaaaaccccatctctactaaaaagacaaaaattagctgggtgtggtagcacgtgcctgtaatcccagctactcgggaggctgaggcaggagaatcacttgaacctgggaggcggaggttgcagtgagctaagatcacgccactgtactccagcctgggcaacaaagccagaccctgtctcaaaaaaaaaaaaaaaagttgagggcaggagctgaaagcagtcagttaaataggtgattgggggctgaggatgtgaggtcctggagtctgtctagtttcttcagtaagatgaaaaaaactcttttcttttttctctccagactcagtggttctccatccttccggacttcagcctggatctccaagaggggccctctgtagagtcccagccctactccgatcctcatatacccccggtatctaagaatgccaaggccagaacaaggaaatgtagtttagtatctggtcacgggagagaaaataaaagctgcagaggttgggggtggggtcagggattctagggatggggcagagtggcagcatcctttgtacctacaggtggatcccacaactcatttgacctttaaccttcacctgtccaagaaagagagagaagccagagatagcctgatcctgcccttccagttcagttctgaaaagtaaggttgggacctgggtacgtggatccctgagtagatcccagcatctgggccatggagaggttggggcaacaggttattgattaacctgactttatagggactgaagtccacctc

SEQ ID NO: 19426 - DNA, 2918 bp, Homo sapiens
gtgggggagggggctattcggtgagagggcatgatggggggggttggcggacggccggggggaggggaggcggcgtggctccggcctggcgcagtctctgaggagggggcggccgcggcaccggaagtgccccccacgggaggctgccctcggggtcgcaggccgcatggccaagcgtggaccggggccgcatggcagcgcggggacccctccccccaggtcccggccaccggaagcccggaacggccacatggtcggcaggagccggcagcccctagcgcggggagctagtcctcgcgggggttccgagggggcctgagattttgaggagtggaagccggaggctcgggtcctaatcaccccggagggcctgctgcaggcatatgttagcgcttcccaacctcaagggccccaggagctttcctgaaaaaccctcctgtgaagtgtggcggtcagccaggtgtaagtggcaccccttcgagctgggaggccggagaaatggggaaacagggcgtttggacaggagcccaacttttctgtcggcctgggtggacagcgcctaaaagcctcaggcagatgagtttcccaccgtgataggcgttcttcaccttgtcactgtcttcctgttgtaactggtttgggagttccacggtttcgaagtccttaactctactagcctagtatgattttctactactcactactaccaaccttttgctttcattttattgtcattcaccaccccccacctctcccactttctactgactgtactggcccggcctgaaaagccgacaggacagatgcatcctgggaaaagtgggagggccttccaggagaggctgggttcctgggttctctttgggaaccaagatcgaggtgtttggcagggggatcatttcggaaacaactttgctttctcccccttggcttgttgcaagtgcatgttggcgaggcgggaatcccccaaagaggccttgtggtttcctgtagcagtgactggtttgtgtgtggatgggggggggcagtgtaacagatgggtggggccttgtcctccggtctccaccctccccccccccaattagccctgcccttttgctggatcatagctgctcacctaattatagccctggctatatgtggggaagaggggtggttggtttcagtggcaagtaacacctgagtcctccccactcccaggaagtaggccttttctcatctctgagatttgacattccagctccctagagccttcctttcccaagccaccactttagctttgatttatgggggagaaaccagctattccaccctcccatacacacaccagttcttgagtatatttgagcccagtcagtattttaagttcaggaactttgactttattttaggtgggtaatggaataaagagttgggaaaatgtttctggagagaaatgggatagattggaggtcctgttgacctccatgcttattcacttcagttctcttcttggctctagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggttagaatttcacctccgcatcttgccttccccatgcctccagtatctttggcgctcccagcagcaagctgccaacagtgctgactttcctttaactctgcttttactgtctgattgtttttgtttagcgctcagccttcatacccattcagacaactacacctgctccccagtcttcagcctcttctgtggttacccttctgtccccgcatcattctctggcagtccctccgtttctccagctttgtgccaatctcttcaattcataggcctttatgctctagctattcagttgctccttccttattcttggttttcactttttctttcttcccttgagccgttgttaagtggttgcttccatcacgttgcccagggtttctccaattctacgccttcccctggagggactcctgcgtcaattctgagctttcaggtcaccttgctgcttcgttccccagttctagctttccctttggaactctgacgcaggatcaaactgcccctacctgccccatcccactctccttgggttccttgagcctccatgctttcatgggttttaacattcttgctagcacttccctcatcacctcagacttttcctgtctctttagaatttcaacctgattcgttcttgttgaatttcttgtggtgtttttccttaatcagtttttccatcttttgacttgacattgatcttggattattctctagtgtctggatccctctctgtgctcttctggcttccttattttctagctacatagttatttctgatctccctgcaagtccttttcttcagctctttcacatttcttagtttcttatcctttcccttctaccttccttattccccagtttctcagctccttctcctggtgtccggaaaactcttcgaaacttttactcagactcctcccactcccctagactcttagcatcttatcttttatcaaggtaactgtcttctccaagcctgccatgcagttttctattgtgctgtcaaccccaatctcaacggtggttttttagcctctgttttttttctttaagaggctttactgtttcttgagttgactggttcaattccaacactccagtctttgccccaacaatgtaattctgacttccctcatcaggcaaggtcaatttgagcctttatttcctccgttttagagtttggttgggtttctctttgtgatgcatacatacaggtccatctggttgg

SEQ ID NO: 19427 - DNA, 1056 bp, Homo sapiens
tcattaaatagtttctccattcatccatttgctcaggccaaaaatctaaaagccatctttgattctctttctcacaatctccacttagtccatctgccagagtgtcagtcctacctttcaaaatatgcctggaatccagccatttatgaccatctccaccaccatgtcccaccatatcccaccctactgtcatctttcctgtggggtgctatagagccctaattggtcttcctacagtttgtaagaacagctagaacaggctagagagatctcttcatcccttcccttcatagaatcctttccagaggtttcaggactccttactctgacctataaagtgctgttttatctggctcctgcttgcttctccatctcattactagtctcctctttgcttttcttgaaccacgctgactgcttgctcctctaacactgcaagcttattcccacctcaaggactttattattcactattcctcctgcttggaacaacgttgctcagacctctgctctgcatgcctgttcctttatgtctgtatgttctgtgttgaaatggcatatctttttttttttttggacacggggtatccctctgtcccccaggctggagtgcagtggctcgatcccagctcactgcagcctcttgggctcaaaagatgctccctggccaggctcaatcacgtctgtaatcccagcactttgggaggccaaggtgggcagataacgaggtcaggagtttgagaccagcctggccaaaatagtgaaactctgtctttactaaaaatacaaaaattagctaggtgtggtggcacgcctctgtagtcccagctactagggaagctgaggtaggagaatcagtttaacctgggaggtcgaggttgcattgagctgatactgtgccattgcactccagcctgcgtgacggagtgagactgtctcaaaaaaaaaaaaaaaaaggccaggcgcggtggctcacacctgtagtcccagcactttgggaggctgaggcgggcggatcacgaggtcaggagatcgagaccgtcctggctaacacgg

SEQ ID NO: 19428 - DNA, 1092 bp, Homo sapiens
cccatcccgatgatgaagacagtggcccttacaagcacatctctcctggggacaccaaggtagggcttggcttctggatatgtgaggacagaatttggacgtgggagccaggaccagagcaggggccttgagtgggtgctttgtccttaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtgagcatggaggcgtggtaccaagacgtctctgtgaattctctaacttcttactgtccttccatccctttctttcctccttggatttggtgccccctgcttctactctcttggctataattccattccatgtttcttagaggtccaaaggggtttgctgatgtttttccctgtctctaggtcatactattggcattggggactccattgctgattctaagacttaccaggacattcagaacactattaagaaggccaagcaggacgtaatagaggtaagaggggaggccaccagagacggaataaggggtttccagggacttcgaagttagcatcatcaagagcaaagggagtgtaaggttagagggaaggggcagagagtagggattgatgtctcaccgagaactctgcctccaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtgagaagccttgtttttccatatacggggccgctgtgaagtttgggaggaggaaggaaggtgtttgtatgtattagggtcaggagaatcacgggagttgggggaaattttgggaactgttattcttaaggcagagggaattcagtatacac

SEQ ID NO: 19429 - DNA, 1110 bp, Homo sapiens
gagcgttgagttccagaacctggctacgcttaagccttccaacaaggcttttgagaagaagtgaggaggcgggcaggcgggtggttctcgcccctggggctcagggcctgagtagtaggattcccatacctattccagagagatagcctggtatgtgtcttgcactagagcttacctttcagcatccttccccacctatctgaaacagctgtgtgacatgggggaggtggtggatggaggtggatttaagattggtccccacatcgtccctgctgatattataaagcagatgcagaggggtgggcctgtactcaggtcccagtggcagtccttgggcctgaatttttctctgtccaggattcttgcctccaaaccactgtacttggtcggctgtgcacctttgggaaccttacagtgcgttttgtggggaccaaggtcccagagcccacctgtccactagctaccccttgcacttccaggttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtgcgtgtgggtcgaagtgctgatgctagagatgtgcctccctggatggctgtccccagacacagccctccctccatttccccctctctcaggtcgtcctcccctgtaacctgctgcggatgatctggaatgctcagaaaatcttccacatcaacccacgccttccctccgacctgcaccccatcaaagtggtggagggtaagtacctgcttaggggtctccaagccaggctaggggataggagactgctgggccctggtctaatgatctcctcacctttaattggtccccaggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactg

SEQ ID NO: 19430 - DNA, 1081 bp, Homo sapiens
ggagtttgagaccagcctaaccaacatggtgaaaccccgtctctactaaagatacaaaaaaatattagctgggtgtggtggcacgcgtctgtaattccagctacttgggaggctgaggcaggagaatcgcttgaacctgggaggcagaagttgcagtgagccgagatcgtgccattgcactccagcctaggcgacggtgagactccgtctcgaaaaaatttggatctcagatggtatagtagctttctttggatgtgctgcataccaggtgccaaatggcgtcctataaatggaagctcttgtgtgaggaaggggatgatcaaataagagttttgtttttgttaagagtctgtctgccttttccgaactcatctacccatgtcctttaagattacagtcctggccctgtgataagccagatgcagatccacatcgtactcattcactgaaagagaggcgttggctttgtctgatgctagctttttcttaggcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggtagggatcaggactgctgggctttttggccggaagaaaagaaggagaactcaactgggtatggtggctcatgtctgtaatcccagcactttgggaggccaaggcaggtggatcacctgaggtcaggagttcaagactaacctggccaaggtggtgaaaccccatctctactaaaaatagaaaaattagccgggcatggtcgtgtgtgcctgtaatcccagctgctagttggggctgagacaggagaatcgcttgaacctggggggcagaggttgcagtgagccgagattgtgccactgcactccagcctgggcaacaagagcgagattccatctgaaagaaaaaaagaaaaaaaaggagaacttt

SEQ ID NO: 19431 - DNA, 1923 bp, Homo sapiens
cctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcaccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccagcctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaagtatgtacatcgagtgcttcattggggttcaggagacccccaggcccctgcctcctgcctgggctgctgcttgatctgttagggggaggggaccaggaaaatgggagggtaccttacagtcagcccacacacagcccctgctctgtgccaggcactgctctgtactgagtttgttatagtcacaacagatgcagctcttgtcctctattaaggtgatattgaccataacagctttttaacttgttttactgattgtcataaataatttggaaaagtgtagaaaagtataatgcagagggagaaaaatgatcacccataatcccaccactaggaggcatactttctttggtattttttcctatacttttcttgagtcactaacaagtgaacaaaaatgtactttgattttggcctcaaaccaagaatgaaaa

SEQ ID NO: 19432 - DNA, 1028 bp, Homo sapiens
cagccctgccttggcctctcccattcctgggcctcgctcccaccgaaccggggcccagaggcccgcataggggcttcttaaggcccgtgtgcgccgagccatccaagctcgtgggaccggactggtgccgggttgcattctggtccccgaggatgaagtaggagggggctgggccggcctggcttgtgcgctccgttctgtcccagcgtcttgattcggttctctttaagtttccttcaaagttcttccccgtttatcagcctctgccccctgaaccatatccctggcatctgcacttgagatgaccgcagccttcccatgccccccgttcatccagggtgttagagaactgtctcccattccagtccagtttccacgtgcaagttgcattctcctcaagtaccacggttatcatgtccctgaggaaagaaactgcccttgttgggccctcaaaggacagccctggtggtattaaaataaagacgtagaacctggcagtgctattgggtttggcctggtgatcttagaaataagatctctgaggcctgctgcttagccattttcccttgtctctggactggggagagatgatggcacagaccctgaagggccccttgtggaccgcgttaaccgggaagatcttaagttaggagttttgcgttttttcctcttttctttatttgcatctgaatccagaggaggcatggccaggaagagaggcaggatctgcggtggggtgatgcttagattttgataccctgatcttttgtttttcagggtactggaagatgaaagagactatacaagggaccgggtcctgggggcctgagcctcctggacccggcatacccccagcttactcaagtcccaggcgggagcgtcttcgttggcccccacctcccaaaccccgactcaagtcaggtggagggtttgggccagatcctgggtcagggaccacagtgccagccagacgcctccctgtcccccgaccctcttttgatgcctcagcaagtgaagaggaggaagaa

SEQ ID NO: 19433 - DNA, 1006 bp, Homo sapiens
gcttgaacccgtgaggcggaggttgcggtgagtcgagatccacgccattgcactcccgcctgggcaacaagagcggaattctgtctcaaaaaaaaaaaaaaagacaaaaaacaacttcggctgggtgcggtgactcattcctgtaatcccagcactttgggaggccaaggcgggtggatcacccgaggtcaggagttccagaccagcctggccaacatggtgaaaccctggctcaactaaaaatataaaaatacaaaaaagttagctgggcatagtggcgggtacctgtagtcccagctactcgggaggctgaggcgggagaatcgcttgaacccgggaggcggaggttgcagcgagtcgaaatcatgccactgcactccagcgtgggcgacagagcaaggccctgcctcaaataaaaaaaaaaaaaaagcctggtttgttgactcatacctataatctcaatgctctggaaggccgaggcaggcagacagacagattgaggccaggagtttgagaccaacctgggcaacatagtgagaccctgtctctaccaaaaaaaaaagaaaaaacccagaatttgtttttactgtcagtggactgaggaggggagacttagtgggagagtctgaggtcttttaattccattgagcttttttgtgtcattggcacaggtgcatttcttcaatagtttcttctatgataaactccgtaccaaagggttatgatggggtgaaaaggtggaccaaaaacgtgagttttgaattcacatccacttgtgtaatgccttgcctctaaagaatgagagtcttgttttctctgagccctttccctgaccgtgttcattcagtctttcaaagattaaacgtctcttgtgtgtgtaggcactaaggatacagtgttaaataaggaaaacttgcccttaaagttaaattgcagctagtgataagtgctgtgggcagatcaacacagagtaacgtgaggctgggcgcagtggctcacgcctgta

SEQ ID NO: 19434 - DNA, 1489 bp, Homo sapiens
ctccgatctgggaggtgaagggcgggacttccagcgcgctggtgctgcggtgggaggtgcacgcgcttgggctttaagcggctgggtcgggcccacgtggacccggcggcaagcaccacctctgggcaccgtgagcgcggcggcacgcctgccggcctgtcttcagaaagggtcacccccttatgtcgggggtggcctggcctgagccgctgcctgcatggggcaaatgcctcagttttatagaaactcctcctttgggtattttttgggagctggtgggagttggatctgggacagcagattgatggcatcatgcaggccactcctgacagagcccggctgtcaggatttctgagtgcttcggtcgggcaggggacaaaacttatgctttaaaccaacagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccac

SEQ ID NO: 19435 - DNA, 1638 bp, Homo sapiens
tcgtagcttgggtcctatggcaggagtgcaataggacatggatatgcatcacctgttctataaaactggttgctggctgggtgtggtggctcaactcgtataatcccaacactttgggaggccaaggcaggcagatctcttgagatcaggagttggagaccagcctggccaacatagtgaaaccccgcttctactaaaaatacaaaaattagccaggcatggtggcgtgtgccttttatcccagctactcgggaagctcaggcaggagaatttaacccaggaggtggaggttgcagtgagctgagattgtgccattgcactccagcctgggcaacgagcaaagctctgtctcaaaaaaagaaaaaaaaaatggttgctgcgtgatgaggcagttggtcaaattagttttcagaaggttaagggttctaaatatctagagtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggaggg

SEQ ID NO: 19436 - DNA, 1073 bp, Homo sapiens
atccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctc

SEQ ID NO: 19437 - DNA, 1074 bp, Homo sapiens
ttcctccccttcctttgacagcaccggggtttcagtgtccatgtctctctcagcgtggccagcagcagccgggagaacccgattcatatctgggacgcattcactggagagctccgggcttcctttcgcgcctacaaccacctggtagggaccgccatactcagccccagcactcgtactggcccggctctccttccttgagggcagctgaggctttgcaagacctgttttcagccctttccttcccccaggatgagctgacggcagcccattcgctctgcttctccccggatggctcccagctcttctgtggcttcaaccggactgtgcgtgttttttccacggcccggcctggccgagactgcgaggtccgagccacatttggtaagcatctgtgcctccaagggaggaggagagggaagggcactgccacctgcacaggggccttttgtgagccgggggccacctgtgggggttcacgccgtcctctgtacggccccgggagcaggtgcagcccagtcggcagaggagcaaacaggctcagagcaggtaggaaaccttcccaaggccaaccagctggtcaaaggactgcttccttcctgaactcataccctgtcagctgtggagcttttggtctctgaaatctttctagaaaattgttgataaagctgattccgttttcctgtaggccttcaacttgcatctctccaaggaagaactgggatttgagagggatgaagtggggcttgggcatttaggtcctttgggaggatagatgtggggagcatcagaggtctttgtcctgcttgtgacagacagcatgggggggatgttgagtccaagcatgttggtgctgggacgggagacagacctctgcttagcctggttagtgccaggagccattgccccctcccccactttgttccttccctctctagcaaaaaagcagggccagagcggcatcatctcctgcatagccttcagcccagcccagcccctctatgcctgtggctcctacggccgctccctgggtctgtatgcctgggatgatggctcccctctcgccttgctggg

SEQ ID NO: 19438 - DNA, 1025 bp, Homo sapiens
tctccttaatgaggggggcagggagcccaggaaaattctccatcctggaagacccccacctctaactgacttttttcttttaggttccccccagggcaacatgccagccccgtagcactgcccaccccacccactgtggtctgttgtaccccactgctggggtggtggttccaatgagacagggcacaccaaactccatctggtaagtcctgtctgagtgaccctctctcctcagcagtctaactctgcaccacatggttggagatgctcggtatgatctggatcatgcccactcttcagaatggtccagtccaattctaagcaccccaccatgtggtgcttgagtggttcagccctcctggtttatggacctcccttctatctcctataaatggttcagccctgtacttcaccagcctctccactactaccaaaaaatcttttccccactatctccctagtgctacaactcagttgcttattgaaatgaagagggagtttgcaagctgaaaagtggatatgagctaccctggaggaattttttcttggtagggaaacagctttgtccctataggagttgttgaacaccctggcttttggagggtgttcagaatttatttggggagatagtggagatcactgccagccacagcagtcttggcatttcacctttccttccagatctctttcagtcccattctctccccactgcactatagcatttgcccccatacctaagtcttactcttctgcttccctctctccttctgtcagttctctgcctgaggccctgctttatttcccattcctttgtaggagaaaagggaagataatccctaagccaggggcttaagttctctctgtgttgttcttcctcattacatatggggtttctcgagtgggactgttttcttctatgtgtctctcactattttgcttgatgttttgcacattggggtgcatggtggatttgtgttgaataatgttaactgaatgagcttcattatgaagaacctatgacttct

SEQ ID NO: 19439 - DNA, 1027 bp, Homo sapiens
cctctgtctaggataccaggccgtttatttggctctctgtgccttagtttcctcatctgtaaaaagtagataaaggccggttgcagtggctcacgcctgtaatcccagcactttgggaggctgagccgggtagatcatttgaggtcaggagttcgcgacaagcctggccaatgtggtgaaactccgtctctactaaaaatacaaaaatcagccgggcgcggtggtacgtctgtaatcccagctacacaggaggctgaggcaggagaatcgcttgaacccgggaggtggaggttgcagtgagccgagatcacgtcagtgcactccagcatgggtgacagagcaagactccatctccaaaaaaaaaaaggagataaaaaattagttactatcacaggattgttgtgaagattaaaagaggtaagatatggtatgtgctgagaacagtttctggcaatggtagggatgaataaatgttatttttatttctttctcttaggacagtgaggaggaatttggttctgagcgagatgagtaccgggagaagtcagagagtgggggcagtgaatatggaaccggaccgggtcggaaacgaagaaggaagcaccgagaaaaaaaggagaagaagacaaagcggcggaaaaagggggagggagatggggggcaaaaggtgagtagaattagggaatgagagtgagaaatctgcattaaagacgggcatgaggaggggaggaatggagactggactggagaatggggcaagaagcaagaaagcccagggaagctagtgggtaggtagacaggcctgtgtgcggcctggaataggggctggaggagcacctacttcaccaaagcccctctcccgcagcaagtggaacagaagtcatcagcaactctgcttctgacctggggcctggaggatgtggagcatgtgttctctgaggaggattaccacacgctcaccaactacaaagccttcagccagttcatgaggtgcggtaagactggggaatcctcgctaattgacact

SEQ ID NO: 19440 - DNA, 1216 bp, Homo sapiens
tcttcaacccttctccctctctctctccatctccccctgccctgcttccttatccctccaccggggtatatgacagtcctgggctgtcctgcagtggccggggaggaggaggttgatggctacgagacggatcaccaggattactgtgaggtgtgccagcagggtggggaaattattctgtgtgacacctgccctcgtgcctaccacctcgtctgccttgatcctgagcttgaccgggctccagagggcaaatggagctgccctcactgtgtgagtacctaatgccagcatctgatggccctgaggaacccacccatctctttcccccttggtttcacttaccctcttcctgcccccagatggctggacttcttagtaacagatgtccgagtgtctaggatcctaatgtattcctttctcccacaatcaacatttctgaaactggagtgtccttttccttagttcccaccagtcttctctgcacttctaggattcaggtgtcctgtctttgcctgtatcttccagtttcattccttaatttcttccatctgtctgtgtgtctatccttggccccctaggagaaggagggggtccagtgggaggccaaggaggaagaagaagaatacgaagaggagggagaggaagaaggggagaaggaggaggaggatgatcacatggagtactgccgcgtatgcaaggacggcggggagctcctgtgctgtgacgcgtgcatctcctcctaccacattcattgtctaaaccctcccctgcctgacattcccaatggtgaatggctgtgtccccgatgcacagtgagtggaaacatctcccctctgtatttactgtcaggcctgatcccttcccccatccctggggcccacatgtccagcttttcatttctctgcactcccccacccttgtgggacccctatcttctcatctaacaatgggttctttctgcctctttctttcctcctccttgtacgtgtccatcccaaagtgccccgtgctgaagggtcgagtgcagaagatcctacattggcggtggggggagccacctgtagcagtgccagcccctcaacaggcagatggaaatccagatgtcccacccccccgtcctcttcaaggcagatcagagcgagagttctttgtcaagtgggtaggactatcctactggcactgctcctgggccaaggagcttcaggtactaggacct

SEQ ID NO: 19441 - DNA, 1027 bp, Homo sapiens
gaactcccaacctcaggtgatccacctgcctctgcctcccaaagtgctgggacgcgcctgttattctcttattgccccggctggagtgcagtggtgtgatcttggctcgctgcaacctccgcctcatgcattcaagcgattctcctgcctcagcctcctgagtatctgggattacaggcgtgcgccaccacacctggctaatttctgtatttttagtagagacggggtttcgccatgttggccaggctggtcttgaactcctgacctcaggtgatccacccgcctgagcctcctaaagcactgggattacaggcatgagccaccgtgcctgggccaatccatcctttttcatagctccctttccctgtcccattcctcctgccggcctcttcccggttccttgttgtcctctgtgagtgtcaggactatctctttcccttttttctgtgccctgctagctggaaatcttccatttggttatgtatcgaaactaccagcggaagaatgacatggatgagcccccacccctggactatggctccggcgaggatgatgggaagagcgacaagcgtaaagtgaaagacccgcactatgctgagatggaggagaagtactatcgttttggcatcaagccagagtggatgaccgtccaccgcatcatcaaccacaggtgaatcctcggtccctgggaagtcagacctggtatatgacattattcttaccatggtgatggccccatgttagtatttgctgattaaccaggtaattgatctaaccttgataacctctgctgtagctccagcctttctggccttgtttcctccaggggaacgggagaaaacaggaggaaaatccggccaggcagtgcctcttttgtcctttgcctcctgtcatctccagtggcataagacatagcacatgagtctggggatgagggcatgaaagcaaaacatgagagacataattcatccagaccagtgttttgaatgtttcttcttcatagtacttattactgcctaaacttaat

SEQ ID NO: 19442 - DNA, 1082 bp, Homo sapiens
ggctgggctccaaggcaggctccatgtccaagcaggagcttgacgacattctcaaatttggcactgaagagctattcaaggatgaaaacgagggtgagaaccttttctgcagctctgtgaaagcaggcccctgctctctcaggagtacttatcagccccctggggagagaaaaacaactcttctctgcagcctttgaaggaaggagagccttcttttagtagcccttggaggaaggttggcctctttctttgcctgtagggttaaaacaaacaaaacaaaaacctttcaacattggctcccggggaaaaagccttctctagggctcctgtgaaaaggacgcagagtagaagctttcccatcagcctttctaaactttggaacccaaagttcccgtttgttttccctctcaccaggggagaacaaggaggaggacagcagtgtgattcattatgacaatgaggccatcgctcggctgttggaccggaaccaggatgcaactgaggacactgacgtgcagaacatgaatgagtatctcagctccttcaaggtggcacagtacgtcgtgcgggaagaagacaaggtgagaggctttgggggccagacattatctatcccaggccatctccaaaaggcagtatcctttactcagccttgaagtaggagggtctgtcccccttaaaacagtagtggacctcaaacaacttcttcgtctaataggtgagactggacttcagagagaaacgtaggcacagacagtactggtaaacacagaagggtaccttctgagacagtgcaggagaaacactgtcagagggattagaggagagatttagaaaacatgaggagagcacattgcaggtaagagatggcatggaacatgcgcaatgtccagaaaatgtatgcagagccacgaagctgcaggagtggggagaccggattgggctgacgcagcagagtagggatttccttgcagtggaaggattagcaaagaaggagacccccagtgttcattcattctgttgcccttcagattgaggaaattgagcgagagatcatcaagcaggaggagaatgtggaccct

SEQ ID NO: 19443 - DNA, 1051 bp, Homo sapiens
ccctctggccttaccccatgaaacttccctttgaccttcgacctttcctcctaccccctctcaccttgccattgatagagattatatcccaaagccctctaaccatctaatcctgcctggtgtagtcactgactcctggcccctttgatccctgttctaattccttgaatctgtaatactgaccttctaacctccctctccccttacatattaaaaccgtgattccttaaagctttgacacttaccacctcccatgcctcctgactatttcctccccatcatccccaaccccaaaccttgctcttccagtatgagatgttctgacaactccccgcccccatgtcttccaatgtccccccatcttcctttcctccatgctccctttttctttcttctttctctccatctgtcttctgtggtaatctggtctctctgtctcttttcctgacactttttcttttcccctgagttgcttctgttttccatctacttcttttactttcttgatctctggttctttgacatctgtgttctcctctctcgctctttttctgcctgtatctgtccatctgatgcctctcttttcctggctccatctctgtatttccctgtctttctcttgcccttctttctctgtggcccgggccccagttctgaaccagctggaggagttgctgagcgacatgaaggcggacgtgacccgcctgccagccacgctgtcccgaataccccccatcgcagcccgccttcagatgtccgagcgcagcatcctcagccggctggccagcaagggcacggagcctcaccccacaccggtaaccctctttccccctagctccagttttccctgtttgtgttcctcctgcacacatacaaacacttccatcagaatcctatacaatatggaaaaacaacttgctagaacacagtcatcacccttgagtgagtctccctgcctgtgtatcctacccttagcagttgtggagtgtggctcataatgtctctcctacagcttctttcctctcacagactatgaactaactccaacttc

SEQ ID NO: 19444 - DNA, 1060 bp, Homo sapiens
gaggccagcatttgagaaccacaatcctttggcccggtatggtggctcatgcctgtaatcccagcactgtgggaggccaaggcgggtggatcacttgagcccaggagtttgagaccagcccggccaacatggtgaaaccctgtctctactaaaaatacaaaaattatccaggtgtatggtgcacacctgtagtcccggctactaagaaggccgaggcaggagaatcgcttgaacccgggaggtggaggttgcagtgagcccagattgaaccagtgtactccagcctgggcaacagagtgagactccatctcaaaaaaaaaaaaaaaaaaagaattgacctagggcttcaggtgttacaatgagatcacatgcgataaagactaagaaagcatccgggtgtggtggctcgcacctggaatcccagcactttgggaggccgaaacgggcagattgcttgagcccaggagttcaagaccaacctgggcgcaatatggcagtacctaaactctgctaaaaatacaaaaacttagccgggtatagtggcatgcacctgtagtcccagctactcgggaggctgaggtgggaggatcaactgaaccctggaagtagaggctgcagtgacccgtgatcacaccactgcactccagcctgggtgacaggagcgagaccgagtctcaaaaaaaaaaaagacagaaagggccaggtgtggtggctcacgcctgtaatcccagcactttgggaggctgaagtgggaggattgcttgagtccaagagtttgagaccagtctgggcaacataatgagaccccatctctacaaaaaataaaaatattagctgggtgttgtggcaccagcttgtagtcccagctactctggaggctgaggtgggaggatctcttgagtctgggaggtcaagactgcagtgagccatgatcacaccactgcactttaggctaagcaacagaacaagactctgtctcagaagtaggggctgagaaataaccactatttggatttagaaattgagttcttggggccatgcgcggtggctcacacctgta

SEQ ID NO: 19445 - DNA, 1033 bp, Homo sapiens
ggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacaggtaactgggggcagaagtcactggggttccccttctgtgcatgaattggctccctctttcgtaccctgctttctgtctgatacttgagcatttagtttcccagatgcctttagtgatcgcaagttgcaaggagcagaaatctgctcacattggtccaaataaagggattgagatctcatggaaatatgacatcgctggacttaatgagaactggagttgggaacggggtactatcaggaactgaggcagctagctggcccttttctgtgggcctgcatagcctcctgggtccacctctcctgcacatctgctcttttttcttgctagaccagcattcaaggttctcacccttcataacttcagtttacacatgggtttgaccagctgtgatactgactctagctgagcctctagacatttatagagacatcggtgtctcagtttttttaggtccagtttaaagaggccatctgattggattggctgaccttgggtgtggtgtccacccctagtttaatgtcacctgtgatttgagtggatgggggcattctgtgtggtacaaacatgacaacctaggtcgaattaaaaatgagggatggggccgggtgcagtggctcacgcctgtaatgctagcgcgttgggaggctgaggtgggaggatggcttggtgccaggagttccagaccagtctgacccatatagtgagacctcatctctacacaaaataaaaagttagcaggatgtggtggcacacacccaaatttccagctacccagggaggctgagacagaaggattgcttgagccaaggagtttggggctacag

SEQ ID NO: 19446 - DNA, 1034 bp, Homo sapiens
gtttttaaagctaggtgatacagaaacttgatttccacaaaatacagcaaacgacggtggagggtaataaacatactttaaaacagtacaaacgcgagccgtattatcgaatttacattttctggtagccacattacaaagaataaaaagcaagcgaaattaatttcacggatctattttacttaccctaatataccaaaatcttattttaacatataatcaacattctaaaaatattaatgaaattttaagtctttttgtttgtacaaagccttccttcaaaagaagatgtgtatttagaagctggcaatacatctgaattcatatatttcaagtgctcgataacggtgtctaccatatccaacagcagactttgttttgttttcgttttaagtgacgggtgtggaagacacgcaaaatagaatgtccagtaatgtacacaatcttgaaagacaccacgagggaggttccatggtgtaatggttagcactctggactctgaatccagcgatccgagttcaaatctcggtggaaccttgaagcttttcttttaatatcagcatgttgaatattgttaattgattttcacagaggggatactcctatgacccaagataatacgacaaaaaaaaaaagtaaactaggacactaccaattatttgtgcttttcctaccggataattgagtcctataacacagtgttaagagaacgtacaataaattatttaaatatgttggaagttgagctaacatttgaaaacatgttaaaatagagatgttatgaagaaacgaaataatagagatgttatgaagaaacgaaatattgcttcagcagttaccatcaggtcttagcttctgggatggatgcaggcctatgatctctctggaagaccaaacacggaagatgatggtgaaaccattaccaggggaattcgtaaaattactttctgcatgtaaataggtgtaacctcacagaactgttaacagaactgtagcaggtgcgtaatccaccagaaaaactccagcctggcagc

SEQ ID NO: 19447 - DNA, 1055 bp, Homo sapiens
caggcacctgccaccaccacgcccggctaatttttttttttttttttttttttgtatttttagtagagacggggtttcaccatgtggccaggctggtctcaaactcctgacctcaggtgatccacccgcctcagcctcccaaagtgctgggattacaggcgtgaaacacagcccctggccctctctgatttttttgagacgaggtctcgctctatcgcccaggctggagtgcagcggcgccatctcggttcactgcagcctcgacctcccgggctcaagcgatcctcccacctcagcccaccaagtagctgggatcgcaggcttgcaccgccacacccggctaatttttgtatttttctgtagcgacatggtttcgccatgttgcccagactggtctcgaactcctgggctcaagcgatctgcccgcctcgggctcccaaagtgctcggattacaggcgggagccaccgcgcccagcctccgtctccctcctaagtgacatcctgtccggcatcccgcaggccttcagatggatggggtagcagagctcaggaactcaaacacagcccgcctggtggatgacttctaagcatctttcagtctccctgatcttgccaagcagagaagggcttcctcgtaatgccaccaaagcacaactttcacatgcttgctttatggccttaactaactgatgtcattacttaactgtccccgcggggacggggaactgaatgtattttcacaaacgtcagttcaagacagatttgtgggagaaaccacctggggataaacctctccccaccaagaacctagaattcggccgggtggctggggaaaagtgggcggggcgtagtcgccccggcgctggcaggtccagtctctgcccgcggcgcacgcggatgacgtaacaaacgcgcgcgacgattcgaggtgctctgtggccgcgagtgcatcttccacgtgagtatagttaccgcgtgcggacctggatcctcctccaggtgcagcgtttcgtcatctagcccaagcttggtctggcggcttcagtatccccac

SEQ ID NO: 19448 - DNA, 1030 bp, Homo sapiens
agcggaacccgagcactgtggaggcctttgacttggcgcagtccaataggtgaggagaaatggggttgttcccatacctgagcccatgggtgttgggagagaccacaggggctcaccttcatgttcctcccttggcttaggggcctccctgagtctctgagggcctgggctcccgtcatccatcaaggagtctacattcaaatcttggttttatcttcactttggctctggatagtccaaaatgacagaatacttgaagattatgactttttggaatatattttgatctgtcatctaagtatgaatttggctgtaactctgctgttaaatgctggtgagaagacatggcattaagaaatgaccccgtttccacctgccttcccctccctgcatcgccccctgcagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggtgagctgggttccctggagaaataggtgagatcacagaatagggtagggcaaaggtcccaggcccctggagtgggcctggggaaaataatcagggaaattggttgtccttattttcagtgggggtggtcagagatgggggtttgtctctgaggcacccagacctctccccactctctctttgcaggagtatgcccctttagtggtgcaaccactggcacagggggccggattcgagatgtcc

SEQ ID NO: 19449 - DNA, 1043 bp, Homo sapiens
ctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcccctccccgcct

SEQ ID NO: 19450 - DNA, 1037 bp, Homo sapiens
agacgaagtctcgtactttcacccaggctggagtgcaatggcacaatctcagctcactgcaaattccgcctcctgggttcaaacaattctcctgcctcagcctctcgagtagctgggattacaggcgcccgccaccacacccagctgatttttgtatttttagtagagacgggatttcaccatattggccaggctgatctcgaactcctgacctcgtgatccggccgccttggcctcccaaaatgctgggattacagacgtgagccaccgcgcctggccccatccagctaattaagaaaacattttttttgtggagacagtctcagtatgttggccaggctggttttgaacccttggccttaaatggtccttctggttctgtctcccaaaatgttgggattatgggtgtgagccactgtgcctggcttcttaatcattttaaagtgtacagtccagtagtgttaagtatagtcaaattgttgtgtaaacaaatttttagaactttttcatcttgcaaaactgaaactatacctattgaatagtgactacccattttcccttcccttcagcccctggcaaccacagttctattttctatgagttcagctactttagatacctcatataagggagattatacagtatttgtgactggtttattgcatttagcataatgtcctcaaggtttatccatgtgtagtatgtgacaaaatttccttcttttttaaggctgaatgatactccattgtatgtattcattttctttatctgttcatctgtggatggacatcgagttgctcccatctcttgctattgcgaatgataccgctgtgaacatgggtgtccaaatatctctttgagatcctgttttgaattcttttggatacatacccaaaagggggatgactttgttccttttttaacacaagcaaatattctgtaagttaaattgcataattggaaaagataacattaattttgggttaaaaactcgacattggctgggtgtggcggctcacgcctgtaattctagcact

SEQ ID NO: 19451 - DNA, 1031 bp, Homo sapiens
tggagaagtatggcttgtagtttcagcatgagaaaagtgccccatttgaaaaagccctccactgcagaacctgcctgccctccctctcactcctgaggagtctgtagcaccgtggtgatggctcactagtgctgccagaaacctgcggcaggattgtttgggggagagacatcatcaaagtaggtttgtgtgtgtgtgcatgtgtgcgggtgtacatgtgttcaccttcccacccgctgaaacttcagatgcagtgaagccttctcacataaaacaatataccttaactgggcgtattgctctgtgggattcaaaagtattttgtaaattctggtcacttgagggcttcttggaatcaggtttttgtctagtctgtgagcacttctgccagttcctgaaacatgggctgccgtgcctgcttcccaggtgccgagctgtttccttcaaccatggtcaccctttgtctcaccatctgaaaggacacacatttcatgtggagtgtggtcgcttggagtctctcaaaaacactcttttttttcccataactttatgtagtttcttaggtaacatgtgctctatttttgtaagccactctgagttcttttgggctgtgtgtaggtgggcatggactaattttagggcgtgatgtggaaatagtattcgtattactgtttaatatgttctcctttcttttattaggcaagaaaaagtcatatttcccacgttgttcatgggtaactgaatttgtttgctgtgctctttttcattctttcttaatcctggtgtgtggtggaagacacattaacaatctggttttactaactgcatggggctgactcagctttaaccaacttacagcccatcagtgaactttcacggtcctgttcgacttgactgtatgccgttattagttcagctgtgagaaacaagaacaaattagttgcagtggtcctggggtggctgggagtagcatgccaggtggcacgcctgagatgggctagggcgctgtagtgttgatttcagagtctggc

SEQ ID NO: 19452 - DNA, 1167 bp, Homo sapiens
cctcccaaagttctgggattacaggtgtgggccaccgtggctggccttagtgacgttttttttgtggctctagcagctcttggcaaatgatcccccgtgaagaaagcagccaactccctggctcatctcccgctttctgtttggactgtggggtgtaagatgctactttggacatggtcagagagagcatctgccacctggcatgaatgccgctacgtaccgtttgcctgtctagctgaagagtgcctctgggtagagtgcctctgtgtgggttttcttcctggagctgccgggtacctggttttgcatggctctccatgaaacctcgggaatgagccttccttgagccgcatctgtgtgccgttcctccctgctggtggggctgatctcccgggtggtggacagcttcttgcctccaggtgttttcatttcagccgctcagtcctatcccttgctcccaaatattgtcttacaagagagtagtagccagcgctccacttccttcagcccagagtggccagaaatgatccctgaccaacgcagctgagacccaggagccaaagctgggaccttgagtcacagtgaggcctgcaagaactatacagaggtgacctgaggacaggacacagtgctctgacctcaggtggcagaaaggacaatgggcccgggtttgagttgactgagcttgcacggctaattcatggtgaagccaggcttgggcacgagcccagtctttttctgctgtgcctttccagacttgaggcctcactggccttgactcccacgctctgtcctgtgccttgggagaggagcaggttttgaaggcttggaaatgacgagcggcggggccggcacagcctttgtagcaggaggaatcggttcacgtagccttcctcctgtgcccgctgcgcatgctgactccgcctttcttggcagctgccccggagatgccactagtgcgcatctcctgagagccaaggtggaagctggcacttctgggagaggggaggcatcctgggtggagccacggctttagggagcacccggtagccagctctgccccctccccgactgtaacagtgttgtgccttgtctcgtgtgttggtgatacagcattcctgaaaagcagattccagtgaggctccacaatttccttctaagctgctg

SEQ ID NO: 19453 - DNA, 1660 bp, Homo sapiens
aacttctttggaaggatgatttgccatggaaaggagtcaagggtgcatttatcttataaatgaggaaactgaggcccacctggatgaagatactggcccaaagtcccaaggttagtcagcagcaaaaagtcagggttcctactccctgtccagggctcttcccaccagctgccccttccaaaagatgccacatttggcaagagcacaccttgaaggtgtcttaggagcagggctgcacgggagctcctctgtctgctccagcacgtgcacctgccttacatgagtgtaggctgaaggtcctctgacaggcctgggttctagcacatcctggcacacagggcagggtgggagtcaggaaggaaagagaggcagctgacggaatgttccaggcctgatcccagggccactgactccagacagctctaccatctggcctctggtgttttgtcttcttgggcctatgaaacactcactgtccactggcttgggggtggggctctaggcagactgagggacccacgggagaaaggaagggaccccggggcctctaagccagatgaacggaggtgtttgagggaaggaaaagtgtcagaaatagggggaagggcagggccagctttccagctcagtctcttctccctaatgcagtgtgagtcaggccttgcctgagagtctgaaagaaacactttcagaaaaaacagtgtggtacagagaatgcctcttggacacttgggtaatggcccaggagcgctctctaggaggcaggctccaacagccacatcgcctttggggaaatgagcatttggggatctcaccaatcaactccatgatggatacatagagcttacacatctacttcattgatgaacatgcatcatttttaagtacccacggaacacttataaaaactaacgtgttctaggtcccagagctctttctcagcattctctgaccacaatgtgataaaactagaaatcaacttaaaaaacaagcaaatgccatacatttggaaatttaaaccgcaagcttaaattattcacaggatgaagaagaaaccataatagaaattagaaaaatttagaattacatgacaatgaaattactccacatcaaaatttgtggaacatgatgaaaaccgatcttagaggggaatttacagtcttttataaacatatcagacaagaagcttgagagctgatgagctaagtgtccaactcaagaagtcagaaaaaaaaggagcaaaaaatggtgagatagaggacagcaggacgaaaacctcttgaagctggctctcaggttctctctcagggtcggctccgtgtttactgatctggttttgagttccttgttcattcctgacacctagagagccgtcctcctttcttgcaagctcaactctgcctttgctaatattttatccaatatttataggtgtttgtattgggagttttttcatattaactgataataacatttaacttaccttttcaggtttgaagaaatgttgattatccatcatttatacggtaatgtgtatatttaagtgtgccttgcactgttacagttcctatatgcaacactttatcagtctctgcttcatgagaacttacaagaaagataaatgaaggaataacaggaattcaatgaaacaaacttctct

SEQ ID NO: 19454 - DNA, 1029 bp, Homo sapiens
atttttcttgtcttactgcattggatagaatgtcaaagtaatggtatatataataatggtaatgtactcttgtattactactgatttaagtgagcacatttctagagtttcattgttaaatatgttgtttgttgctagtttcatatggatgttctttattgtactcaatggagagacctctattcctgacttactgggagggttgctctttcttacttttttttttgtttgtttttttgttggagagataaggtcttgattggttgcccaggctggagtgcagtagcatgatcaatcatagctcattgcagcctcaacctcctgggctaaagcaatcctcctacctcacactcttgagtagctgagactatgggtgtgcaccatgcccagctaattttttaaagaaatttttgtagagatgaggtcttgctgtgttgcccaagctgatcttaaactcctgggttcaagtgatcctcctgcctgagactcccaaactgtgctctttttttaaaaaatattcaagaatatgtagaatgttaatcctttagatattaatcaaaatgatcatatcatttttctgctttgactattaatgtaatgcatttctttaattgatttctgaggtataattcacatgtcatacaattcacccatggaaagtggtttttagtatgttcgtcgattggtacaaccataactgaaactaatcctataacatttttgtcatccccaaaaggagctttctacgaattagcagtcactttccatccttcaccctgatctgcacccacaccctaagtaggcttttgatctttacagatttgcctattctggacatttcatataaatagaatcacgtaacatatggccttttgtgactgacgtctttcaattagcataatgttttcatggttcatccatgttatagcagtacttcatttccttttaatggctgaattccattatgtaaacatatcaaattttgattcattcatcagttgatggacatttgagttgtgtccatttttt

SEQ ID NO: 19455 - DNA, 1035 bp, Homo sapiens
tagaaaaaaattaatagaataagccagaaaaggagatgggggcagggaaggagagataaaaataagagcagaagtcaatgagccagaaaacaaatattcagcagagaagatcaacccaagccaaaagttgattgtttggaaggactaataaaataaacaaatatctggaaagattggtcaagaaaaagaggaggcacaaatgaataacattaggaatgaaaaagagacataactagagatccatcagagacttaaaaaaagtaaggtaatgtgataaacaactgtatgctactaaattttctaagtgtcatttccgtatcatcattagcaaacccctggagaatttcaacagagtggtccatagaccacttgaatcaaattcttaggtggaatcaaagaaaaaacataaattggactttatcaaaatttaaaacttgtgcttcaaagatacaatcaagaaaatgaaaagacaacccatgggatgggggaaaatatttgtaaatcacgtgtgatgaaggtgtagaatgtgtaaggaatatgtaataaatcttagaactcaacaacaaaagacaacccagtttagaaacgggcaaagaacttcagtggatgtttttccacagaagatacacaaatggccagtaagcacattaaaagatgcactaaatcattagccatcagggaactataaatcaaaaccacaatgagataccactttacattcactaggatggctatacttgaaaagaaaggtaataacaagtgttggtaaggccatggagaaattgaaaccctcatgtactgctggtgggaatgtaaaatgatatggctacttttgaaaataatcccttccgaaaccccccaaataagagtccaggcatggtggctcatgcctacgatcccggtacttcgggaggccaaggtggaaggattgcttgagcccaggagttcaagaccagcctgggcaacatggcgaaaccctgtctctaccaaaaagatgaaaattagctgggcacggtggtatgtgcttgtagtttc

SEQ ID NO: 19456 - DNA, 1026 bp, Homo sapiens
tgatggttttgatggggagccgccatcttgtgggcacggtgaggagttagatttaattttgaggtctatgggaagccatgagagaattttagataggatggtggtctgtctttctgttagttggtggctaatgggtacaaagcagaagcagggaaggaccctgggctggagagtcctgagttagagaccaccaagtaggtctggctcaacagctctggtcagaccaacagtagctggtcagcctcaggtagagtgtgtggggtgctgagtgatggcctggggtagtttggggccgaggaagggcactcgtgttctatgagcaccgtccagaatgaggccacagcccagctcactggaaacgtgccctggagtgtgatggcctgggtagtgatgtgagcacttaacccaggctctgctcagagtccagaagcaggggctccaccccgtgagatgtggcaatggctttttgaaggaagaactgatggggcgtgggactggtccagcatgaaggatgaaaagacgctggagagatgagatagtaaagacaacgcctttcgtgcctgcgtgcttgctgtgtgccccccgtctcgtcccttcaacagaggcccccctgtgatgttatcagggcaagcgcttttcatccttaggattctttctccatgcaaaatcttatttggaaactcagtgtggaaaacaggcaaaactcgggctgctttggctgaagaaggtgttgttgaggtgggggctggagtgtacccccttctccccctcaccccgcagagccctgtcctcttctttttgccccccacccccacttcaccctcagcatgaccaaaggacccctgtggtccccagggacacagtttctcaagagaggcctgggaccaacatgtacagcattatttttgctcccactgaatttgctgtacaaacaactggcaattggggtatgttggctgaaataatttcatcacttaatcctcaattttacgtgtgactggttgattgcacacagatcctgtgacc

SEQ ID NO: 19457 - DNA, 1041 bp, Homo sapiens
ccaggaggtggaggttgcagtgagccgagactgcaccattgcactccagcctgggcgacagagtgactccatctcaaaaaaaaaaaaaaaaaggcacattgagccggagtcggcactttgggaggccgaggtgggcggatcacatgaggctgggccaacatggcaagaccccgtctctgtaaaaaatacaaaaattagccaggcatggtggtgcacacctgtagtctcagctacctgggaggctgaggcatgagaattgcttgaacccaggaggcggaggttgcagtgagccaagattgtgccactgtactccagcctgggcgacagagcaagaccctgtctcaaaaaaaaaaaaaaatggcatgttgttagggatgtggacatgataatgtctcctaaggctattaaatacagcttcaagtgtggaagttgagtatgaagcaggggtatgtgttctgggtgagccatagaagataataaatgttttggatctctgtttctttgagcctcctgttacaataagataacagttttcactgtattaaatacatttgtcagtggaataaggtccatttgacttaaatgcacccgggatacattaatttacacagccattcacacagccaccagagctgccttcctttatgactccattctccactcctgtctcttacagaattaagtccaaactcctttacgtggaatttgaggcccttcttggtctgtcccaacccactcatcttcctcacttcttcagtcgcctcccatgccccatcgtgtttatgctgtgcaagcatcttcaggcctggatcgggagttagttcttccaggcatctctgcccatctagcccctcaacaggtgactcagggtgagggctctgggcttgggggatgggagctaggtccatccctcggcagccaggaggccctgggctcaggtgctagaagcctctggtgcaaactcacacattagcctctgcctccatagagttcagattgtattgaagatatcataaaccgggcatgctggtgtgcgcctgt

SEQ ID NO: 19458 - DNA, 2046 bp, Homo sapiens
gttcatgcagaaaaatgctttttacttttatataagtattttatgtttaacttctgcctttggtgtcatttcaataagaggttataagatattcatctactttttagtgtattctagcactttcatagcttaattttttatacttaaatcttgaatccattcctaaaatgatctgatgtaaggtaaagaatccagcctttcactttgtccatgtggacctttccctaacgcattcgaaatgctcctttgccatgtgttaattctctttggtctgtttctggagttctttctgtccaatgatacacatctgtgttcttttgccagtgccacactgttttaatattttaatcattttagggcatgaatcccatgattacaaaatcccttggctggtcttttgcattttgtttccagatgaactttagactgatttgatcaacttaaaaaataattcctctgtgcttctgattgaaatggctttaactttatagataaatgtggagggaatgagaatctttataatttttttctttttctttttctttttttttgagatggagtctcactctgtcacccaggctggagtgcaatggcgtgatctcagtgcactgcaacctctgcctcccgggttcaagcgattctcctgcctcagcctcccgagtagctgggattacaggtgtgtgtcaccacacctgatttttgtattttttagtagagatggggttttaccatgttggccacgctggtcttgaacgcctgacctcaggtgatctgcccacctcggcctcccaaaatgctgggattacaggcgtgagcaactgcttccagccaaatctttataatattgaatcttctcgtatgaaactttgatatgtccatcaggtatccacatggtttcctcatctatgtccctgaatgtttcttaagtttatatgtgggcattttgaattgtttgtagcatggtgaatggtgtcattttccagtatattttccaattgtttgctattggtatatatgaaagaaactggcttttatgtatttattcagtgactggcctggtcactgaataggggctgtcttcctgggttttatgggtagacttttttttttttttttttttttgagatggagtcttgctctgtcgcccaggctggagtgcagtggcacaatctcggctcactgcaaactctgcctcccgggttcacgccattctcctgcctcagcctcccgagtagctgggagtacaggtgcccgccaccacacccaactaatttttttgtatttttagtagagacggggtttcaccgtgttagccaggatggtctccatctcctgaccttgtgatccacccgcctccacttcccaaagtgctgggattacaggcgtgagccaccgcacccagcccatcatagcatctttaataataataattctgcctttttcttttctgccattcattctcttttcttgtcttcttgcattggctacaccattcagaacaattctaactagtagggatgataatagcaggcgtctttgtcttaattctgacttaaatgggaatgtctttagtgtttcacatttctctgcttaaggagtgttaaatgcaactaaatcttattttgatgtttcagagtcattggtaatacataattgaaaaacattctgtcatacagtcataccatcagcaatcagtggagcttacttatctgttttacttgaaggttccaagttttatttttctcactcatgctctctcttttgcattgctgactcactgagactttccttgtttctcttctcttgctcccaagctgtctattgtcggtaatttctgttgtttttctcctttttcattttataaaccattgttttaattgaggccataatttgaggacgtggaaaacatttcaaatagtacaaaaataagtcaaaagtcagaaattcaaacgctgctgtaagatgtgtttccctcctatgccgacgcttgttcaccctggaaaatgtaacattttgtgtccttccagacctattaaatgcagtgtg

SEQ ID NO: 19459 - DNA, 1036 bp, Homo sapiens
tgttcactgcaatgttgtttataacagcaaaaaaagatgtccaacgatgggagatgagctaaataaactctaatgtagacataaaattaaatatatatgattcaggccaggcgcggtggctcacgcctgtaatcccagcattttgggaggccgaggtgggcggatcacttgaggtcaggagtttgagaccagcctggccaacatagtgaaacccatctctactgaaaatacaaaaattagccgggcatggtggtgtgtgcctgtaatcccagctactcgggaggctgaggcaggagaattgcttgaacctgggaggcggaggttgcagtgagctgagatcacgccactgcactctagcctgggtgccaaaaaaaaagaaaaaaaaaaaaaatatatatatatatatatatgattcagctattcagatattgtgtattatttattgacttaaaaggagtaagggaaaaaaaaggaagattcaagtgtaagtatgacgggtctgatacttttaaaaaatgtgcatatgcttacttagaaaaagctttgcatgattctattaacatatttagggtgtataaggtatataaaagttacttttaattacaaaatgcatctatttctgtagtgtttgaattttttgcaaaaaaatatattgatgttttacttgagttaaaaaaaaaaaagataaacatggaggccgggcactgtggctcacacctgtaatcccacactttgggaggccgaggcaggcagatctcctgaggtcaggagttcgagaccagcctggccaacatagtgaaaccctgtctctactaaaaatacaaacattagctgggtgtggtggcgggtgcctgtaatcccagctacttgggaggctaaggcacggagaatcgcttgaacccgggaagaggaggttgcagcgagccgagattgtgccgctgcactccagcctaggcaacagagcgagactgtgtctcaaaaaaataataaccataaataaataaataaaagtgggatgaaagatgttaccagtata

SEQ ID NO: 19460 - DNA, 1029 bp, Homo sapiens
tctggccagttgtgataattaagtgtcccttgggggacagaggagcctctggctaagaaccactggatcagacccagattttctgacatcagcccaggttgctagaactctggtccaggaaagaaagccagagcccaagccaaggggccgtgggactcttctagtggggggacctgctcattgcccctccgccttgagatcagacatcccgtgtgtattaggtcaaaccgtgcggaattgctgctgtatgtgaccatttcagacccacaaaaatggcaatttcctagagttcagcttaacatttacttccccttggccaggagaacctgcttctgagcagcctgcacaagtcagtttcccctctcttctttctcactctctgctgtctgtctccctctctctctcctacaccccctacccccaccttcctcattccctcattttccctggcctcttccccaccccctcgtccttttcccctctttctccttttcgggacctgcacaaagggctggggcagaggtcaggctgggggtgaacagggccaggcgagctctaccacccctccacccctccaccctgggcctccatcaccccaaggagcacagagaagccatttgcatggtgggtttcaggagccccattgttcccctgtctctgggcctttgcaggtggagctgccaccagcctcgaggaggataaagggatgagctgggaggccagaggagcaagtgggggcggaatatttagcccttcttgggagctcttcccactgggggatcaaggagcatggctgatgggaacgggacaagtgacaggtgtcagggagagagaggatgggagtccttggacccacctccatgtcacacagctgtcacagcgaccttgctggcagaggctggcaggggtggggcagtgcaggctgtggagctaggctgaggcaggggtggatgcagagaacccccaggtggcccaggctcagagctcggcctgaaaccccttgcagattcctgtacaggtcctgggctg

SEQ ID NO: 19461 - DNA, 1084 bp, Homo sapiens
tactcaggaggctgaggcgggagaatcgcttgaacccgggaagcagaggttgcagtgatctgagatcgcaccattgaactccagcctggatgacagagtgagactccatctcaaaaaaaaagatataaaagatgaacttggcaacttgttgaagcctgagacatgtcctgctgagatgggcagagcagggatgaagtccaggctatccactggcctcttgatgcccttcagcctctaggttccacaccctacagtgggctctttgtgagggcagctgcgtctctggctgtgtttctgctagcaccttccacacagggtcatttgagtctgtgggtacctggagtgtattgagaattcattactttcctaaagcaaacccgatacctttattctccatgtgagaaggtagcagaatttggtcttgccggtggggggacttcagtatctaccatggtgtgacattgttgtgggttgagtggttccccataaatagggttcccagaaacctgagacacattattcattgaaatgccacaaaactgtaaaaaaaaatttggagtggaaatctcttccaaatgtatcaccaacttttttgccttattaagcaatgcacaacaaacataattttacttttcaggatgattcagccacggcacaaggaatcgtgctgtctgaacagtcatagttacaaatcttattcaactgttgggactgtttgcctctgttcaaaatgatattgcgatattctgcgtctgtgtttcatggtttcataattttctttttttcttatttttttattttttatttttttgagatggagtctctctctgtcggccaggctagagtgcagtggcgcgatctccgctcactgcaagctccgccttccgggttcacaccattctcctgcctcagcctcccgagtagctgggactacaggcgctggccaccaagcctggctaattttttttatttttactagagatggggtttcaccatgttagccaggatgatctcgatctcctgacctcgtgatccgcctgccttggcctcccaaagtgctgggattacaggtgtgagccaccat

SEQ ID NO: 19462 - DNA, 1046 bp, Homo sapiens
ggggtcacaacccagggagggagggtcacagcccagggaggctgggagctgctccaaggccctggaactctgcctcagtcgcggcatgctggagaggggtacggacttactttcttggagttgtcccaggttggaatgagactgaactcaagaagagaccctaagggactggggaatggttcctgccttcaggaaagtgaaagacgcttaggctgtcaacacttaaaggaagtccccttgaagcccagagtggacagactagacccattgatggggccactggccatggtccgtggacaagacattcctgtgggccatggcacaccgggggggatcaaaatgtgtacttgtggggtctcgccccttgccaaaagccaaaccagtcccactcctgtcattggacgtttcttcccattccctcctcccaaatgcacttcccctcctccctctgccccctcctgtgttttggatttctgttcactcagaattgtaaatgtttagttgtgaccatgacgtattgtttgggtcaatgtccctttccaatgcatactaatatattatggttattatatatgaatatatttaatgacatggaaaaagttgtggattttctttctttccttttttttgggggggggtggggggttggttagagttgtaatggacccagatggaacttgtaatgtgggccccacatgatagaactaaattcagatatcattaaataaactcttgtacactatgccgtctcgcagtcttgattggtggcctgggctgtgggaggtgggcgtgtggggaggcaggggaaggatggagttttcggggagtttgaggaatatggcttcaggccgaagaactcccctgcaagtcagagcctgggttttacccagagcctcagagacagagccctaactaactcccccgagaaggcaggagaagagcagttttgcttggaatgtcctagggccttgctggccgtgctgttttgagctaaaaggttctcgaatgggacagtctgtattgcaggctgcaggaaaccactccag

SEQ ID NO: 19463 - DNA, 1088 bp, Homo sapiens
atgtcacatgtaggctcagagctgaggatgagatagaactagctatgtgaataatgggatgaattgcattatgagcagagctcgtagcatgtgcaaaggccctgaggcagaaagcattcggtgtgtttaagacatgatgacagcctggatgaagtgtagccattcaggggtaattgatgaagggtggggctggagaagtgggcaggacactctaggccacggatgggagtttgcattttttccaaaggggtgataaatcatttaaaggttctaagcagaggagtgaagacataatctagtgtacaaatcaaactagttgctctgctgtatggagaatgtgtagaagggatctagagtggaagctggaattccagttaggagggtgcttcaggggccgagtgagagacaccactggctgagatgttggtgttgacaatcaagatattcgagacatagtttggaagtagaatcagtaggtctggcttttggattaggtgtggggcggaacggaaaagcaagagcaaagatgaactcctaggtggctggcttggattagtgtggaggtcagcaaactgtggcccacgggccggatccaatctagggcctgttttttgttgttgttgttgttttttgagacggagtctcactgtgttgcccgggttggagtgcagtggcgtgatcctggctcactgcaacctctgcctcctgggttcaagcgattatcctgcctcagcctcccaagtagctgggattacaggcgtgcaccactacgcccagctaattttttgtatttttaatagagacggggtttcaccatgttggccaggttggtctcgaactcctgacctcgtgatttgcccacctcggcctcccaaagtgctgggattaaaggcatgaaccaccacgcccggcctgttttttttcccccgtttattaataatctatgggttaaaaatggtttttacaattttaaaagtgggagaaagacacgcagaatatgcgacagagaatatatgtggccatatgtgacctgcaaagtctcaatatttgtcatctggtcccttatgggaaaagtttgcaaacttcca

SEQ ID NO: 19464 - DNA, 1035 bp, Homo sapiens
atctcatttgacgacaatttcctgttccctttggttaaaatagtttggcagggctcagtggctcgctcttgtttgtccccagctgtatgcaaggaggatccttgagtcctggagtttgaagctgcagtgagctatgatcatgccactgcattccagcttgggcagcagagtgagacatggtatttaaaaaaataaaagtaaaataatttactaaaataaccatttagatattaaggtgagagtgtaaatgcctttctcacactatctctgtgcagtcagatggtggttttcattctgcccaagttcccttcctatgttccacctctcttgattcttctggcctttgtagtaaaaatccttcttgggcctgaagctgggcttgcccactcagatttcagagaaacatcaaacagctttggttgctggcaatgaaccagggaggaggcctatctggctcctctgcagacttaattagctcttgagctgctctttctgtcaatctggccttctctgctcctccctccctcttgcttttaaggagagaatctcattttctgctcccaggggcccattctttgcaagccactttagctttctttcctttctgtgatcaggaaagccggatgtagatgtcaaggagggtaattgtaaaagctgactgacactttttctttctgcaattagggaagcgtgactttgacaactaagccaaatcattcattcccctgcctttgaaactcacccctgggtacaagttattttgcataaaattactcaatattttcatagaaccaacccggggactgctacccagttttcttctgagtctaggtcatttgtttgtttgtttgtttttttcttctctttttctaagtatttgaaaacacatctgaaatacacagttgccaatgttatgggtcagttgctataaatacaaactttttggaacaatgcacatgaaatgatgaacaatgaatgcctctggggacaagactggatgtttgagctggttcatgttctcgtataaaatcttct

SEQ ID NO: 19465 - DNA, 1088 bp, Homo sapiens
accaagcaattctctgacagcaaccgtgtatccaacaattgaattcatttctgacactatttacctggagttagcatcagatctcacaagttgaagggctcagtgcttcaagattctcctcacttaggatgctagtcacaaatggggtgtttaggatactcatactcctgcttggatgacttcaaatttgggggttcccattatcaaacttgaccacaacccccatcaagtttgataatttgctagcatgtcttatggaactcaggaaataactttatttactgttattggctttattataaaggttacagctcatgaacagccaaatggaagagataggaccctgtatagggcaaggtattgggagtaaggggacaggggaatagcgcagaggttctgtgacctttccgtgcacactatccttgattcatttaccaatctggaagctccccgaaccctattgttaggggtttttatggaggttttattaggtaggcatgattgattgtatcattggccattggactccgtctctagtccttttcaccttcctggaggtgtgtgtatgggggcgtggcagctgaaagttttaacagtctactcacttggttgtttttttctggtggccagcccctatcctgaagttatataggggccctctgagagttaccagactcttgcacaaagtcaggtatggttgaaagggccacattatcggtaacaaaagacactcctgtcactcaggagattctaagggttttcagagctctgtgccccaaacctgggacaaaggcaaaatacagttatatttttcattgtactacaggtacttctgtagcaaaattaccttgcacacaattggcccacagctttgaatctatctgggaaaaagagtggtaatcccataatgggttgtctactggattggtgatttttctgtcgtgaaaaggatgaacatggtttgtttccttggagcaaatgggtacttaggctaggaagttctctgcatcttatagctttctttattctaatctacttgctaatgaagttcatatagaattgaagtgcagaagagttaattacttatg

SEQ ID NO: 19466 - DNA, 1060 bp, Homo sapiens
caaaaaatacatcaccttggaaattccaagaatttaaggagttgtgtgccaggaaatggggacaaaaccaaaaatatatatttctcaataccatatttggtagctcctcaatttgtgtgctgttgtgagtacttacgtgtcagctgaaatatggatccccttagccctgtggcctggggccactcactagagctctgtgtcattgtccttgagtcaagaacagacttatatttctttcattgtgttgtacacattttttttttcatatgcacatataaaaaaggtttggaagcactgattgaaaaaatattgatgttatagttataaaatatggttaatgtttttatttcacttataggtggtgaacagttgttaaaatagggtggtgataggatgtcatggcatttaccaagcaggaaaaataaatgtgatgtaagacctgtgtgcacgtggttccttgctagggttcaagcaagctgttcttcagagagtatctgatatgtgcttctgtctgtacagtgaggtcagactagaagccactccgtgggctctgggatatagatggaaatcagaacaagccttatgacttttcttgacatagctttcataagtttgcatattctattccttattccattagtaagattgctactaaaaaaataagcatcagttatgtggatggttttccagaaatctgagtatcttgttcttgttacattgtgagacagtaacttaaaactttggggtgctcatgaggagcttaattagaatattgagttggattaggaggcagaggttatcaaagtggcctgtgtattgcaaagtaagagaccactgttgactgttgtacatagaaaattttgttggggttgatcaatttgggtttgtgtctcacttgtcttcatgggatttctgttgatatactcacaagttcgaggcttaaaaacacaaatgccctttggatttgccagagatttaggcatcacatggatttaaaaatggtctgagcacctggataaaatgctgagtacctttactgactcttgctatgctgcaaatg

SEQ ID NO: 19467 - DNA, 1054 bp, Homo sapiens
ttaacatatagatgaggagtacctcatctatatgttaaccagctctctggttaaatgtagcggggtaaagcccagagttcagaccaaatgtttgaagaggcagttaggattaggtttctgagctagggtaattcagatctgggagaaacacctagcatcatcagtcagaatcaggatgccacagaaaatctagggacacaggagaaaagagagtaaatgaaatgtcacagcttagaccatgggcttacaagctcagatggctgacagagggaagaatgactgtaagcctctgatgcctgacagtatattctccacctgactctgcctgcagtgtaaaaaatcctgcatgcctagagtaccagcttccctgttgttttctagcagactcatgtccagattgacttcttgaaggtatgcatgcccttttcatgtttgtagaatatgtgcgaaaaaccaaagaaacgtgaaaaagtaagaatgaaaatgagagggagtataaggactgaagtacctgtcactaaagatgatggcaggcagtggaatctgaattgttgtgtgaagggttaatactgtaataaagctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgacctggtatgcaagagtttcaagtattttctttctgttggagatctgcctaacttgtcttgttcttttgaacctcagctctaccctttcacctctactgtttcattgatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagccca

SEQ ID NO: 19468 - DNA, 1050 bp, Homo sapiens
gtcccagctactcgggaggctgaggcagaagaatggcatcaacccgggaggaggagcttgcagtgagccgagatcgcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctcaaagatagagctgtgctaggaactctctacattctgattagtaacaattctgtcagagattgtctcagtgttaggtatcagtaagatgttggaacttcagttaggcctttagatcatgtagtccatatatcctttctgtagctacggtagggttttcggacacaggctcgctcccaaaagtcagttattgatgataactgttgaggttttgactgtaatatgcttcctagttgaaatataaatatttgtacaaatgtgtatttagcataccacacaaccagttttgtgaaacaaaagataaactagtaaagaggacaccttttaaaaatagtagtttatgtgtgttagtatatatccatttgccaatatattcatactagtaaaaatagaaaaaaatacatttgttaacaccttttaatagtgagaggtagaaatcttccccaaccaaagggttatttgatttttcttctctacttgtctctaatattaaacaactcttcgtctgttttaaatttagatatataggattattaagattcttttataaataattaccttcctaaattagcattttcacagctacacttttagagttattttttaaaaaacaggtataaaggtagaatatttacaaaaattattacatcatgctttgaacaaatacagatcacatct

SEQ ID NO: 19469 - DNA, 1159 bp, Homo sapiens
gaacatgtgggtgagtgagagatagaccatatagtaagtctgtgttccctcaacaccacatggataccttcactgaggccctacagtgtgttgaatcatgtgattgaaggtttctcaagaagacatggctaccaaacaggcagatttaaaagacagaccttggaaaagaagattgaatgatagagattttatgttatcccagtgtgattttatgttattccagtgtgatagttatagaagacctgagaatatgtgagtctcggaagaacaacctttgtttctttcacttgttcgggcaggcagaggctttgaagaccatatctaaaaccctgaagaatggatagatgtctcctggctttttggaagagaaagaagttataaaggttttaactgtagttaactgccctaatctttatgcttttccaaatatgcccattagattttagtttggcatatgggaagatatttggcactgatgacaatctcactgatttggcgaatttatcatctatttgaacaaacagctaagtcagaagaggtgacattatagactagcagaaggcactggccaaatctgactgaaatcaaaacaggacagttgtgcaactcagcaaggattaaagacaaaaacaaaaacgtgggcatggggatgagtaagggatgtgttgtcttcaggtgtttccatttacctggttatcaattgatagaaaacaatgttatcagtaaaactgaagttttgagattagattattgtggtttttgtttataacctgggtcagaaggttattcacaaaataaaaaagttctaaatgtgccttgggccttggaatttgcatggcttcatatatgcagctctttcagctgtgatatccttaaggcaaacaagagtcattttattatacattgcacaatgttagaaaaccagtcttgttactgtatgagttacagaagttggacagacagcataggtggggcagatagctttccctggcctaccgtgagctagagagccattgcagtgcctgagcattaatctcaaactttgatcctaaaacaccaactagagaaaatagaaaagcaaaaaatcaaaacagagcattatgtttctttcttccaaaaggaagcagagcgttatgttcctttccttttggatgttttc

SEQ ID NO: 19470 - DNA, 1070 bp, Homo sapiens
tggattggggacacaaggccagatgagccaatttattgatctgggtggtgccagctgatccactgagtgcagggtctgaaaaataccttaaacaccaatcttaggttttataatactagtattatctgtaggagcaactggggagagtagtgatcctgtggcctcttagcttcatgactcctgagccataacttctaaccttctggctaatttgttagttttacaaaggcagtctggtccctaggcaagaaggggctttgttttaggaaagggctgttctcatctttgtttcaaagttaaactttaaactaaattcctcccacagttagttcagcctatgcccaggaatgaacaagagtcaacttggaggttagaagcaagatgaagttggttaggtcagatgtcttttattgccataattttctctattataatttttgcaaagtcagtttcaaaaggagcctagctagagtttggtcaaggagaaaatctttgtcactgctcttgtttgtaaaagggaaacattggaagtctgtaaagatcattctggattgtccatggttggtttctggagttaattttgttccagctcataaaatcacagatctcccttgttctgctagaagcccaacctggcatggcctaaccttttccttccccgacgatagctattctctgtttcactcatgagcatcacagtttctgtgcctgggcacagtactatttgagagctcccctgtgtccctgctccattcccaggctctggcaaagctagggagactatcctagctagaacagcttagggtagtcttcgttctgtttctctgttttgtcggagagggcagtgccactggataggagtaaagtttggggaagaaaggggaccaagtaagaattactgagcatgactctgagtatccttgaatagtgtcctgtgtctgtgtaaggctttagcactgcatatgtgtttcatattgatggactttttcgtacgtgtctgtctgtattcatcatagtcctgatgacataataacccccattttatggttgggaagctgatacccaactag

SEQ ID NO: 19471 - DNA, 1043 bp, Homo sapiens
tattctacttaaggataatcttattttttcttaagcctttgcatttccatacaaattttatttatttattttgttgttgttgttgtttgtttattttgagacaggatctctctgttgcccatgctggagtacagtggtatgatcataactcactgtggccttgaactcctgggctcaagagatctttctgcctcagcctcttgagcagctgggactacaggcatgcatcttcgcacccagctatgttttcatttttgtaagacaacgtctcactatgttgtctaggctggtcaagaccagtcttggcctcttggccttcagtgatcctcctgcctcagcctcccaaagtgccaggatttcggtcctgggccactgtgccaagccttccatataaattttagattctgcttgtgaaattattttttaaaattcttattgggatatttaattgaagctgcattgctatgaagagaactgatatgttttcagaactaattcttcccattcatatatacactgtatctctccatttacctgacttcattcatgtcttttactaatttttaaatttttccctatgaagacattgctcatcttttgttaaatttatttcaagtttctttgctgtatggaatgaatttttaaattagacttttgagtatgtactggttatattaattttgttatattgatcttgtatctagccatctttctcaagttttattatttataataatttctgtagattactttggattatctttgtgaacaaacatataatcttcaaatgtcagtataggttcttcccttttagttttaaaatcttctattttagttgcttactgagctgggtagacagtaatagtgggaatccttgtcttactcatgattctaaagagcatggttttattttattttattttcaccctctccccaagggcatgtttttaacatgtttccagtaagaataatgttttataggtgctttttaaaaataagttagggattttccctgttatatttttcatcaacagacatggagt

SEQ ID NO: 19472 - DNA, 1005 bp, Homo sapiens
tgtttctaaagaaactctcttttgtcatttacacaagtggcctgagtgtcatgctgctgacaagttaagaatgactatagataagttatgcttataatgctgccaccccaaaaatgaggcctctcagcccgtaggcatcagatgtggcctctgtcaacagcaggagcttcatgtgtgccatcacttagcacatccaccctgcagattagctctcgtctcttgttgtcccatttctgtcagttacagcattcttcgcttccttcagaggagaaaccttagaaccagtcttcttcactttttgctctccgctctccccttcatcttgagtctaatttctgtcaccagcagaatcttttgtaagccctgtgacatttgctttcccatcctcatttctgaagctgccatcctagtttacattggaaacacgggaggctgttggtttttgcagcagcttctaactgttctttcttttgtcctccgccccgcttaccctgccgttcatgctgcccagcgttgccaaactaacttacccaaaatattgctttcgattttcctaacttatacgagtctatagtttctccatattagcttctgtctcaaccctgcttagtgttaaaggaacactgtaacctggaatgatcaaactgttcctcagaatcaaccttttttccctttccctgtccctccaccctaccattgaggccagtcctttcaccccaccatatttgttcccccgcctccatgggaaactggtctgcctgtcttatatccagtcagatcctttcaaggcctctgttaatcctgctcttggccccagtctcccttttcaaaacttggaatatggctttgaagtcaagcacacttgagttcagatcttggctctgacatttactagccagtgagactttgggcagttccttaactttattgagatgatatccacatctataaagtaggaataataatagatcatttaagaattaaataattaatgcatataaagca

SEQ ID NO: 19473 - DNA, 1053 bp, Homo sapiens
actcccggatattctactttgggtcagaagtgagacccagggatctgcatttataattaaggactgcagaagattttgatgcagatgaaccctgaactgcactttgagaaacacttaatattgaggttttttagcattgtattgtagaagcaatagagtgttgattttgtactctaaatgtgtataaagaacatcgttttgttttccaaaaataaatttttattcaaatatggaattactgttttttcatagtcttcctacgtaacctattggaatttttagatttcaacattgcaattcagtaatacctgtgctctgcaattgaaatctttttcaaattcatggccagcaactcaggaaaagtaaaggcatttgagtagcaaagaaaagagcttggaatacaagttgagagccaccaaaaagtgctctgtcaatagttgtgtttcatcaaataagttgtttggattttgttttcttcaggcatttttaattttccttttaaataatgacaaaagaaattaaaaatagtaagttggggattagagacgaagatagagaggaagagaacattggcatcaaacaaaacaaagaaaatgtaaaggtgattgattttaagaagctaaggagtttgagcaatctaatgtgacagcaagtacactgagtcattcattgggaaagagatgaaataatattcagtaaattgttttgaaggctcagaaatacgagaaattttagaaatatttccatcaaaactggtttcaatttcattaatatttgggtatgcaaacaagaaaattacttcattaatctagaaaattcatttgtatgcaacatcttatttcccagagatgacataaaaatgaagtgtgacttattcatttgagttttgagtaacaggcatccttctaaggaaaagctaagtaattatacatacctttttttagacttttttctttctattagcaaaacaaagcctagatgtgctttccattcatttccagtttgctcagactgacatttggcttgtgtgggacatactgatgtttcaggaaa

SEQ ID NO: 19474 - DNA, 1059 bp, Homo sapiens
gcttgctctcctctctaaagcacattaacttccatcatctgttttacgtaaatttccaggcatctgtttgcctgttgtgagttaggttacgcccatttcaataatcttttttattgttgtgtaatttaccagttcaaacagtaacttcaattgctgggctataggaggagggatatcacccgaggaaaggaagaagcagaagaagatattagggcaacatttggtactgggtaacatcagaattatagggctttttagaactgctctggttcattttaatttcctacgcctttagccttcaaggttggtttttaatagtccacttctagctgcagtatttaagagccccagcaagagtggggatgttcagtggtaaagtctcgtgtttctccaaagccctgggaccgccattccccagtgggaaactgacttggcaggaagtcagctcatcttctcagctgaccactctattctggagaggaaaggcaaggggcagaggctatctccgactgcagatgaaaattctaaatcttcaaatgtgattctgagcatcctgcctcaatattgggaaaaaggaaaacaggaatttatgccattaattcatcttactttcatggaatttttttcttttaaatgagaacttagtgtctttctttccttttccttccttccatcctttctttctttcatttataaagaaaggagtttatttcttacagttctggaggctgacaagaccaagattttggggacacatctggtgagggccttcttgctggtggggactctgttgagtcctgaggctgcttaaggcatccgatggcgagaggctgagtgcattcatatgctctaaaagagcactgagattcatttgcagccacaaactcttatacaagcataaattagacaatctaatactagtattattctttacctgtctgtttttcttctgcttagggtaatattatttaacttttgatgatgaaagaattagatacctctgttagcttttctttatcacaccagtagaggtggacttatctttcttctagtttcctt

SEQ ID NO: 19475 - DNA, 1059 bp, Homo sapiens
cagctcactgcaacctccgcctcccaggttcaagagattctcctgtctcagcctcccgagtagccaggattacaggcatgtgccaccacgctcagctaatttttgtatttttaggagagacgaggtttcaccatgttggccaggctggtcttgaactcctgacctcaagtgaaccacccacctcagcctcctaaagtgctgggattccaggcgtgagccaccaagcccggctgagtaatttttttcttggcatcttgggagatgccaagtctctttatcacagcagtagttcccctggctcagttattttgacaataatcaaaataaattctgaggctccttgagtgctttctgacacatgtggacaaacaccagactgtcctggggagaggggccctcatatgggttgtgggaccagcaggcggtcgagcacagtaaatctgcccacggctcagggaatctttatttatggttgatctctcatttcctttttactagctttattatgtggtttcctatacacaattgccgatttagcattctgttcagctactgacaagcccttctctagggccagtgaggaaattccggctgcagagttcagggaaggttgtggaccccaggcaggctgagagcagaatccagcattcctgcacttagcctcttccaggagccaaacctccctcattgcccccctgtggggtagaactgaatgagtgacaagtcccctgtgcacaagtcttgcttccttacatcctttccaagatcctgtcaacagaagataattgataacatttttgtaacagcctactaggtaccaggctgggtaccaaagctaactttgcagttctttcaaaagccctaggaggcagacatcatcttttttttttttcattattcagatgagaaaactgcagcatggacagattaagtgatgtgttccccaggttcacacacgttagtaaatggaggtgctgagagtcagactcggtggcctgacttccaagcccaggctaagtcagactgacagcgagatacccctaaacccccttctctgca

SEQ ID NO: 19476 - DNA, 1051 bp, Homo sapiens
ccttcacctggtcttgccctgtctactttctgatcattctgatggtctgatgtggctgttgatgtggaactgcagaagagttcagagaagagtatgcaacaaagccataggaaaacacacaggagcttttccctccccttcaggtccccgccctctttccaagctggacaattttttattaagttgtttattccctgccttaaaactgaaacaggaaattttctggtagaaggagggtcatttagtcacgaacactgaagtgggtcaaaattctattctgggtcaaatccttgaattcaaacagatgtccataatcagtactgatggaatagagcaagtttttctatgtaagacaaataaatcaaacatcatgtgcatctcctcataagggtctgcaagggtctgatggtttaaagttcctaacagatctggttgcagcatctgccggagcttgcaccccatcatcggacggtcatcttcctgctgcagaagttaggtaacataagacttagatttcttcctgttctagcaatctgcaagaccaccaggcttaactttttagctgccagaagacaaacccccttttctgtttcggcaatttgtcctggcacgtgttttggacttcctccgatttacacgaaaagctctgatattcattggagtactttattttttttcctcagttttgtttcttttctcatgtaaaaacaaacaaaaaggtcaacaaaaaaaaattgaggtttttcttgtttctatctagttcatgctttctttgcggtgtttgaacagtagtctgttaacttagtaggtggtacctggaaaggtattttaagtatagtgactgtttaataaatacttaattggatgatggaggaggagaaattgttttcttcccaggattctctttgggggtcattttgtgtgacagatatattttagacatttggagaaacagtttcagatcctgccaggatatttttgtaaaaaaggaaaatggaagattccaataaactagaaacagtacgtatctaagatgctgacacagaagcta

SEQ ID NO: 19477 - DNA, 1050 bp, Homo sapiens
tccatgctgaaagccaataagtccagcattgttcatggaataatcttatgttactgatttgtaatgctacctgtggtaaacccagttcctcagcatacttagttctatttcttgtctctctggtttacttgtctgtctatgtctaataccagactgttttatttactatacttagtattatatatagctcataaagaaaatccttcctggatattattatttttaaaaaagttatacttttgaatattgaaagagtttaaaaatctttccgtgattatggatatatctgtttcaccccagagacctattagtttctgtgacttacccactcaccacccatctcccttttttggggtattgcagttttcatagtgatctgttaagaggtccttatatatgaggtttttaccttttcttatgttacagatattttttctagtttttgactttcagttttgctatgcattttgatgtacaagtttaattttttttttttttgacggagtcttgctctgtctctcaggctggagtgcagtggcacgatcttggctcactgcggcctccacctcctaggttcaagcaattctcctgcctcagcctcccgagtagctgggattacaggcatacgccaccaaacccggctaatttttttttatttttagtagagatgaggtttcaccgtgttagccagggtggtctcgatctcctgacctcatgatccgcccgcctaggcctcccaaagtgctgggattacaggcgtgagccactgcgcccggccctcaagtttaattttttataatctttttttttctgccttttcagtgctgcttaaaatgtgtttcattaatccaaggttacatatatatttgcctctgtttactagtatattctttaattttttctttagattcttaatccatttggaattgcttcttacttctctgagtgtatcttcttagccttcttttttgaacaattaaatattctaattactcaaaatttgattttaatctcccttccttttgtatacctggagtcataaacttgagt

SEQ ID NO: 19478 - DNA, 1031 bp, Homo sapiens
aaattatgtttagcccagggtcacacggaagccgggactgaggcagcctatcttcccaggagcccttaaccatcatgtgagcagctggagggaaggactgcacaccccgaggtcacccccaaacacccccttgatgaggggtcccttctagtggtggatgaataaggacactggcaaattgtgattagattcctttaattattacctggacaaagaagactccagctaacctgtcaaatggacgagtgaggaaagaagctaagccctggccaatgtgaatggaatctcacagcatttgcctgacagctgtgaggctttgtggatctcctcccacctgcaccttcctcggattggggaactgaggcccaacctttccttttgcctcagatttattagtgactccagaattaggctttagccatggttattctctcctaaattattaactcgataggctcttggactccgaggctaaccagctggagacagcgccacgggcagcgggaactcaatggcaaatagcaaatgtatcttcttggacagaattaaagtggagaacagcctgtcccaggcacgggcgggcaggcttccactcagtctaggctgaggggcagggctttttctggagggtggagggttgagtggtgtggtaggtgggaggaaagtgcctgcagagctgggagtgcagggtgcgcaggagcagggggactcctgagctggcctggcaccttgggtgcttcgcacccgtgagtgggcatgggatttgggctgtggtgggggacgggccagggagcaggcagctcgaggagggccttgagcttgctgagggttttggattttgtcctgaaggtgctggtgagtccatgaatgagtcgcatttattatcttctatttttttgagttagaaatcaaccagtgggcatagaagtaaacagtcaaaagtacaaaaaggcccaaaagggaaagcaagagacccccaccagtccctctgccgggggcagcccccagcctgtttctcttggcatttgccc

SEQ ID NO: 19479 - DNA, 1047 bp, Homo sapiens
caaaaaggagaggtacaggagaaacaagacacatctgtagtatgatcgcacaaatttgctggagaaatcctttgtttaagtctctctaccaccaagcagccaaaaactttttgttgaggtcttcattcctagagttaacttcccacctggaggcgtaagattattattagtatctgagggaagcagaaatgtcctgagggtgattttataatgaactgccacttaggaatttgccacacagccttcaaagcacttttaggctctcagatggcaatctaaatgaaaaagcaaggacttttaaattttttttgaattacaatgttagcactcctaggattctttaatctttcttacccacagagaataaagctacaggtatggtttgactgcaagaacaaacagcaggttccactgctgtgcttttgtcacattttcagtggttcatataatgcagttatcccagtacagcttttattaacatttttttttaatttttgttttttggagacaggatgttgttctgtcatccaggctggagtacagtggcagatcatagctcattgcagtcttgaatccctcggctaaagtgatcctcccacttcagtctcctgaggaggtaggagtactggtgtgcgccaccaccctatgctaattttaaaattttttttgtagagatggggtcttgctatgttgtccaggctggtctttaactgctgggcttaagtgatcctcccaccttggcctcccaaagcactgggattacaggcatgagctaccacacccagcctcagtatggttttttgacgcagtcagaattcctcgggagattttaggttaccagaaatagccaatgattgggtaagaagatgcctactgaacacattcaagatttcagttcaggccgggcatagtggctcacgtctgtaatcccagcactttgggaggctgaggcgggtggatcatgaggtcaggagttcaagaccagcctggtcaatatggtgaaaccccatctctactaaaaatacaaaaattagccaggtgtggtgg

SEQ ID NO: 19480 - DNA, 1043 bp, Homo sapiens
tcttctctctagatttaaacttaagcaagcagaagcctctgggattctgtactgactagaataattcactgcttccttcttattgcgagtccccgtccatcataatcctccctggatcatgctgaataaacagctggtgacttgagatggggagaaattctacagagtttccttgcctgagcctttcaagggctaagactcaaaatgttcaactgcctaaagcaataaacaccaaaagaggttaaatttcgaatttgcttttcgcttatctagcagtggacaactaatgaacccaacaatcaggcaaaatctgagttagaaacatttagaactggaaattgaccttaaggataacataattcaattccttcacccttcagtgaaaaaacaacttcctcttacaggaattgctcctagttttcccgcttatagtctggaatgtttatccccagaaggagagagctttttaaaaaaggaacatgctggaaagaggatactcagaccatggctgacagaacttgtaggaacctcacttggaggtggtttctactgtggttctactgtggtttcagttaggtcgcaaggagaggtgacccatctacatggtcatccattcatgggtacagttttattttatgaccgctccaagcctcttaggacactccacagtgtctttgttattgttccttgtgtttggtgcttctctctgaaaacaggattatacattcctggcctgttaaatacaggctggccatgtgacctgctttagtaaaatctgagtagccaagcgaaaaatgttaaaaattgtgtaccatgttttcctttttctctttgagattcacagtgttccagatatgggctgctttgcccactgggatccctgcatgaagctgttttggaacagagctacagctggctcctggtggatacacagcatgaatgagatctaaaactttgtttttgtaagcctttcagatttggggtcattgataccacagcataacttagcctctcctgactgaaacatcctccttattaagtga

SEQ ID NO: 19481 - DNA, 1094 bp, Homo sapiens
gccggccgggcggggacaggggcgcgggccgggcccgatgacctcagagccccttcccgcagcgctcgcctggttctcgaggcccgctgcggcagaggaggaggagcagcagggagccgacggggccgctgccgaggacggggcggacgaggccgaggcagagatcatccagctgctgaagcgagccaaggtgaggcggctccgggccctgcgcccggccgagcgcggtagcctttgtgagcggggtcttggcgttgctgcgcattactctctccgcctcgccgaagagtggatggaggctccgcgggtaaaattgccgagaatgaggtgggtcatccgagaggggattggaatccatccaggcttttccgactctaaggcctgcagtaaaacctctgcagtgtcaagtgcaaatggagatggcgccctaggcatcacgctttatgcaaacgaaatatcgggaacgttttgtagtggttttatcaattaaccagcctatctgaaatgacataatttcgcacgtatatagcggcctgaaaatggcaacttagtgttggttatgcggttcggttctcctcctgaattcttccttttctccacatccttttctatttttttttcctcctcttttcccaagttatctcatctcttccattgagctaaatacctactcgatgccaacaacgtccaaatttgtatttccattctgtagtgtgctactgacatgccatttgcactttaggaccatacctacctctcagatttaacatgcccaaaactaaacgatctttaatgcctcctcaacatacgctttcgccatctctttactaccatcagtttttcagcctaaaaacctcatagtcattcttaaaacttgtggtaccttaccattgccttccaatacacttacagtccagcaacaagtcctgttgccaacaaatgcaaaatatttctcaaatctttccccttttgtctatctcccttgctgtcaccctagtgcaaaccatcattgccaccaactatgctccagtagtctttcctggcctcctggcctcttgcaatctattctccatgcagaaaccaaagcgaccaaa

SEQ ID NO: 19482 - DNA, 1918 bp, Homo sapiens
gagttccagaccagcctggccaacatggtgaaactctgtctttaccaaaaatacaaaaattagctgggcatagtggcgggcacctgtaatcccagctattcgagaggctaaggcaggagaatcgcttgaaccccggaggtggaggttgctctgagccgaggtcacgccattgcactccagcctgggcaacaagagcgaaactccatctcaacagaaggaagaaaaaaaaaagaagaaaaggtaaatggctgattattgattttgctttacagacaggaatttgctgttgctggctatgaattctgcatttcaactctagaggaaaaaattgaaagagaaaaggaattagcagaagacattatgtcaggtaggaaacccattatctgggcattgccttttctccacaaaaggctttactttacacttttgagaaatggaaagagatctaaattgggaagagggaaagttacctattttgcaaaataagtgtctgtctttaaggtatcagcagaagttttggaataagatgttttatttaaaatatttgactgctgttttggtggtggttttttttttaacccccttggtaacatggtcataatttatttgttaacttttagttacatataacttaaggaaaattggggagcagaaggagaaggtgtttctcgtatctcttagttcagctaccaatcaaaatgcttattacgttttagccctagatatacagcaaattaagaaagaagagaaaaaaagctcatgtttttacaatccatcctcactcattctggaggctaggaatagaactggatgagcaggaagctctctagctctccaccattttgggtttcttaatttgggttgaagtattgagaattttcagatttgacatttattcaatacctactctataccaagagctaccgagatggtagggatacagcagtcaactcttctgtacctagtggtcttctaactctctcttgaacatagagtagtcccccgttatccatggggaatatgttccaagacccccagcagatgcctgaaacgacttctaatacactgtgtttttttcttatatatatgtacctatgataaagtttaatttataagttaggcacagtaagagattaacaacaataacttttaatagaacaattataactatatactgttaacagtgtcacagacaggagattcattcttattgtagatcttatcaacctcagcatacagttttttgttttttgttttttgttttcttactaagttgagaactttcaccttttcattaaaaggaagcactttatgacttctctttgtcatattcaaattgccagtatcaccactctcacactttggggccattatgtaaaatatggattgcttgagcacaagtactgcaacattgtgggttgatctgataactgagactgctgctaagtgactgaggccagctgccgtatacaacttgggtacactggacaaagatgattcatgtcctgggcaggatggagtgtgacagtgtaagatttcttcatgccacccagaatggcatgcaatttaaaaacttacggattatttcttgaatttttcatttaatatttttcggactctggttgactgcagataactgaaaccccagaaaatgaaactgtggagtaggagggatcactgtacaccaatttttttgttttcatcactccactgaagctacctttatcaaagtcaccaaatccaatggttacttctcaatccttaacttactcatcagcagctttaacttaggggatcactgtctcctactgaaaatactttcacttggcttctgggatgcctcactggtctctctagtgaggtgaatagacttccctacctcttaatgttggcacgccttagggctgttttcagccct

SEQ ID NO: 19483 - DNA, 1117 bp, Homo sapiens
caaatggcagacttataattatgattgcccacccgacatcttgacttgaagtctaatggtcatctcatacttaacatgtccaaaataggtctcagttttgccgctcacaacttgtttcgtcaccagtcagccccagatttgtaaatggcacactactcatttagttgctttggccaagaacctaagaattgtccatgatttcttcctcattcctcatatctaatccatcagcaagttatactggatcagccatcaaaatatatccatactgaccatgtctcatcccattaccctactgctttggtccaggccatcactgtttcaagacctcagtacctttgtatcacctttagaataaatttagaatccctgcatggacctgtaaggcgcttatgacctgggcccacccacctcttccatgccatctgctgctctccccttgctcgttccagtctcaccacactggtcttattctggcacattccaagcttagtgccacctcaaggcctctttgcttgatattccccctacctagactgttctctcttacctttctctggccaactcccgtacttcactcaggtctctgctcaaatagcacttcctcagagtgctcccttcactaaaactatcatctcttcccaccttactattgctctactcctctttcctttacttttcttcatcacacttaaaagtagaggtgtgtgtgttgtgtgcttgtgtttctccactaaaagtatgtttttgtttaaaaatttttagtctttgtcttccatatcaaagaaggatagagacttcatccattatactcagtgctaaatcctcggtgcctagaacagtgcctggcacataatagaggctcaataattactgaatgaaagaacaaaagacccaagaaagaccagcaaataaatccagtttcagtgcagtgtggaagtgctttgaggaaatccacaagaggtgtaaaaacaagtctagctgtcaagtaagtcacttctgaactatttacacctttgctgtctttcatttatagtgttgactatggtttcttaggagtgtaaagctatattttctgattcaaaaaataataccagtaaacactgaagaaagttta

SEQ ID NO: 19484 - DNA, 2012 bp, Homo sapiens
agaaatttcagctaaattaggtttaacagtaaggacatttatgtcaagtaactggcagttcagcaatagggagcaggctgttgagttagttgacagtgtgattcactgaaatcataaaggaacaggctctttccatccttcctcactcatgtattggctttttccccatgctcccctggtggttgaaacgtgaaactataacaattcccaggaatctcatccagaaatgacagtgtccagaggaaaaggagacttctttgatgtttctcataggatcaaggtaatctttcctagaagtctccaagtagatttgtccttacttctcattggttagaattgggttacatgccatttctaacccagtccttggcaagaaaaatggattatcatgattggctaaaatacatcagtctcctttcctgaggatgtgagtcatgtgagaaaagaacggatactgggacaaagcagctgctctgctagcaaaggaagatctttgtaatagtgagccgtctcactgaggaacattctatagctcctgcttatagttttcttcatatagatgacagctatttattaaatttgattctaactgactccttgactgaactctttgcttttcagttgatattcacactaattccagatttataatcatacattccggaaatcatgatacaggttgagcatcccccagaaccgaagctttctgagtgccaacatgatgcataaagaaagtacgcattggagcatttggatttgggtttttggttttgggatgctggcagtatccaaaggaaatattccaaactcaaaaaatctgaaatctgaaacacttttggtcctaaacatttcagataaggaatacttaacctgtaattgtttccttccagagagttatactactgtctcccttccccaccctttataaaattagttcattggctgtaccttcagaacatcaagcaatagtagtaataggaaacttagtcttatatccaatttggtaccaagatatatgaatagatttattactattatatatctagagcggaccaggcttgcttgtaggttaattgcttagtacctgtgtagtgctggataatatttaatgctgatatgtaacttgcgtttcttatgagatccacagtaaatttcttattgtattgtttgtactattatgtttgtattatttgttatcgcaggattgttattaatgtgataaaatgaattgggatgctttctgtattttctattctgaaataagtgtgggatattgcattggaatggtctgttccttgaaagttgcagagtctgtgatgccagatggaccagaactcctgagttaattctccggcagctttttttttccttcttgattactcatgtatttcttccattttcttaatttcaatataggacagtgctaaaaacataaacattaataaatatctattgaataaatgaacgtatgggtgaacaaattttataactattaatttcctagaagaaactttaaggaattatatttttaaagcatattttacactactcttacgtatctgagatcctcttccttttctagatcctaattttatggatttccttttaaattagtaaaaagatgtttcccattgattccttcctcctcctttccttgaaagtttttattttcatatattaaataaaacatttctagaaagttatttttgatgacataatatttggttccatgagtgcttaaagtctggagcctgagttcagattctggttctgccacttactagcagtggacaagttatttaacttctctgttctcagcttccttatcaataaaatgaaaataataatagaacttacctcatagagttacaagaattaaatactccaggactatgaccagtactcattaggcactattatataagagtttgtggaatgtgatatatttactaatcttatttattatatgatttggcacctatattttactattatcaatttatgaaggacct

SEQ ID NO: 19485 - DNA, 1033 bp, Homo sapiens
attttgtttattcattcaaagagccaacttctggtttcattaattttctttattgtctttctattttccatttcacttatttctactttgtctttattacctctctcctgtttgctttgggtttattttgttcccttttttctggtcccttaggtgggagatgaggttattgatttaaggtttttcttctaacataattgccatttataactataagctttagctgcatctcattaattttggtaagttatattttcatgtatctcaagtattttccaattttgggggggatttcttctttgaccctttggatatttaggagtatattgattaatttccacatacagtgaatttctcaaattttcttctgttgaatccagtttcattccattgtgttcagagaacaactgtgcttgattttatttattgagatttgttgtatggcctcacatatggcttatcctggagaatgttgtatgtgcatttgagaagtatgtgtattctgttgaatggagttttctatgaatgtctgttaggtctagttggtttatagtgttattcaagtcttctgggtccttactaattttgtctagttgttctaatttttttttttttttttttttttgggatggagtcttgctttgtcgcccaggctggagtgcagtggcgtgatctcggctcactgcaacctccacctcccgggttcaagtgattcttgcacttcagcctcccgagtagctgggagtacaggtgtgcaccactgcatctggctaatttttgtatttttagttgagatcgggtttcaccatgttgtccaggctggtctcgaactcctgacctcaggtgatccgcctgcctcagcctcccagagtgctgggattacaggcatgagctactgtgcccagccagtttttggtatttttagtagagacgaggtttcaccatgttggccaagctgttcttgaactcctgacctcaggtgatccacctgcctgagcctcccaaagtgctgggattacaggcatgagccacc

SEQ ID NO: 19486 - DNA, 1271 bp, Homo sapiens
caacatagtgaaaccccgtctctactaaaaatacaaaaaatgagctaggtgtggtggcgggtgcctgtaacctcagctactcgggaggctgaagcaggagaatcgcatgaacctgggaggcggaggttgcagtgagccgagatcacgccattgcactccagcctggttaagaagagcgaaactccatctcaaacaacaaaacaaaacaaattagtattgaaagggataattggtctaattattgcattttaaaaagtgctttccatttttgttaattcctttgttttcagttcctcttacaggaacttttccctctctgatctgtatttgtattttgtagggaaggtatatgtatatatgattttcagttgtataaggagtaacctaaacatttcttaaagacagttgactcagaggaaaaaaaatttttttcagtttcttctctaaaatgagatgagtacattttaacattatccttctttcccttttcctcacttgttttttctctgtgatctggaattttagacttagtggaatttattgcagaggagaattctaaagcctgcatatttgccttgttttttaaatagtctattttctcctgctcagatgctttgctggactcagaagttaaatgagcataaggttagggagttgtctgtttatgaagcttgcttagtccctggtgaaccttcatttttagcatccagttctctggagcttctgtagtctattctggctcaatgcttctgtcccacatgctctggcctcttaccctggaatgtcatttacctgtatgttgacctctcttctctatccttcacattatcccctcttccatcagttttctcatgtatattttgggagtttcttcagttgatattccacattaccaatttattattaagaaaagtcagttctgtgcttttcttttgatttgttttttgttttttgagatagggtctcactgtgtcgcccaggctggagtgcagtggtgcagtcatggctcactgcagcctcaacctcccaggctcaactgatcctcctacctcagcctcccaagtagctgagactgcatgctcatgtcaccatgcctggctaatttccggattttttcatagaggcggagtttcaccatcttgcccaggctggtcttgaacttctgagctaaagcaatctacctgccttgacctcccaaaatgctggcattacaggcatgaggcatcacgcctggcttccctctgatgtaattttttaaaattagatttcaa

SEQ ID NO: 19487 - DNA, 1024 bp, Homo sapiens
atggcttaaatctgtcgtttttgatattcaggtttcctcaatttagccttagtgaaggaggggttgtacacactgccatttttgtattttaaaggaaaaatgactttcattcccaactgattatgacctttcaggatgtcgtcaagtgatgctttcagttgtaacacgtgacttggtgctgtccctgctggtctaagtagaactgtagattcatatgggctggtgttcctgtgcgctgtgggtgtggtgattcagcctggcatttctaccataagtttttggtctgctgatttgctgccctgtcttctcttactttactttatcaatacctggcaaactgaccagaattaccttcctcatggcaaagggggattatggtgaattgttgttcttatagtctgtttcatgaagcacaagtggaatttaatacataaaagagaaaaatatcttagtttgctaccagcatccagcatgaagttgtaaagtggggattaggcacgtgacagtatagcacccatttgaatttaaataaaagtgaaccatatttatctggttatataaaactaaaaatgggggtgtttatataaaactaaaaactaagaatgatgtaaccttttgtctgtgttatctgaacactctacttcctttgcagccttagtcacacaactgagtcatctcaagtactctttaaggacacacagcccaggctgttctgagtcagaataggcccctacaggtatattttaaaactcttcgtaattctaatgtgtactgctggtatagctgaactactgacctggatcttagtcctagcctttttgcttttgcaatttcagtatcttcatctctaaactagggaaacactgggattctttcttagctgtgggggaaggtatttggttagatgactttgaatgaatagactgctgtgctgaaagagctttatcacactgtctcaaagtatgtaaagatacataggtggatgctcttactgcagcagtcatgaatacatttttagccattt

SEQ ID NO: 19488 - DNA, 1025 bp, Homo sapiens
tactgattggtctaaattcaaaagtgaattggttaaaatcgtgtcattaaaattttttaactgtccaatggtcactggagttttctgggcataaatatttttaaaatagaatcactcagtgtaccaaaattaaaagcattatgaaatttgcagtcataaacatgcagtggaaaactggctgtcagaatacttttatgaagagtattaggaagaccttaatttagttctgggtgctaaaaaaatcacgtgtaaggatatagtgtcagaacactgaaatctaagtctacaaagaatatcatgttttggtttgcagtgaaccacagtaagttgtcagtgctgctctgtgcttaccacttaaatcatgataaggtgaacctccataggtaaaccatgtgagaattctgtcctttcatttattttgaaccaagaactattattggattttaactctcattctgagatttcttctccaggtgatggtaaataaagtaatacgcacatgcattatgatgaggatggagggagtggttcacagcacctcaccttcgggtcctcaggtagaactgcaagagtaagaagttaggctctgatctgacatgttctcagaaactatacggttgaccttcaaataatgcaggagttaggggcatagaccccctaagtagtcaaaaatccacatctaactttgactcctccaaaacttaactactcatggcctactgctgaccagaagtcttacggataacatagtcgattgacacatattttgtatatgtattatatactgtattcttacaataaagtaagctagagaagagaaaatgtttgttaagattataaggaagagaaaatatatttactattcattaagtggaagtggatcatcatgaaggtcttcatccttgtcatcttcatgttgaataggctgaggatgagaaggggttggtcttgctatcttgggtggcagaggtggaagaaaatccatgtataagtggacccacacagttcaaacccgtgttgttcaa

SEQ ID NO: 19489 - DNA, 1279 bp, Homo sapiens
accactaagcctgatctaaagtttatgttggggacctcaggtatacaggagtggaacagggacaggagtgaaagctttgactgaagacaaatgtgggcttatggcctatctctgtcactaatttaactatatgggcaaagtactaaacctgtgtcttcatctgtaacatagggattagacaccagtgataggagggtcttggtcagtagctaatcacagagctgcttccttaaaagccttgagtacttttgtttaaaagtttaggtctacttgaaagtctgtaaagtgctaatttttatcatcctgagagatctgtttctcccctttccagttaccagtggcattctcccaaaactgttagtatctatgttatagaaagatacttaaatgctatgataaattgtatgaaaaaaactttaaaattcagcaagcaattcttaatgaaagataaaactggccctctagtaccataattagtttagaattcagtcttttaaattatttgcaccttgagactctgtgaaatgaaaacatttaacagtaaactcttgtcccaagggagcaaagtgagagtaaatgctggtccatagtgatggggaaaaaggactgtgttcaccatgagtttttcaggatgcagcataaagcttatctaaatactacacagatcattatcttttaacccaaccaatcatatattcaaactaagggaaaaatatgtaagcttttcctttggaacctgagacaccaggagccttaaaccacaaataatctactgtagctatggacagggtagtcaaatttatttcaaaacaaaagctttgttgggctgcatcaaatgcaggagaaaaggaatacttaggggcatggttaaattaccagtgtgcgtaacagtgaggtatgcctcaaataagcctttaaaactttataaactgaactagaacatacccatgcagtaatattttttcagtgctactaatgaaaaaaaaaaattaaagcctgcactggaaatttacaatatggcagaatttgttacttttaccttttgaccctaatgtacagattttatgacagggtctgtgttaaaaatctaaacattttcacaagattttaaacatcactggaaagctgaatttagaggaaacaatatcagataaaagtacaatgcccgtgacagccaacattatgtaactgggctgtatgaggttgtttagaaggctagggttaaaaagatagatagacaaaaagatttttaaaaatcacccccaaagttgatgcgctg

SEQ ID NO: 19490 - DNA, 1063 bp, Homo sapiens
tgaagttttatgggctttaagacatgttttaggctgggtgcagtggctcatggctgtaatcccagcactttggaaggccgaggcaggtggatcacctgaggtcaggggtttgagaccagcctgaccaacgtggagaaaccctgtctctactaaaaaaaatacaaaattagtagggcgtggtagctcatgcctgtaatcccagctactcgggaggctgaggccggagaatcgcttgaacccgggaggcggaggttgtggtgagctgagattgtgtcattgcactccattctgggcaacaagagcgaaactccgtctcaaaaaaaaaaaaaaaaaaaaaaaaaaagacatgttttaaagcccaataataaacactggaatgaggcagaacagagaacagatttatgatattttcctgggagctggaaaagaaatcaccagggaaacatttatggaagaggttaataaacaaatgagggagtagatctcaataactgattccaatgattccaattctgtgggacactctgttcttagaaaaacgctgaggctataaagctgcttcattcaccaccatgatgattttaaagctatggattatataacactatataatgattttctcaaataaatggagtattgctaacaaaacttactccaaacattaataattttttagcactgtgttacattgtgaaaataaccagaaatggtagagaatgtctgaagggaagtatattcccagaaagggaggatgtcaaccaactctggaggatacccacatcagaaaaggacctcctctaagacacagttcccaagtaaacagagggctatgcagtggggctaacaggcagcttttcacagtcctgccatagcctcagagctgacagttgggagcagatgtaaccgcctgctcaggaacctctgaattcagagggctcttcacatccacaaactgcactacagaatctgagagcactgtcagagctccaaagggtgcatggccctgggctggacacagatgcagcaggtgggaatgaactctgctccctagccaccacctgct

SEQ ID NO: 19491 - DNA, 1031 bp, Homo sapiens
aaataaaaaacagatgctccacatacggttattactacattacagaagcttttcatagttttccagtgctcttaaaaagtgctaatagaaaaagaaacaaaatgttttcttaaccatttacatgtatacatgtattttttgcatcctcaaacctgaaaaggaccaaatataagataatctatagggccgggcacagtggctcacacctgtaatcccagcactttgggaggccaaggcgggtagatcatgaggtcaggagttcaagaccagcctgaccaacacgtctctactaaaaatacaaaaattagccaggcatggtggcgcatgcctgtaatcccagctactcaggaggctgaggcaggagaatcacttgaacctgggaagctgaagttgcagtgagcctgagatcacgccactgccctccagcctgggtgacaagagcgagaccctgtctcaaaggaaaaaaaaagaaaaaaaaaagataatctatagactgagttatttgtgaatataactgatctgctcgactatattttataactttctagtatttagtagtgtgccagaacataaaaagcacctcatactggttgaatataagtgagtaaacaaaaatatatgaatctctaatctacaaataagactatacacaataaattctgatcaatctttactagttgttttatatcatagtctagtaaaatccagtatcttaagtaaaagaacagatggaactaaatatgcaagagttccatcattcccaggcatcaagaagaatttgaaattacaactaagatagatcacagaatacaattaaaaccaaataaccaaaacatattttttaaaaaacaaacagcctgacactcacctacatcaacccccagtctatccaaaggcctttgccttctacagcagataacaaaggtaagaaaagaaaatttcaccaattcataacacaattttttttaatgcttttaaggccgggtgcagtggctcacccctatcatcctagcactttgggaggctgagac

SEQ ID NO: 19492 - DNA, 1002 bp, Homo sapiens
aaaaatcaagtaatctagggagaaaaaatgggagagggtatgtgtagagatttgagggaaacccaaaatatacacaaaatagtttatgacttaaaaaaaaaaaacgcaaaaaaaggtatgatgaggacaatacaaaactaaacctgtaaactaaacctgtttgctgggcgcagtggctcacacttgtaatcccagcactttgggaggctgaggcggatggatcacaaggtcaggagttcaagaccagcctgtccaacatggtgaaaccccatctcaaataaaaatacaaaaattagcccggtgtggtggcgggtgcctgtaatcctaactactgagctgaggcaggagaatcgcttgaactctggaggcagaggttgcagtgagccaagatcgcgctgctgtactccagccagggcgacagagcaagactcttaaaaaaaaaaaaaatggccattatctccacttaactggtgaagaaactgtggctcaagaaagttaagtaacttgcacaaatcagacctgcaattatttattggagagttgaagtaacaggtgcattagctggacagttgctcaaaatgagtccaacttaagtgataccaaaatgtcactgtattattatttgtaaggttacagaggagttttatttaccagaactatttttagggaatatagtatatgttttgggaaaataaagaatatataagttgtttggggtgccaatgggatcaagatccccttggggtatgctggatagctggctatgaaactcttcaaaagaggaagctttcctaaatggtatctacacattttcctgtaatactcaggagtagcaacctctattttctttttctataccaacaagaatgagcttggaaagcttcatccttaaatcaatgttaaacaggatttgaggactgtcaatgaagagggggccccagttgttctgagtggtcgtacatggtgtgatcctaaatctgcttaacttcaaagttagtaccc

SEQ ID NO: 19493 - DNA, 1046 bp, Homo sapiens
tcaagggttcaagaccagcctggccaacatggtgaaaccccgtctctactaaagatacaaaaaattagccaggcgtggtggcatacacctgtaatcccagctacacaggaagctaaggcaggagaatcgcttgaacccaggaggcggaggttgcagtgagctgagatcgcaccactgcactccagcctgggtgacagagtgagactctgtctcaaaaaaataaaaaagaaaaaaaaaagaaaaagaaaaggcagtaaagtttaggtgagctgtgaacaaattagctttggcaaaacatatatctctttctgttgaaccttcatgatatcatacagaaatgtaaactgtgaatagtggagagagatgatgagttttgtgcttcagaatgattactctaatgaaagtatggattgaagagatcaagattgtagatgagtctattgtctttgtcccagtggagggaggatatctcaaattagggtagcagcaactgagatggagatgatgggatgaattcaactctttttttttttagagacaaggtgtcacgctgacacccaggctgtttaggcagtggtgcaatcttagctcactgcagccttgaactcctgagtagctgggactacaggtgtgggccaccatgcctggcttattttttaacttttcgtagagatgggttctccctgaattactcagtgatatgatttcgatctgtgtccccaccaaaatctcatgtggaactgtaatcctaacattggaggtggggcgttggatcagtaggaggtgattggatcatggaggcagatttctcatgaatagtttagcactatcctccttggtactgtccttgtcagtgagttctggcaagatctgcttgtttagaagtgtatagtacttcctccctctctctcttgctcctgcctctgccatgtaggatgcttgctccccctttgccttctgccatgattggaagcttcctgaggcctcctcaaaagtggaaactgctatgcttcctttatagcctgcagagccatgagccaattaaa

SEQ ID NO: 19494 - DNA, 1035 bp, Homo sapiens
agtaatttgctcaaggtcatccagctaataactggtagagctggcatttgagctgatgcaatctgggtgtacagtatatgcttcaaccactattttccacctactccatgcctgacacatgctttcacaaaggcagtctcatttaattcttagactaactgcacaagataggttttattttctttttttgtttcacaggaagaaactaaagctcagagagattaagagaatctttgtggtcacacgtttaataaatgacaatgtgaggattcaaaaacagaaagggagatggaatagattctgactttcttcagggaagcagatcaccactttgttactgtatttgaaagacgagctgggcacggtggcttgtgcatgtaatcctagcactttgggaggccgaggtgggaggatcacttgagcccaggatttcaagaccagcctgggcaacatagtgagaccccatctctacaaaaaataaaactaacctggtatggtggcgtgtgcctgtggtcccagctccttgggaggttgagatgggagaatcgcttggggtcaagaggtcaaggttgcagtgagccttgatcacgccattgcaccccagcctgggcaatggaacaagactctgtctcaaaaaaaaaaaaaaaagaccaacgtgggtttatgagtacatttaattgacatcgtatagaatcagctctattttccccttgttctgaacttcactgcaaaacatttagccagaggagctcacccaagtaaatccctcaactaatcagttaaagaggggggaaaaaatctagttctcaagaaaagaaggcataatctcagttgtaagaccactatatggggacttttggcaactttacccagtaccttaacatctagtatgatgttaaaatgcatgctgcacagatgttaacagatacctattcagtacctagaatgacactgtgctagatgctgaagaaagagaaaagcagtgaaaggtataggaaatgaataataggttttgccatgacagtcattgctgtt

SEQ ID NO: 19495 - DNA, 1061 bp, Homo sapiens
aaaagagctgtaatacagccggtcacagtggctcacacctgtaatcccagcactttgggaggctgaggtgggcagatcaggaggtcaggagtttgagaccagcctgaccaacatggtgaaacccccgtctctactaaaaatacaaaaattagctgggcatggtggcacatgcctgtaatctcagctgctcaggagtctgaggcaggagaattgcttgaacccaggaggcagaggttgcagtgagccaagatcatgctactgcacttcagcctgggcaacagagtgggactctatctcaaaaaaaaaaaaaaaaaagagctgtaatacaaatagggctgaaacatatccctctgcttgccacattcccagcaacaagaagaaaagaactgcagccctttggagagcccggcccaggctgttgcgttgcctgctgggctgagtgggcagaacaaacccagtgggtgcaagcaatactcaggcagaaggcatcactggccacagaggtttctagctggcgaagcaacaccccaaggatcctgtgacaatttattgaatatgacaccaaaacagtaatcaacaaaagaaaaaatagataaattggactttgtcaaaattaaaaacttttatgcatcaaaggacactatcaagagtgaaaagacaatctaaagaatgggagaaaatgtttacaagccacatagctcatcagggattgatattcagaatatataaagaagtcttacaacaaaaagacaaaaaatagggtgggcacagtggttcacacctgtaatcccaatactctggaggcagagagaataataatacattattattattgcttgaagccaggagtttgagacccgcctggaatttgagacagggatgatccctccacctcagtgcctcccaagtagctgagactacaagtgcgcaccaccatgcctggctaatttttttgtattttttgtagatatgaggtttcaccatgttgcccaggctggtctcgacctctgaggctcaagtgatctgcctgcctcagcctcccaaaatgctaggattatagg

SEQ ID NO: 19496 - DNA, 1026 bp, Homo sapiens
gcgcgatcttggctcaccgcaacctctgcctcctaggttcaagcaatcctcctgcctcagcctcctgagtagctgggattacaggcacgcaccactgtgcccggctaattttgtagttttagtagacacagggtttctccatgttggtcaggctggcctcaaactcctgacctcaggtgatccgcccacctcagcctcccaaagtgctgggattacaggcgtgagccaccacacctagctaaaaattctttaataggtctctttaatgttttaagtagtcctagatttcccctgtgaaccatcttgaaagttttgccttttattctcagttctcttttgctggcttcttatcaggaaacaccacctgactgatttgagatgtaaagtgatggagtgcaaagaccacaggtctctgtattcaaaggtctaggtgcaaggtacaaccttaccggatatttcagagcttgtcttttataatttttgagctgagaaggtcaggtgagataaactgtatggactggaattctgatttgagatgtaaagtgatggagtgcaaagaccacaggtctctgtattcgaaggtttaggtgcaaggtacaaccttaccagatatttcacagcttgccttttatcatttctgagctgagagggccaggtgagataaaccctatggactagaattctgaaaggagagcagtatgtcaacaaaggaggattcagcaactgcctgatgcaatctctagttatcttcgtcctgcaccagcagtatatgatgctatctcatccaactccattcttcagatttgtcatctctcctttacttggataaaacctggctggaaacttggcttcagtcctccatatccatctgttttaggcagacttaactcagctttacatctttgcaaacttacccacgcacatcagcatccgagaaatttccatactctttgattaaaattgcagtaaaagtcacaaaggaccttgcttaaaatgaaaggaagtttctaggaactctaagctcag

SEQ ID NO: 19497 - DNA, 1034 bp, Homo sapiens
aagaatcgcatgaacccgggaggtggaggttgtggtgagctgagatcatgccactgtactccagcctgggtgacagagaggattctgtctcaaaaaaaaaacaacaaaaaacctgctttaacaatacgttatgggctgggcacagtggctcatgcctgtaatcccagtactttgggaggccggggtgggtggactgcttgctgggcaacagagcaaaatcccatctctacagaaaaattagccaggcatggtggcacatgccagtggtcccagctactcgggtagctgaggcaggaggatcacttgagcccaggaggtcaaggttgcaatgaaccctgatcataccactgcactccagcctgggcaacagagccagaccctagccaaaaaaaaaaaaaaaaaaaaaatcaaaactatttattatgaacattttctcctatttcatttagtattcaaataccaatggctgccaattacgccactgtatgtatataccataagatatatcacgaatcccttactgttagacattttgatttgccactttatcactgttatacatggagcgatgctcccagcttgagtttaagaagaattcagacctgccaggagcctctgtaaagagcctaggggaggccagacgccgtggctcacgcctgtaatcctaacactttgggaggccgagacaggcagattgtctgagctcaggagtttgagaccagccagggcaacacggcgaaaccccgtctctactaaaatacaaaaaagtagccgggcgtggtggtgggcacctgtagtcccagctactcgggaggctgaggcaggagaattgcttgaacccgggaggcggaggttgcagtgatccaagatcgcaccactgcactccagcctgggtgacagagcgagactccgtctccaaaaaaaaaaaaaaaagagcccagggcagactgcaagaagcccacatgcagggtgaggaagagctaggccagctcaggtcatcctagggaaaactcttagctgtccatggaacaggt

SEQ ID NO: 19498 - DNA, 1064 bp, Homo sapiens
agaaaagaagaaggaaggaaggaaggaagaaaggaaggaaggaaggaaaatctaagagaatagaaactcaggataatgattttggttttggggtttttttgtttagctttattttctaaattttctttgagatgaagtcttcctctgtcacccaggctggagtgcagtggcacaatctcggctcattgcaacctccacctcccaggttcaagcaattcttctgtctcagcctctccagtaactgggactacaggttcacgccaccaggcccagctaatttttgtatttttaatagagatgggatttcaccatattggtcaggctggtctcgaactcctgaccgcaggtgatctacccacctcggcctcccaaagtgctgggattacaggcatgagccactgtgcctggccattttttttttttttttttttgagacagagtcttgctctgtcacccaggctggggtgcaatggcacgatctcagctcacaacaacctctgcctcccaggttcaagcaattctcctgcctcagcctctcaagtaactgggactacaggcgcatgccaccacgcctagctaatttttgtatttttagtagaggcagggtttcaccatgttggccaggttggtcttgaactcctgacctcaaatgatccgctcccctctgcttcccaaagtgctgggattacaggcatgaaccactgcgccgggcctttttttttttttttttttttagatgtagtttcgctcttgttgcccaggctggagtgcaacggtgcgatctcagatcactgcaccctccacctcctgggttcaagtgatttttctgcatcacactcccgagtagctgggattacaggcatgggccaccatgcccagctaattttgtatttttagtagacacggggtttcgccatgttggtcaggctgatcttgaattcctgacctcaggtgatccacccgccttggccttccatagtgctgggatcacaggcgtgagccaccatgcccggcccatattttctaaattttctacagtaaacctttgtacctaataagaggca

SEQ ID NO: 19499 - DNA, 1352 bp, Homo sapiens
cttgtttgtgtccctgtgggtggacgtggttggtgattggcaggatcctggtatccgctaacaggtactggcccgcagccgtaacgaccttgggggggtgtgagaggggggaatgggtgaggtcaaggtggaggcttcttggggttgggtgggccgctgaggggagggcgtgggggaggggagggcgaggtgacgcggcgctgggcctttccgggacagtgggccttgttgacctgaggggggcgagggcggttggcgcgcgcgcgcgttgacggaaactaacggacgcctaaccgatcggcgattctgtcgagtttacttcgcggggaaggcggaaaagaggtagtttgtgtggtttctggaagcctttactttggaatcccagtgtgagaaaggtgccccttcttgtgtttcaatgggatttttatttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgtactctttctgactacaacatccagaaggagtcgaccctgcacctggtcctgcgtctgagaggtggtatgcagatcttcgtgaagaccctgaccggcaagaccatcaccctggaagtggagcccagtgacaccatcgaaaatgtgaaggccaagatccaggataaagaaggcatccctcccgaccagcagaggctcatctttgcaggcaagcagctggaagatggccgcactctttctgactacaacatccagaaggagtcgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcc

SEQ ID NO: 19500 - DNA, 3851 bp, Homo sapiens
ttgtgaggattgggatattccgactccttaagggcctggcgcacataaggtgtgaccttttcattcccgttgttatggaggtaggctctctaggaatctgggagtagtagctggggggcaagagcaaataaagagctcgagcttctgtggtctctggggagatgttcccgggaagcctgtctagagggcggagggcagctgttgagatggcgtggctccccggctcctgcgcccgcgtggctttcgcggcgggcgctgcggcccggtattggacagcctggcagggcagcgcggggccgaatccggctgccgtggctgaggctcatggatcactcttttgtggtagggccacatctgccagagcctggagtctgcgaaggccgggacccggttccccggcccacagtgggggtgtgcaaacccgagagaactgggtaagttggggtcggcttgcagtttggggtaccccgagggcggtgtacgtcggtaagattgtaacagtattactggaagacttattcgactgtcctgatgatacttgtaataggaagtgccgtcagaagcgataactgacgacgtctaatgtctatctgaccgcagtcgctgaaacctctacaacttagttgaccgtaactgccagagccctgccctgaattcctgtccttactccctctttaagattgcgtacccactgcagagtgctgaagacggggtagccacgaggtgagaggctctctggtgtagggtttaacatggaacgtagttttgtcacttgaatgcacggaaattggcgttttgacagttttctacgtttaggtgttttatacactttagggtaacgttatcatgtcattgcatagggtggaacttaaatagaaactggagatggctgcttcagccacagtcctaacctagaactgcatttaaagcaaactgataatgcagaaacaaactccttcgttaagaaatgtctccagtagcagggttagcttaagtttcaggtagggtctagatctgcggttggaacagtactggagggttgtgaggtgcttgactgctctgatgaaatcactaataggaagtgccgtcagaagcgataactgacgaagactactcctgtctgattgcagtcaagtcttcaccacttgctggttcccaggagtaaacttgtttgaacggtgacctaattgctatattcacctaggttgcaaattcgtgaagaatcagcatcatgtttggcagctgagtattggagccaggagcctgccatgaggtaagccttgctctatggggaggctagtggctgaccacgcctagctgtcaggtcgaatattggcaattggatttggttaacctaataccttgtaacagtgtagcctatcccagagatactgattttagtttccggtggcagtggagccagggtggattacctagaaagaggggctactctatttacctcttggctgtttagtctcgggcaaattacctgtctgctgagatgtagttttcctcagatgtgaaaaggaaaagtaatcttagctttgtgaagtttaaattgatatgactgaaatggagattacaactcccctgaggctgggcacagtggcctgtaatcccagcactttgggaggctaaggtgggtggatcacctgaggtcaggagttcaagaccagcctggctggccgacatggtgaaaccccatctctaccaaaaatacaaaaattagccgggtgtggtggcgtgtacttgtaatcccagctactttgggggctgagccaggagaatcgcttgaacccgggaggcggaggttgtagtgagtcgaaatcgtgccactgcactccagcctgggcaacagcgagactccatctcaaaaaaaaaaaaaaaattacaacctactgagaagctaattaagatttgtagtcctcaataatttacaaaaacttagaaaaattacctctaattaggtcttaaggggcttttgttaggatggacttaaatttgtaaagtcattaattgactgtcatcagaaatgcctgtcctgctctgcatctgcagtctctaaggtgtatgcgccttctccattcccccaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactttcataaattggttatgttggtgggcaaagttctttaagctggaaattgtaaattcctcctgaaatgttttttcatgcagttaccatgaactaatactacaataaaggatggtcttgggtgtcaattcttgaaaatgtgtatttgaagaaaaagtaaatttcgcctactgttgtcagatattagcagtccagatattcgctctagcttgtaaacttccctgtggtcagcctaagctcttaaccccctattctacagctttagactgaaggcaaaagctcaaagcatttaaggcctcctcaatttcggcccctgctgctctgtgctctgttccttggtgtagctttgttccagctcctgcagcattgcaccattcctaaccacaaccttaacagcatgtagggccccatactctaggccccatcttgctgtcttcctgtgttggaatcttgcctaccaaggcctgtcaagagggtcctcccccatactgtttgcccacaaggttcaagagtgattggctcccagtcttcctggactgaactacttggatctaggggttgcctgttatttagaagagatcccttaactggtagggccctttcagtaggacagtatttgggtaaggggagggtataagatgagaacctttgctaagttaggttcctttgggagcctccagtttgtttctccctctccccagccatcttgttggatctgccaagggattggactccttcattgtcctaggtttttaaggttttaaagcccaccttctgcagtcggttttctggaatgtgttggtggattacttaagagttatggggaaagagttcttacggcctgtctaggtcagtgaagtcatactggcaagtgacaagaaggaagccaggtttgtcacttaccctgcatgctaaggacatcagagcccacatagaagtct

SEQ ID NO: 19501 - DNA, 1035 bp, Homo sapiens
gtggaggtgtcaggaacagaggagggaggcccacgtgctagagcagagctcgcagggtggcaagtgggagaggggagctcaagagactcaggcaaagccagatgaggagtttgggttttgtttaaactacagcacagcccctcactaaaggatgttcagtgaggtccgtgtagtatccaatttacctttggaacgagctctccggtcttgacacctctgcctataatctctagacccataacgtgggctgacatgaacttctcagatgcaaattgctctgaccaggatgtcctggtcagccctctggggtggatggaggggctgctcctaccaccagcctggggacctcccacccctgcctcatccagagagcctcgcttgccacatgggcacgaaaggggccttccaggtctctgggctttagcagggctcacccactctggctggctctgattttgttttgaggaaaacaaagtccaggtgttgaagtggtctgaggaaggttacaccatgcaatggactgaatgttggtatctccccagaattcacgtgttgaaacctaatccccagggtgatggtatttagaggtggggcctttgggaggtgattaggccaggggggtggagctctcacaatgggattcctgctcctttgcccatttcctgccatgtgaggacacaggaaggtgactgtctgtaacccagaaaaaggtccttgccagtcaccaaccaggctggcacccagatctcagacttccagccttcagaagtgtgagagataaatttctactgtttgtaagccacccagtctacgataatttgttacagccacctgaatggaccacaacaacccaggtatgcaccccctggccccgcctctacccagatggaaagggaagatcagaaggcaggagttcccgcccctcctcctggccttgcctggtcctgtctcacagggtctcacagtggcccttacccactccctggcctgcctctctctctgagagggtgggtccttctccccacacaggctgtc

SEQ ID NO: 19502 - DNA, 1062 bp, Homo sapiens
tatcaggtgacctgcaattattattattttttattttcatcttttaagttcaggggtacatgtgcaggatgtgcaggatgtccaggtttgttacataggtaaatatgtgccatggtggtttgctgcacagatcatcccatcacctaggtattaataatagcccagcatccattagctgttcttcacgatgctctcccttctttcacccgccaccatcccacatgcccctgtgtgtgttgttccccgccatgtgtccatgtgttctcattattcagctcccacttgtaagtgagagcatgcagtatttcattttctatttctgcgttggtttgctgaggataatgttctgcagctccacccatgtccctgcaaaggacatgtctcattccttttcatggctgcatagtattccatggtgtatatgtaccacattttctttatccagtttatcattgatgggcttttaggttgattctttgtctttgctattgtgaatagtgctgcaatgaacatacgtgtgcgtgtatctttatactagaattagttatattcctttgggtatataccaagtaatgggattgctgggttaaatggtatttcaggttctagatctttgaggaatcaccacactgtcttccacactggttgaactaatttacactcctatcaacagtgtaaaagcattcctgtttctccataatcttgccagcatcttttcatttttttgaattatagccattctgactgttgtgagatggtgtctcattgtggttttgatttgcatttctcagatgatcagtgatgttgaagtttttttgtttgttggctgcatgtatgccttcttttgaaaagtgtctgtttgtgtcctttgaccactttctaatggggttgagtttttttttcttgtaaatttgtttaagttccttgtagatgctggatattagacctttgtcagatggatagagtgcaaaaattttctcccattctgtaggttgtcggtttactctgttgataggttcttaatgctgtgcagaagctctttagtttaattagatcccattt

SEQ ID NO: 19503 - DNA, 1223 bp, Homo sapiens
tggtgaggggaagggacagaagaacccttgagagaagggatgtgggtggcctccagggaagtagttggagaggccagcagagcatacgcggtgcagctcagggccatggcaggcaggcgtcactgaagaaggcccgtggccataccctgtagacccctgaggactgactgcagaggccacagtggctgagttttgtttttcggttttttttgttttgtttttttttttttgagatggagtctatctctgttgcccaggctggggtgcagtggcgcaatctcggctcactgcaacctccgcttcctgggttgaagcgattctcctgcctcggcgtcccaagtagctgggactacaggtgcgtgccactgtttttccttttttattaaactacttacgttgagataatcgtgtttcccctgtggttgtaacaaataacagagatcccatgtacccctttgcccaggtcctccgatggtgaccttctgcaacactgtggtacggcaccacggctgggatactgactacaatgcagaaagcacccagtgtctccatcgccttctccctcccacatcaacccaaccccagccacccaggaatcctgctccatttccataaatctgacatttcaagaatgttatgtgaagaaaatcatacaacctggaacctttgagattggcttttttcacctagaattctctggctattcatccaggttgttgcttggatcagtagtttgctcctttttattgctgactcgcattccatggtaagaggggacacctaggctgtttccagttttggtctgctacgaacaaagctgctataaccattcacatgtagtttttgtgtgagtgtatgttttcattccctggaataaatatccaggagtgcagttcctaggttgtaggtagttgcatgtttagtttttttaaaaactgccaaactgtctcacaccagcagtgtatgagtgatagatatacttactttgtgacgttgccagcatttggtgttgtcaccatttgttttttttagccattataaaataagatgttcataaatagcatgaacacctcttcatgctatttatcttctgtagaaagtcttctcgtgtcttttgctcatattctaattggattgttttgtgttttcactattgagtttgagggtctttatatagtctaaatactagtatatagtctagatattagtcctttgcaaaagga

SEQ ID NO: 19504 - DNA, 1051 bp, Homo sapiens
agcacacaacatggcaggtgtgtttgtttcctgtggccactgtaacaagttgccacaaacttagtggcttaaaacaacacatctttgttctctgatggctctggaggttgagagtccaaaatgagtaccacttagctaaggtccagatgtgagcagggcagcttccttctgaggtcccgggggagaatcccctctccactgtttgcaggctccagtggccacctgccttccttggctcgtggcctcttcctgtcaccactacagtctcttgctcctgtcatcacatttccttatcctctttgtcacattttcctctgcctccctcttagatcagaatctggatgactttttctttcattttttattttttagagattgggtttttttttgtcacctatcctggagtgcagtggcgcagtcatagctcactgcagccttgagctcctgggcccaagtgatcttcctacctgagcctttcgagtatctgggattacagatgctccggtgttgagctctggggagttcagcagggctaagtaggacttgtgggggtgctgctaggtgtgaggtgtaggcgtgagaaacggggaaaggaagatggggccaccagagactgccctgatggatgacatagtcaccacctaggtatcagcatcaccccacttccagagcatttgtgttttcagtgtgaagcaggatcagggaatgtcattgctggaaaggacctggaagagccagccccgtcctcagttgggggcgatggagaagtggcttttgctccggttggggcagtgtggagcctggcactgcagagctttgaaggtttccctgactcaagtcagcgtggaagctgagcccctcaatgtgtagagcgcagcagacacgacgcctggcctcctgttcactgattcaaccccagggggaggtggggagacggaaaagactccttgtccttgagcagggtcgtcttgttggtgagactggttttgtgtttctcacgtgtgaggtgcagacaggcatggtgttgcagaccaagaccttggggcacgaa

SEQ ID NO: 19505 - DNA, 1034 bp, Homo sapiens
acacaagtgtgagagtgctgggggttggaagactcatgtgtgccagcctccaggtacagctagcctgtttcctccatgccaaggccttgtctcccttgaggcagagtggtgtggtggagcgagtactggactaagtcagaaggcccaggcagttcaggcagccacagattaagtcacttccactctggccatggggtctttgtaagatgaggaggttatgtcagatgcgctctggtgaaagtatggaaaaaagcattggtgacgtgtggagctaaggaggtcaggcttgtcaccaggagctggccctgtccccagccatgtgtccccatcagcactgctgggaaagcagctcagaccccagggccggcagccgtgagggtatcttgcagtggctctttgggagcagcggctgctatttttagtaagctgcctaattggaggtcctggtggagcttaaccagctcaccttgtgctttgatccttctgtttggccttctctttttacgtggaaagagctgaagttcatgccctgaccaaagcagatttgtttttgcaggagacggaggcttttgctgttaaaaaaaactgccccttcccaggcccctgctctgtctcttaagtaatttccagtgggttgtcagcattgatgttggttccttcctaataagatctcccccttttatctgctatatcaggacatcaggggtgggggctgaaaagagtattgaaaaagatggaagcattactctctgcaggaaaacagattggttttaaaaatgctgtcctacatcctgcctcagatgatggcccttcgcacatgatttctctcacttttgatgccctcactttattttaagccgaagaaccaaaccttcgagtaaagcctctttgttcctttttagcagtgagatatctcctaggatgggagaccaggtgttttctcgggaacagtcatcatttagctttttcccaaaggaaaggaactctgtgtgtccctggtggctctgggaatggcgtgtgagcccatttcctca

SEQ ID NO: 19506 - DNA, 1030 bp, Homo sapiens
ccaggtgggtgtgggagcttgtccagggcgaagtgtctgcagtgttgcagtgaggcacggggtggcctcaccaccatgtctttctcagccctgccggcgtccaacacagcagaggtgctcagtaccccgttttctactgagtgactgaatgggtgaaaggcaactggattcctacactcttggtcttttccagggagtctgtgtcttggtgtttctgctgcttcactctttgtggtcgacttgtagaagcccctctgcccagaggacttgatcctgggcaggcagcagcaggaacacaccatgcctggcgtgggcagaacctgtgatcttgaaagagttgagcctccaccacttcagagagagggcagcaagagcgctctggagcctgccctccacagagcttggtgctttgagacctggacagtgcccaccagacagaatccacatagtgtttcctctcctccttccagaaccggatcttcctgagtccctcagtggctttgactggtgaaggctggccaggcctgctggagagatccgggatgcagagctgtttagtctgggaggcaggtcagtctcagaggatgggtgggtcagggctgaacacaaggaaaaaagacgccacacatggaaggaaatcaccactatgccatcataactgaccaactacattttcccaaccttggaaggacaaggtaggagtggcaggctagaaggataggtcttcaaacatcactgttgatgcaaagctcccataacaagttggatttctgagaagcagattgggaattcccagtgggagagaggcagatgagagcatccaagataacgacttctttcccagatgctggccttcctggaatgctggcagaggatctcagttcttaataattattttattgggtggggaagtctttggaagcagaaaataagccaaagaggaacttaatgtcatacccctttctcaaggaaagttttatctacaacacatttggtctattcttagcttctgctcctgtcctttggaaac

SEQ ID NO: 19507 - DNA, 1030 bp, Homo sapiens
aacttgaggctgcccttgcagacggctcctggccctgccctgcagtctcttcttccactgattggtatccctgcctgccctccccagctgagtccatcactagtggtatagctctcaagggtctgttttctatgaagacagggacagaaatgccagagaaaggtagctggggtataggtcaggtacagaatttttgaaaagaaatttgccagtagctgttctcaccctggcaaccaccattctactctctatgaatttgagtactttgggtgcttcacataagtggaatcatacagtatctatccttttgtgactggcttattgcacttagcatagtgttttcaagattcatccatagtatagcacataccagaatttctttcctttttatggctgaattatatggcagtgtatatacatactacattttgtttattcatctatctattggtggacactggagctgcttccatctgttggctattgtgaataatgctgccatggtacgtgggtgtacaaatatctgttcgagtccctgtgttcagttcctctgggtatatacctacaagtggaattgctggatgaaacagcaaatctataaagtccagtttaattttttgaagaagctccatactgctttccagagtggctgcaccacggttccagttactccatgacctcaccaacactgacagttttctgttttttaacttacctctaccctagtgaatgtgaactagcatctcattgtggctgatgtgatttgcattttcttttcttttcttttctttttttttttttttttttacttaagagacagggtctcactctgttgcccagactggagtgcagtggtgccatcacagctcactgcaacctcgaactcctgggctcaagggatcctccctgctcccaagtaactgggactataagagtacaccaccacatctggctatttattttttaatttttatttttagagatgaggtctcactatcttgcccaggttggtctcaaacttctggcccca

SEQ ID NO: 19508 - DNA, 1107 bp, Homo sapiens
gggaaagggcctgccccgcatgcatctgcagctggggagaggggtcagaaatgttttgcaggtagtgtctggggccaggtgctgtcagcctggggctcagcagaggggcagaccctgctctcccctggaatgtggcctgggaaaccagcctctggtgctccccagggccccaaggcaagggccagagaggcacagggagaatctgcacggtactcagctgcctttggattgacccttcggcttggtccattgttttcaagagcccttatcagccatcttagcacaagtagatggccatggtctctgagtagaggatgtgccccctccccttgcagaagacggtggcccatgatgcccagagctcctcagtccactgagccctgcctctctgccacagggtagaagacggaacatgcccgacactgtcctccctccttcccaaacattcgaggaaagttgttgaacccatcgtcttctgaccaccacccttgcttggtaggagagtggtgatgtgcactgagaagcagcaggcggcacgggtgtgccatcccgagcctgagctcgagtcccgcttcagctgtgcagtatcgtttgtagtcttgtgacagaagggggtagattatcaccccaaagggaaatctctaggccaaaacattaggccacttctcattcccctcccctagcccctggcaaccactcctctgctttttctctatgggttggccttttctgaacatttcaccaagatggagtcacacagtgtgtgtccttttgtgactggcttcattcacttagcgtgatgtttccaaggtttgctcatgttggagcatgtgtcaggatttcattctttttatggctgaataaaataatattccattgtatgaatattgcattttgtctatccatttgtccactgatggacatttgggctgtttccaccttttggctatcgcgaattatgctgctacgatatgatttgtgtatatgttcgagtacctgtcttctgttcttttgggtatatatccagtaatcaacttgttgggtcatatggaaactgtctgtaattttttgaggaactgctaaagttttccacaatagctacaccac

SEQ ID NO: 19509 - DNA, 1037 bp, Homo sapiens
ttctgtctcccacaatcttaatccagaaccatatgatcaagaatgtcaagggcctctgaagaaccctcgtggtacagtcgaggagacccagggcctagagacaggagcctggccaggggcaccttctgcactttctggctcacacctgtttctgctgttggccgggcagcacacagccgaggcttcctctgcccaggtggcttccctaggaaaccctcaccctttccacaggagctgggtcccagggagggtgtgggtaacaggtgggatggatgggagtcctgggtctccagggcaagctggggagtgtctggagcagggttggttctaggaccagcacatagaggtatgtgttgtaccatgtggtattaggagagggtgatgtttagcatttggactgcctccagcaggcagcttaagtcctgccagaagtcctcactccatcccaagcccctctcctgggtcacttctctgctctcttctgttgcatattcaggcttgccatacccatgcagcttgggtagacaagatcgttaatggaccaaggtaccgggtgcacatgccatctgggccctacgtgtgtggtggctcagtggcgtatccaaagccagaataagctgcctgacgctcttccccttcccctcgccctggttgtgggccacgttagttcgtgtccaacaggcaggttctcacgtggcataacctcgtgatccgccctcaccttcccacaagctgggatgctcagctgcgtgagggagtcaggtgtggcctatgcaccctggggacaagtgcttttgcctccttctcccattcctctgtctcctgccctcgctgacagcccccttcctctgctccctctcttgcctccctctgtttcccattataactcctcttcccagtaacctcatccctaggctctggagcgccattctgggtctgagctctctggtcacatcaaagctggtccctaagaaggtgcagacacttccaccaggcagctgggagctgggtgggttggggacagtcccacccagtct

SEQ ID NO: 19510 - DNA, 1067 bp, Homo sapiens
cgttcccccctcgttttgacttcttacaggtagagattagttcttcctgttactctagaggactgactacactttccacaggaaaatgtttggatgtcaccttgctgacatctcccgagtgttaccttccttccttctcctcctgtcttagaaggaagtggcatcatttacctacaccttgtgtcctgcgcttgtttaggatttgttgtcaagactgcgtactttttgttttgtgaaacaaacagctgcaggtgctgtgctcctcccgcctgtccctcttcctggcgctctcttgtcctttagtctttgttttgcttcttagtgtgttccattattcagttttgtttggtttatttctcctagaagctgtttggttaaagctgttttctgatgttattgtccatgttttctgtttacctggaagcagctacttactaaaaaaaaaaaaaaagaaaatttgttggatttttttaatgggaaaaaaaaataaagttgtacaaaggataaaagccaaagccatcaaggagctttctgtggttgttcctggccagaggtgtgacactcagaactgggaggcccgagtgttactaaccagtatttaatcggtttttttaagactgaagtggccgcctccccatcgggtgcctggcagaggctccatagagtcaaccaagaccttcaaagtgagcttgaagcccagtgccagcgccaggagctgattacacaccagattcagaccctgaagcgtagctatggggaggccaaggacacgatccggcaccacgaggctgagatccggagccttcaggcacggctcagcaatgcggccgctgagctagccatcaaggagcaggcgctggccaagctcaagggcgacctgaagcgggagcagggccgggtccgcgagcagctggaggagcggcaacacagcgaggcggcgctgagcagccagctgagggctagcgagcagaagctcaagagtgctgaggccctgctgctggagaagacgcaggagctacggggcctggagacacagcaggcgctgcagcgggaccggcagaaggagg

SEQ ID NO: 19511 - DNA, 1027 bp, Homo sapiens
aacaagcaggtctgttctgggtagagctgggtggggtgggggacagtggagctcccccttcccttgagctttggagggagcctcaagctgaccagcccatgctcagtccccagtctatcacaccagagtctccaggacagtgccagagtgtgcctgagcctaagctggcgacttcccagtagatggggtacagcctgcagtttcacgttgctcaggtttttggttgaaactggtagaatcaggcagaccctgagctagagcccatcccttcagcttccagtttctcagtaaagcctgtacctgcaccagctctggcaagggtaagccacagggagtcagcagggctgagtgtgatggcgacacttagcgtgaagagggagataagtgaagagccacagcactttccagtcagtactggaatgcccttcatttccagtcattctctgaaaagtgctcttccttttcttattcagaaattaaatcattgaggaaagtctgtaagaatgagatgggaaatactctgtcccctagttagtaagatctcattcatctctggacatacagatttaagctttagcaagattccacgtgaacagagtattggttttatgttttgaaaatcttactagatacgttggcgtgttcccacatccccataacactcacaggcctctgatgagggaatgccagaaatgggtctgagggcagcaggtgctgcggaggcactgtaggagcgaggccctgtcccgggacacccatcctgctggggattccctggagcatctggtcctcctcagctgaggctgtcaggtgaagaatctctggagctggatgtggacaaatccattcacaagacaagacacggggatgggcagtctccttgctcattgcactgttttccctggctggattcgtttgatcactgcttctctaaagagccctaagctcagaatttagctgcttaaacacatggtcttgtctctctgatttttttttcctttttcatccaagtaattttgtgaagggg

SEQ ID NO: 19512 - DNA, 1033 bp, Homo sapiens
caagtgactgagactatcccagaaaactatgcagctagtgaaactagagtacaactaagaacattttcagacctccagtgtggatgacctgggcataatctcacaaactgatgggactgcaaggattgtaaactgaaattgacatgaatatactctgttggatcagactaaaaaaaaaaaattgggcccggcacagtggctcacactggtaatcccagcactttgggaggccgaggtgggcagattatgacattaggagttcgagaccagcctggccaacatagtgaaaacccgtctctactaaaaatacaaaaattagccgggcgtagttgtgggcgcctgtaatcccagctactcaggaggctgaggcaggataatcacttgaacccgagaggcggaggttgccgtgagctgagatcgcgccattgcactccagcctgggcgacagagagagactctgtctcaaaaaaaaaaaaaaaaattgtgggttgctttaaaaacctatagaactggctgagcgtggtggctcatgcctgtaatcccagcactttgggaggccgaggcaggtggatcacctgaggtcgggagttcaagacaagcctggccaacgtggcaaaaccccgtctctaccaagaaaaaaaaaaaaaaaattagctggacttggtggtggcacacgcctgtaatcccagctactcaggaggctgaggcaggagaatcgcttgaacccgggaggcggaggttgcagtgagccaagattgcaccattacactccagcctgggtgacaagagcgaaaactccgtctcaaaagaaaacaaaaaccctatagaaccaacatagtgctttaaaatatggcatcattgcattggttcattccaacaacctaggaatattcaacagtgtgggcagactgttaagggcatatggtactatcagaattttttgtttgttttgagacagagtcaagctctgtcacccaggctggagtgcagtggtgtgagcttggctcactgcagcccccacctcccgggttca

SEQ ID NO: 19513 - DNA, 1064 bp, Homo sapiens
actcatgggagtcagcttctagcttggtggtgttgagcatacatccaaggcaggaagaggtggctggggaggagggaagagccaggaaacagagtgcaggtgtcttctgagggatggggagctagtgaaactgtcaggctggaagccagtcaagacacagtactggcgggtggagatgagggctgggaccatgtccggtccacccaggtggcgctctctggccctgggtcccttcctttcctataacttccccaatgatccttttattctttgtttacttcttgcacaggggtgagtaaggaggtaaaatctgaagtagtgaatttagcctttcttgttctcataaagaattcagagtttttgaaaaattatttaataaaagtaacaactgcaagtttagaagtacagagaaacgtaaaatggaaaatgtgttccttcccccaagtcccctcacctgtagtaactgctgttaatactttcctaagttccttctgggaattacatatgaatgtcatttcaaaaatttatacaaattgagatcacgtcgtacttgacttttttcactgattagtctcttttggccacctttccatactgcacataaagatctacctcattaaggcagctgcagaaaattgcatcttgtggatgcagcataactgatggaactggttttctgttgatggtcttctagctgtttttcttattcttgctattaccagcacagtgctggggttagcatctttgtgtaggagtaagtttatgatcagataaatcccagcagtagaattgctggggcatagggtacaaacattttttatagtgatagttatgctaaatttagagcactacgtctttttagctaactcttttccaaaattcagtccttgtagactagactgcttcagttaacctaaaatggcctataaatctgccacccagaaagcattaaacaaaaattaaagttgtagacggattctacaagtacccatggatatgaaatggaaacagggcctctcccttcactcctcccagctcccttgcaaagctgtgtaatattccac

SEQ ID NO: 19514 - DNA, 1094 bp, Homo sapiens
ggaactacaagacccccggggtctttctgagtgcaaggctgaaatggacaagggctcctcacgggggtggagggagccggagcctgccttgtgttccttttttgacttgtgacatttttcaaacacataattaaaaggacttatgctctgctgtctcaggacataatgctttttgtactgagaaattcatagtgggatggctctcagatagttgagaggaaaatgtttctctcagtctcttcagacacaaccacacctctgctcctcactccctccgccccagcacacacacccgccccagcacacacacccgctgaaccagtgtggaacaggaactcctctcccggctggcctcaagggcagtttgcctggcgggtcatccctgggctgtccttagttgccttttatttttggaggggggaggtggggggtgccttttggtgactcgaggaggttcagtcctgtggggagccgccctcaccagagcagggttgaaatccttctaggacaattttgagtgtctctcacagggctgagcgtcctctgaaagccaccaattacttggattactgggtggccggcatttatgctaagtacttttcaaacatcacacttaatccccacagtgagcccatgccgagggtgttctctcttcccggggtgaagaattagaggcttggcaggtgtcacccaccaacaggtttgcagtactagtggcagagagattggtgttctggggtgccttagccatgagacggagacagcaaggctgaagggggatggggctctacacctggccaggagcacttcctggagctagaggggagcagaggctgaggagttagctgtttccagacagggtggcaccctggagtgagcgggtggtgggggcgcgccaggatggtcctgtttccagatggggtctcaggctctttccccagggcctgactgatgcctccaacagtccgaaagtttgcctgggcccacactgagtctggtgacaaaatggttaggcacagttccagtggcttttacgctgaagaattcagaacattctctcagaaaatgaggccttttgtcatctaacccaaaga

SEQ ID NO: 19515 - DNA, 1050 bp, Homo sapiens
catattccggccttctgggaaatgtagttccccgtcaccgcgaagtgcctctttatctgggggctcgcgacagcgtctagaggagccgagaactacaagtcccagtgtgtttcgccgcagagcctgccggttccgctgcagctacgtagcagtatccccttggatccggcctcccgcccagtgcctttggtcgccggctgccgcacccgagcctgtaactgacctggcgtccctgcccttgcctggcggcggtggggctagaggccgggggccgcgggtcgtagctataagcagcttcccgcgcagcctcctgcggacttggacttggcccgggtcacacacgcccagggccccacacgcccagggccccacgccctcttctgaaattcgctttactctgggggcggtgcgcgacgagcactgcctagagcttcccgcccccgcggcgcccaggctctttagctcggccaaagacccctcctccactcattttttccttcattcattctctcattcactctcgagtattttctgaaccagactgtgcgctgagggtacggtagggaacaacacagagtcccccgccctcgcttcctcctgactgagataaaagacaaaatgtgaataaagggttataatatggatgagtactgtggtggaaaaaacggggtgggtcaaatggtacggaaggatgctgtcttagaatgtgcaggggaggtgccagatgtgccaagtgtgagggcagggcaaacaaggcaagacgaatggtatgtacaaaggcctggagacaggacgggcacctaaggaacagagaaaagaccggtgagctgtggagtagtgatggagggggtcaaatggagaagagtttagacgatcgggtcccagaagaaccccttttgtaggccgggtgtggtggctcatgcctgtaatcccagcactttgggaggccgaggtgggcggatcaccagaggtcggcagttcgagaccagcgtgactaacacggtgaaaccccgtctctattaaaaatacaaaaaatagccgggtgtggtg

SEQ ID NO: 19516 - DNA, 1057 bp, Homo sapiens
gcttctcttcctgcccctgcccccctccattctccatacagtcctcgctctgctcagggtcaggcccaccccaggtggggggcagccctcgctgcagactgaatggtggcccctccctgctgaccacacagctgggttttcagaggctttcctgggacgtggccctcgggatctagaaactggaaaggaatcttctagtttcccacccctccccctcttgacaggcaagccggtatattcggggcccaggagcaaggaaaagtggccttttgcgtgacacagaagtggacacatcattctgatctcagggcaggctcagccccataactctggcaaaagctctcacaagcaaaagccttggagaggaggagaatgtatcaaggtgagatccaggccccagaagccaactgtggagtgggcaaaataggacctttcccaccagcctagcatccctctggcttctgtggagataaagggaactcaggggtactggagctgcctttctcttccactagactgtggggctctcataggcagggaccctgtcttactcctctttgttttatttttgagacagggtcttgctgtgtggcccaggctggagtgccttggcacaaacacagctcacttcagcctcaacctccagggctcaagcgatcctccagcatcagtctcctgagtagctgggatcacaggcgcccgacaccacacgtagctaattttaaatttttttttttttctagagacaggggtcttgccatggctggtcttgaagtcctgggctcaagcgatcctccctctttggcctcccaaagtgctgggattacaggagtgagtcactgcacccagccttactcctctttagactcccaagcctagaccaattgctttcaaattcttgcccgtgacctatagtaagaaatacatcgtaggtaactacacaggtcacactgtatatagctgaaacaaaagtttactgaaataactcccttactgtgtctgctggtctgtaatcctttttgttcttgtgtatttgttttttttttaattactgatt

SEQ ID NO: 19517 - DNA, 1051 bp, Homo sapiens
ccattccactctgcccagaaccttcgtctggcttcccagagggcccaagtccttgtcttcagaggtcctggctggggagccttagagcatggtcttccctcactccaggcttctcgggtctccctattggggactgaccgtgggagcagtgagccactgtgcaccagggcagcccggctcctcggggggtggcccaagcagtcagggcggcaggcttgatgggccagggcctggggactctgccatggtggaccattgtgcccttgcctggcttgccaggaaagtggagtgcgtgtgctcacccttgcttctgaggggccttcctgaggcagaggctgtccctggacacccagtgctgttgaggcagctggggacactcagaccatggtggacaaagacttgaagtctcgtttcagccctgcacaaggtgtgaccttggctccagcactgctccctctgggcctgtctctttctcagcagaatctgggactggccacatcatctccaggggttctagcattggacgcctgaaagtggacaacatggcagtgtgagggggctctttgtggtggggtggtcagaatggccctccatgtggggggctctttgtctccccagggcagtccttaaccaccagccagcctccccaggcacccgtgccgggcagtggggtgtgtaaaggcctggcacacacagacaggagttccgatctcaactccatcctcatgagctctgtgaccttggtgagtcccttttctgtgtagcctttaactctcatctggaacgcaggatatgcatagtcctgacatcaggacgttaccatgagtagtaagtgaaactcccacttcaggtccttcgcctggtgtccagggcatgggaggagctaatacgtggcctctgctgcttgtgttgttattggtggtggtgtttgagatgtccttagagatgttggccaaagtttccagttccccaccctcccaagcccgtggggaaattgtgcttcctggtggtttttgggtgggggggccgggggagggtcatgtgaccagtt

SEQ ID NO: 19518 - DNA, 1048 bp, Homo sapiens
gtagagacgggtttttgccatgttgcccaggctggtctcaaactcctaagctcaggcaatccacctgcctcagcttcccaaagtgctgggatcataggtgtgagccaccgtgcaggccagactctagctttcattctgagtgagctggagactgcaagaggcaggctccaagctgacttactatctcacaggctccctcaggagttgagggggccagacagagcttgaaggggagtagaaggctcctggaggctctggcagacctcagaagctgcagccacatcgaccaagctgaccccacccaccatctccaaggaatgggttaatgggcaccccaggcctctcaggtctctgcctctgccttgctcctcctccttcctcctgctgccaccctctgatggtgcttcagcctgtgccatttttctgggtcctctccaagtgtatattgaccctgaggtggcagcaggaggggaggcaggccccctccccaggaggagacccccttgatgaactctgagaagctggttgcttagcaagcccttttttctccaacaatacttgtgctaatcagcctagattgaatgagcaaggaattggcttttgcaccttcctgtcctctcttctcatatatatatatacacacacacacacacatatatatatatgtacatttttttcccttagagacagagtctcactatgttgcccaatctggattcaaagtcctaggctcaagcaatcctcctaccttagcttcctgagtagctggaactacaggtgtgtgctagagtgcctggctagggactccattctagaatcatggaatcttaggggtcccctgggttgcatcttgactcagtgagtgagtgggttactttttcacatccctccttgtacacctcctgtgactcctggcagctcactctctttctagcgactgagggcctctggacaaggtgagggggacagagcaatggtccagaagttagaagactgtggtcccagtcacaggctgggcaccataagtggacaccataactgacccatc

SEQ ID NO: 19519 - DNA, 1033 bp, Homo sapiens
ctggaatctgtgaagggtactcactgagcgacctggaatctgtgaagggtactcactgagcgacctggaatctgtgaagggtactcactgagcgacctcaggtgagtcttccgacatgtcctggccctgatgttctccatgctccaccccacccccattttatccaggggaactgttggctcaaagaagagaaaacttgggcttggtcaggcttatgggaggagggcttggtttaacttcattgttccatgcattcactcactcattcattgaacaagtgcttatggaatgtataccaggaaccattccaaatacggaagatacaccaaggaacaaacagacaaaaatacctaccagatacctaaatatgtaaattacatggtatattagaaggtagggaacagcattccaggcagatggatcaacaagtgcaaaggtcctaaggtgagagtgtgcctgctgaattcaggaactgcaaggggcaatgtgagtggggcaacaggctgggactgagggcaggagttggtggggacctgattgtgtgggctgtcatcaaccacctgggggactttctcctcctcatcactcagaaactgaggaggggagggaagacattccagccaggttggtgatccccagcgggcatttgggcttttccgttgccaccttaatggtatacacaatgcgcatctcctggttcactcagcagcctcaggactgagtgaccctggtccccaagacagatattgaagacagagactaagcagtctgacattttaaatatggggagccccgagtggggcggggctgcccaggaccttagggattcacttctggtagggagggctgctaccaggcttcagggaatgccagaaaaaaggtgcccgaggcccacctggcatgtaatgatgggcaggattggctgtaggatgtatagagactttagtatgggcagggttgggggttagtaggtggagaagggagattgggacatcattgagcagcaaaacccaagtgtgacaggtggtcggtg

SEQ ID NO: 19520 - DNA, 1048 bp, Homo sapiens
cctgctccccacccttcccacacacccactcagctgcaggcctggccattaaatgtgggtgtctgacccataggttggaccatgagaccctagtggctgagggaggcctgggtgaggctctgggaggcaggactgaaaccagcaagggattcactgctgctcatgccctatggcacaacccccttatttatggggctgccttcccttccccagacctcgagtttccgttttcaagaacctttttcttcctatcttccttagggcccccagggcctagcacacagcagtcactcacagtgtcctgtatttgtccagctaaatggagtgaatgaatcagtggtgaatgaatgaaaagggaaagtttctcaattggaagcatctagcccttgtggttttttttaaacctttttgaaatatatattgtaaaatagcattcacagaaaagctgaaaaaaaaagagaaaaataaggttattgacagtcttagagggctctgacaatgttagtattttgatgtagttcttcccagtccttttcgactcggtggttggtttgttttttaaagactttgtcgtcattctctatattcagatgtatatcctgcttgctttgccggcataatgtgagccttttcctgttttgtaaccaatgcttcataaacaccatggttaatgtcttcaggcttttccaatcaagtggatgtaccataatttacttaatattccccttttgtccaacattctggatgttcctgatgaatgatgtagtggatatattttgtatagcttttcttgatacttaaaatgatttgctcaaaatgccactgctgatgccgaaggctccgactgcctgcagtgggagaaacggcttctctagttttccttggataaatgggacactatttttccttccccacaatctagaaccttccatcagagccgaaaagagccttggcaatgaatcacctatctgacctccctcctttgacagaagaggaagccagagcccagagaggggaagcgagtcccaaggtcacacagcagttgctg

SEQ ID NO: 19521 - DNA, 1071 bp, Homo sapiens
ttgtttctagtcaagcactggctagttggggggtatcagacaaaggggtccacatagaaggcaaactgaagggcatgttcaagtgctgttcacgcctgcctttagcccccaacgaccaaaagggggcttggcatagcgagaccctctctctacaattttttttttttaatttagccaggcatggtggtgggtgcctgtggtcccagctactccagaagctgaggtgggaggaacacctgagcccgggaggtcaaggctgccatgagccaagattgtaccactgcactccagcctgggtgaaagagcgagaccttgtctcaaaaaaataaaaagttggggggatgttaaggaggttccagttaattgtggctgattctaaattgggaggcctaacaaatggtacttatcctcccgtgggagcagaccagggctaaccaaggccgctgggaatgggggtcatggagacagagccccttttccctcccacccacctgaaggctccaagaacttccactgcagaggtgtcagggacggacctggtgcagaccagtgggcccacacctgctttcctatgtgcgggtcagagcgtgtaggtgtattacatgcctgcctgtgtgtctgcgtgtgagctccttggacacacacaggggcacatatctgtgcttgcatgtttgtacatctaagtgtgtgcgtatctgtgtgttctgacaccagctcgcgacaccagctcgccctccacaaagctatttccaggccccattccccaagaacagccatctctctctcctttcccacctgacatggggcagggaggagagaatctgtttgaaatctcaacaggacatgggctttgcacctccagagagcaggacttgcttgtgtggacagaggtgacatagaaaggtttcagtttcatccaaatagaaacttactttttttttttttcgagacggagtcttgctctgttgcctaagctggagtgcaatggcatgatctcagctcactgcaacctctgcctcccgggttcaagcaattgtcctgcctcagcctcccaagtagctgggattacag

SEQ ID NO: 19522 - DNA, 1207 bp, Homo sapiens
gctgattttttttgtatttttagtagagtcggggtttcaccatgttggtcaggctggtctcaaactcctgacctcaagtgatccacctgcctcagcctcccaaagtgctgggaatacaggcgtgagccaccgtgcccagcccaaagatgcacttcctctcattcagaagtgatttagaagtggcctgggctgctccaggaggtagtgagtgccccatcttaggtgggtaggtgtgcaagcagatgcccaacctgtgccttcctctcttttgtggtcccttctaagcgcaaagtgcctagggctgtgtatctcctggcggcagttctgaggtggccctattttgccaacccagcctggttggagggactgacagggcttctgcccctaggtgtcccctgaacttggcccacaaaaggcctgaggaatataggggactgtgattgtgtgtgtggtgtgtgatgtgtgacagtggacttgtttgtgtatctgtgttatgtgtgtgcatctgtgtatggtgtgtgtacttgtgcgggtggggcttcaagggttgagtgtggatatccatgttgtgagtgtgcattgcgcatggccctggaggatggggggacatttctgggctgtgtgggtattgactgtgaactgtgagtatgtgcacttgggccagtggaggtgtttgtggctagaacgtgtctggagggaactgtgctgagacccccaccgcctctgtcctggttcattccttcccaccccaggctcctctcatggcccctgcccccaggtcagacctgggaggctctcagtcatcccaaactctgaccattcatgctctccctcccagagaccttggcacctgccagcactgctcttgactttgtccttgctctgggataagagcaggcccagcagatggccgagaggtcccaaggaacagaggaacaggcggggaggaggcccagtcactgcttagcttctctgtaggagatgtagaaggaagtgggtctttgtgtttctgcagcatctggaccagatggagagacctttctggagatggcatgcacacttccagataggagctggaacatttccagaaatggaatgtttttagaaatgagacatggtgtttctggagacaggatgaggacgtttctagagaagagatgaaaagcatttctggaggaggggcatttctgaagatgaaatgagaaca

SEQ ID NO: 19523 - DNA, 1037 bp, Homo sapiens
ggtgaaggcgggggcagaggactccagggaccagcaggaaactgggagaagccatgggcttgaaatgagcctggggtccacccctccgtgagcttctcaaggtggctctgaggtgctggggtaaacgtagcaactgccagcttgcagctgtgtgtgtctgagctcaggcaacccaggcaccacacaggaagctgctgtactcactggaccctgatgggctgcagagggccagagagtctacttgtgggcccttctgggtgtcagtcttctccatctggggaatgggttggcttggtgggagttttcaggcctgcattaccttcaaagggctcatgctgcaagcatgggctgtcctccctgtttttataagtacacgggccccagccttacccagacagcccagcacgctgcccgtagtatcctggggaagggcagcagctgtcatcagtgttatttctgaggtgtgttttcctggcaaccaggaaatttctgtcagtgggaacagcctgcccaaggcctcctccacccctggggaagacaagttgtatgacaagggagacagaggcaattcaaagtgaagaacgggagtgaggccgcctcctccgtgcatattgctcacacactggggcagccacgtgcccagtaaaggctctcttgaaaaccgtggagataggagccaagctctgcaaggccctgactagctcacctgacccctggcatctagaagctcacagcctattcttggtggaggtgtggctatggctgccctccaaggaggggaagacagagatggctggacaggatgggacaagccagcccccaggagctggggaagcgaaggtgggtgcaaatgaaaacgcagaatcccatttgcagtccatttgcttagcagccctgaccaggagggagagaaagaagagggcagagcagggagagatggggagggataaggatacagagagagaatctggcagccaggggtcagggagcctttggccgtaaggcctgggatgcctgctgcttactgaggctgtggc

SEQ ID NO: 19524 - DNA, 2950 bp, Homo sapiens
gggcacggtgggtggctcacgcctgtaattccagcactttgggaggccgaggcggacagatcacgaggtcaggagttcgagaccagcctgaccaacatggtgaaaccctgtcttactaaaaatacaaaaattagccgggcgtgatggtgcgcacctgtaatcccagctactcaggaggctgaggcaggagaatctcttgaacgcaggaggtggaggttgcagtgagccgagattgtgccactgcactccagcctgggtgacaggttgagactccgtctcaaaaaaaaaaaaaaaaaaaaaaaaggaaaactgtagaggcacataaacaggtcagagttcctgtctaggcttccctagaggtctttacttttactagtgtaatctgagtctttgactctgtttgtgggcatttacatacacaattaaatctttactgtgtacctactgtgtgctgaaccccgaggatttcagaccttgagccctgctgttaggggctctcacagtcctggtggggagactgacccctaagctgataaatgacccctccatggggagtgggcctgtaaagtgatgatggaagagggtccacaaaggagggaactaactgtgggttggcaggacagggaatggggatcggggaaccttgaagggacatggagtgtgaactgggactccacagagatcacaagtttttaggtagaagaaaggagagggaaaagcttggaagagcatattctaaggaaagggaggtatttgggatgtgctgactttggagtccctgtgggatggccatgatcaacccactgtagggagccaccaaggggttctggatcttggatgccaggccatggagtttctgttttattctctaagtcagggagccattgaaggcttttgtgtgtgtgtgtgtgtgtgtgtgtttgtttttgtttttgttttttttgagacagggtctgttgcccaggctggagtgcagtggcacgatctcggctcaccgcaacctcagcctcctgagtagctgggattacaggcacgtgccaccacgcctggctatttttgtattttttggtaaagacagggtttcaccatgttggccaggctggtctcaaactcctgacctcaggtgatccacccgccttggcctcccagagtgctggattataggcatgaccaaccacacccagccctgaaggcttttaagcagggaggtaagtgagctggtccagcatgtgtttttaaaaactctttctccagcagagcttacagaagggtgagcagggtgtacccggggggcttgtgtggagtccaggccaggcagggacggtggccagcgggtggaggaagccgtgaggatgtggccggaggagaggggcaggcttgggccctgcgaggtgggtgctgccctgggccatgattgggcatgagtggggagccgagccataccatggccggggacagggactgggtgcgttgttcccacatgagcgttgtggagttggcatgcattgggaggcatccctctgggctcagcccctgcctaccaggccaccattgcccctttcttggccagcagatcctccaccagcacctgtcagccccgagcactggaaacggcagccggcggggcctttgtgcttcaggattccttctccagggacacgggtgatagccaagcccggcagatgcccccgggggtgccaccgtgcccccactcgccatctccgatgctcagctgctccccagaatgaaagaccttgtcacaaagggaggcagggagaggatgcgcttccgtgccgcagcccatctgggagccaacgttattttcctgattgaaggaaacatctgttcagtcctctttcagagcgaggcaggcagcggactgggtcggtctggctctgggcaggaggtagagaacctgggctgagcccagagcccctgccctaaggggtttaagaggagctaccaccgttctctgtccctccctaaactgggagttcaggagctcctgccatccccttaagaagcctcggtcactgcctcccccaaggatgggggctgctggggcaaaagccatcgcctgtcccagagcaccatatgtgttttctttttttttcttttcttttcttttttttttttttttttgagatggagtttcgcttttgttgcccaggctggagtgcaatggtgctatctcggctcaccacaacctccgcctcccaggttcaagcaattctcctgcctcagcctcccaagtagctgggattacaggcatgcaccaccacgcccggctaattttgtatttttagtagagaaggggtttctccatgttggtcaggctggtcttgaactcccgaccttgggtgatccgcctgcctcggcctcccaaagtgctgggattacaggcatgagccaccacgcccagccccatgtgttttctgaggactccttcattatttcacacacacactagagccatgtttttgaaagatacggctgccaaacaaactgcatttattacataatgattaattcatcgcccccatttcttattaatcaaagacatccataactgcctatctgagctttgagttggggagagaaccagcggggcctcaagctgacagccttcccacccagatcaggggcactggtagatttgtgtcagtggagcctcatttggggtaaatgcacagtacccctgaggtttctagaagaaatggagacagctcacagacccccacacgtcacctccccaaacccctggggctgcctgggatgttttataaccccttctccagccagccctgagctcaggctggctgcttggcacttagccactggctgactagtggcctgtcagaggatgtggaagatggggtgggccagtccctgttgctggaggctgcaattagtggcagcctgggaaggagactgaagcctgggctgaggt

SEQ ID NO: 19525 - DNA, 1051 bp, Homo sapiens
aggaagatagggcaagggtgcaaggcccgtctctgcacagagggtgggagagaggagtaactacatagtaggtgcttggtaagcactttcccagtctacattcattgggtccattttatagatcaggaaaactgaggctctgagagggctggtaatttggattagagaaggcccacctgtctggagcggctttatgaacacaggctttggagtgcgacagcggggaggtcaggagaggagaggaaatagccatagctgtacccccacaacattcacaccatgcctccccctgaaggctttgcctgacgtttggactgtttagagggctcctctgagctcccacagcctgagccttcctgtcacggtgctgccaccctggtttagcaggcctgtttacacactgtcaccccaagagcctggcagcaccccagtgctggactgtgagccctccacacagggcccagcgcatggtgtgtaatacagctctatggaatgctgagtggctgattaagtgggctctagcttctggcagctttgctccctgggtggatggggcgggagtgatgcagaaaggagaggtgtaggcctagagttaggagggcagggagagcactgggcactggaaccacttggcagggtgagttggcattccctgtttgccacgaccttggggtcaccctcaccaacttgccccagctgggcctgactgaagggcagggggcctggacattggagcccagggagggcagagggtggtagactcaggagagagctctttgtttgggggcatttctccagcagagacccttagtccctccaaggagcatgtcctcctccatcagtcagtgtcctagccagcaggggtgcgtccccccagatccttccctgcttatcctatcctgggcccagccatgctttctcccatggggtcatgtcatcctgaccctcagatttggctgggtcgccccagggctctctgacaaagcccagctcctcccctggcacccagcatccctcagacccggcctacaccctgtcaagcccgccttct

SEQ ID NO: 19526 - DNA, 1034 bp, Homo sapiens
cgagcaggagagggtggggtggtgtgagtctgagggaggtctcagatgggaggggagggcggagtggggcagggaccagtgagggccagagtggagactgggcaggagggcatagcacacacatggacatgcttcccaatgagccctggcccagtcaactcccagctccaggaaccccccacagccctttgctggggtgcacaccgtccagagcactgacttccccaacgagccaggtggaaatgtcccagggaggaccccggggcctgaggagcctactgaatcctcaacaaagaagggaagagaggcctaggccacagcaggcccagaattattgtgttatgctctggatcttggggaatgtgtaatccccacaccgtatctatggcaactctccattaaccagaatttggttctacaaattcctgttcccattcattctagaaaactcagagctgttggtctttttaaaaaaactcgctgaaaaaaaaaaaaagatactaaagaatgtaaagaagaaaatgaagtcagctccagcccctctgctgagaacacactgatgttagtactttcgtgcatttccacccagtttgtttaagaaaattgggattgtgttgaatgcctgcttttgcatcctgccttttccattgtgcttcagatcatgagcatttggcaggtcagaaaaaaaatgtctttggaagctgggctgtggggactggggtttggaaggcttgctgtgtgctgtgatccttcaggggtcatcgccctccctaagcctcagcctttgcctctctgcagggagagactgaaggacatttctcaggctcccgccaagagtctcagtgttttccttgcaatggtggccttgttattccagccttgctactcacaggtgggcctggtgatgtttgtggcagggtgggcacagggctggcactgccaccaagtacgtagttgagccggtaagctcagaaacgtgggctcactccagccttgagcactttcccatctcgtgatcctgggcaaatgacttt

SEQ ID NO: 19527 - DNA, 1015 bp, Homo sapiens
gcctggatgccccccagcaccctttcatgagggggagagaggagaggagcaaggcccaggccacctggtattcagaaggctgaagtgacagtgtcaggcagtttggggggcagatgaagccgtggcaaagggtggccaggaggccagagcagcactcacagatgaggtgggattggggccacctgcatgtgtggggaaggagcccccaggactcggtgtgtgggcctctggctgacaaaggccactctgcagaaaggaaattagaaagaagaaatgatttcttggctcatgtcttcacgaacaagggagaaagttgctggcgtggtctcctcacagaagagccagggtatctgaggggagccctttctctgccagctgggtcaccctcagggctggaggtgctggatgccagagtagaagtggatggatgggggtgtccccccaaaaggagagggagacaaggtgaggctgtgccttttaagccttctgcgcaggcctccttgggacagcccgggtcggatctcagactgcagcatgtggggctgggagccagctcccccgaggcacgggggctcaagaggtctgagcagcatgctgaggtcagggctggaggagcagaaagtagtagggagccactgatggcgtcataatgaaggagcgacatgacaagcttgtgaggggccacacagggcagaggctagggacgaggagatcccgctggcagctgggcatggaatttctggtgggtagtgaaacagccagacctaggacctgtggcagtgaggatggggagggggccagatgggcacacttcaggcaggggaaccccaggacttgggggcctcctcagagaggccttacagaaggactggggcagcaagcaaggcctgtggggcgaggaggcctaaggacaccatggatgcactggagccaagccattaaggaccctgcaccccggccagaggcctcactcaggatggctgcagtggagactgaagagatgggtcgggtggag

SEQ ID NO: 19528 - DNA, 1044 bp, Homo sapiens
tgttaatgatatccacaggacactcagcaggaaatgagagtgatctgggactaataaaagccgaaatgtaatttgtgcagatatacgaggcgcagccttcagagtggtcctgggtttgcacattctgggctcataaacatgcgcctggggagggcagggagcgggcgctgtgccctcggcctgggcacaggcccgcctgggctgccctgtggcagtctggccagggcaggagcgtgaggctgcccacctggcagggagctgccagaccagaaccaagtgccgtccccagctcctctgggttggcgcgtcgcagcaggaacctcctgtaatgttttatccaagctgccaggggtaggattgaagtgggtcagaagggtgggcacgctgcttgttagggatgcctgcgacaaatccagggagaggagctggagcagagggaaagcggctttgataagccggtgggcaggggctcgcctcgtgggaaagtggccggcccccacactgggctgactctcctgcatttgtgggccagggcaagctgactccagagagcaggagaggtggtcccaggactgggctgacgggcttctgggggccatctggctgccctgggcttgccctgctctcaggcagatggaggccctctgtcgccttccctgcatccatccccagacactaaatgaggaaggcacttgtggtggggtccgggccaaggaagaagggtaaatggagcagcacccccagctctcccccactccccacctttctgcctcttccctgtgcccctccccgactctgcgtgcctctccctctctgtgcccctctccccctctctttgtcccttcctgaccccttcaacaacctggaatctttgtagcctgaggcaagccaccccttccttttggagcatttgggaaccagcactggaaagtcccctatcccctcctgggggcctgggccacacaggccgagctgagcccctttcttcctgcctccgggccagcatggttctgggtaaatcccaaaccctctgggactcggcca

SEQ ID NO: 19529 - DNA, 1068 bp, Homo sapiens
ctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctg

SEQ ID NO: 19530 - DNA, 1032 bp, Homo sapiens
agattgaggcaggaaagggactgggaatgctgcaaatggagacatacacctcagagactgagttggcacagaatccatgggacttgatgatgagggagagggaggtgacaagcctgatgcccagcttccccatgaaggggagaagtagggtgtggacgtgcaaatggagtattagctgctgctgcagagctactggcccttccaggcccagcttcatgtctccagcaccagcccttcattagttctcaaaagggcgtgagttggctgcaggctctgctgggagcaggatgatctagggtggccccagctgtgccagcttgtctttgctccatcaatctctcatcctccagcaggctggcctgggtgcgtcctcatggcagccccagggctttgagagagtggaggtcacagggccactcacagcctaggtcctggactttaccacgttctgttagccaaagcaggtcccaagtccagcacagagaagtgcaggccacctggggtgagctgcagagccacaccacaaaggacctgggtgcggggaggggactgggctgctctgccaggccatctacacacacggcagttccctttggccacacggcagtagaggcagctgtggacatacaaagtgtagatagctgggctcaggatcgagtctcgcccaccatcagcaggcgagggctcatcagagccctggaagggacaaaatagcagggttgtgttcaccatggaacagctggctgaggaggagggtggacccctgggaaactgaggaacagctgccagagaaggcgagggagaacaagtgagctcgagagtgaaggcggggaggacgggcgcttggggtgcagggagggcccccagcgtgactctgccagccaggcggtggggggggcgggggggtgggagtgagagggcactgagggagtgggctggtcaggctgatctgatgtctggccagggaggagccccaggcctctgtgtcaggcactgggactgcagggcaccagggctgcccactggctgcca

SEQ ID NO: 19531 - DNA, 1057 bp, Homo sapiens
ggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaatctgcagcccgtggattccgaccagattcagctgggagccgggccaggctttaggttggggaatgggaatgaagggaggggctgggggggggggcatgaatggagtcagggagtcggcctttcacagaacaggaaacctcccccgcccctgtgccccctctccagtgtggcggcaggtcgggagggaggaggcttctttgctgtgagatgaccaggggccgggatg

SEQ ID NO: 19532 - DNA, 1033 bp, Homo sapiens
atcctgcatataaactggtaagaagtggtgctttctcttttcctggtacagatcctagcccagaggtgatgagcagtaaagctgcagattggaagggaggggctggtgaaaacagtggtgcggtgcagatggggagggattctagtagtaggcatcttagacttcagttggtgttggtggcaatggtatctgtacccctctaagaccgcatggcaagaatacaattttatatttaatagtgatcagcatggatgttggtgcgtcacaaacattgactcagcagtgtctaaacctgggcatttagaacaaggcctcacagaatcttctggaagtgcttcaaactcctttccaaacctagtcgtcagttgttttttgtaaccttcccatgttaggcctgggtggatcccctcttaaggctgtactttagggaaatattttttatcttcatatcactttatctgtcattcattctcctattccctgttggctgcatggggcagattaaaacagactctgattggactaattagaataattacttcaaggctaattgcttacttgctgctatctttaatcactgctacgtggtctgtggtgtggtggccacatgcccagagacccaggcctaggccagccgtctggaaatgactgtatcacccaggcacggggcatgcactggtgagctcagcctgtgactcttccagttaacggttggtattgggtggagtgggcacccctgtcagttctgggatagtctgatcttgttcagctggttgaaagcaaaatttagctttctggcttaaaatagttgggaaagtagggcagataggtcctgggccacatctcttgtgtggactcttctgattccactggagggggaggaaccacaggatgaagtcagggctgtgcaccgtcaggaggagctctgggccaggggggttggctgcccttgctgctgccagagcctgacaaggcagagggcagtaaaagaaaggaagctaacagtgaaccatggtgttaatcatgaagctca

SEQ ID NO: 19533 - DNA, 1036 bp, Homo sapiens
ctttggttgtctgtctactcttcatggtcacatgttctgtgtttcttttcagtggatatgctgctgatgaaatcactcactgcatacggcctcaggacatcaaggagcgccgagcagtcatcatcctcaggaagtaagtgccttgatgtctgaccttctgcctcacctgcaggcctgtctggagatgtagctctgggtccacttagaactcagctcctatgtatcagtggcatggcagagtggagagcagaactgttaagttctctttttatttgaatcctgtgaggataaagttgttttgttgttttatcagaaaattaagtactctatttagggagtttaggactgagcaaaagcatatacgcccaatatttgtgggtataatcttgagacaagatttgggcaacattcttccaaacctcaccccaccccttagcctctattcctcacctccttcgttcttatttgttacacgtactcttggtgattatttttagactgtgcctttagcagcctgctttaaaaatgcctgggttttcactgctggaaggaacagggagtgaagagaggagacaagggtgggaggttaggatgtagtattcggcagaatcatggcttgtggctcttctctggggagggaatcagggatgtgctacttaacatcaacaaacctggcttcaccagcatttatttctttcacggggtgagtggaagaagccatagcctcacagacattggatcaagacaagccttgccccactgtccacccatcttgctcaggctggaatgcagtggtgccatcatagctcactgcatcctcaaagtcctggactcaagctctcttcctgcttcagcctccccagtagctgggaatagaggcaagtgccaccatacctggttcacgcctaccttttgaatagagtcccagagaagataggtgattgcccagagtcatagaagtcagtgagcagagcaaaacaagcacgtaaacttaggcttgacccataaaacttgctgtctgtcgtcttcttccttc

SEQ ID NO: 19534 - DNA, 1081 bp, Homo sapiens
tcggggccttgagttggtgactagggcacccaatcccttggtttttaggaggccctcaggattgcactgtgagacttgtattcttgagattggtactctccagttaaccagataaagtggcacaaagcagtatatatagcccatttatttgcttttggtcaagtggaactcagctcagagtggtctgaagctgggaaatgcagctggagatccctttgccaagtggtaacctaagctggtgtgtgctaggctctgtgctagtacccggaatggggtttgtatgggttcctattctcttttgtcctttgggaaaaggcagacatttagcatctcaacaggaactggtcaaagaaggctttccagataagtgccacctgaaggtagtcaaggatgcttggaccttagccagcatagaatgaggctcaggggcaaagatagttcagtcagaagagatgctctttacagaggcttggagtccaggaactctgttctggaacacagaatagataaggagtggaggacttgatacaccggcctaagacagcaaaagcttcacgctgtgcagagaaatgttaagcgcgctggggagccgtggaggcatgtgagcagtggggtgagggatttgcatgtgagagattgtaggaagcgaagctcaatagcttacttggtcattagatccacagagttcgaggagtcaggagaccttccatgagagcagagcaatctgaatgtgaggctgagtggatggatgagcagtggaaggaagtggaggtctcattctggacctcgttcctcagcagtggggtgaggggtggctagctcttagtttctctgaccagggcttggtgttgctcctttctccatgatttgtgtctcctgtggttagatttagcttacatttgttccctggttcagtaagtctgtgtccacgtgcatacaccctgcccttttggcagcctgactgttctgatgtgtctgtggcctgcccaaggaatatgggtacaatgggatcaccaggaaggtgacaaacttgggcttctgccctggctctgccactcctctccaaatgcagtcttatctg

SEQ ID NO: 19535 - DNA, 1067 bp, Homo sapiens
atgtcccaaagactgggatggtcactggcacttagtgggcaagaacctccgataccagggcctctgccaggactacccttcgttgaggaccactgagctgaagtgacccatcccaaggatgagacgaggtacagcggtaaagccaggcgcctcctgccagcctctcagataacgtcctacctccctttccttgcaggccacggatcctggagatggacaaggaagagaaccggcgctcggtgctgctgcccacacaccggcggaggggtagcttcagctctgagaactactggcgcaagtcatacgagtcctcagaggactgctctgaggcagcaggcagccctgcccgaaaggtgaagatgcggcggcactgagtctacccgccgccctcctgggaactctggctcatccttacgtagttgcccctccttttgttttgagggttttgtttttgttcattggggggtttttgttttttgttttttgttttttttgattctatatatttttccttggttttgttgcctgttagggctgaagaatagaattggccaggacctaggttctcatattcttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggct

SEQ ID NO: 19536 - DNA, 1044 bp, Homo sapiens
acatcaagacctgctgaagcagatccgctcataccctcatcggaagttgaaggggcatgatttgtgtcctggtgagatggagcacatccaggatcaggccagccaggcatccactacctctaaccctgatgagtctgccgacacagacctttacacctgcagaccagcctacaccccaaaacttatcaaagcaaagtccaccaagtgttttgacaagaagttgaagaccttggaggagctctgtgacactgaatatttcacccagaccctggctcagctcagccacattgaacacatgttcagaggagacctgtgttacctcctgaccagtcagattgatagagcacttctaaaacaacagcatataacaaactttctctttgaagactttgtggaggtcgatgacaggatggtggagaaacaagaaagcataccctctaagcccagtcaagacaggccgccttccagttctctagaagaatgcccaattcctaaagtgttaattagtgttggttcttacaagtccagtgtggagtctgtgttgatcaagatggagcaggaactgggagatgaggagtacaaggaagtggaagtgactgagttgagcagtttcgacccccaggaaaacttggactacctggatatggatatgaaagggagtatcagcagtggtgaaagtattgaagttttgggcacggagaaatccacctccgtgctttctaaatctgacagccaggcaagcctcacagtaccattgagcccccaggtggtccggagcaaagcagtcagccacaggaccatcagcgaggacagtattgaagtcctcagtacctgcccctctgaggccctcatccctgatgactttaaggccagctacccaagtgccattaatgaagaagaatcatatccagatggcaatgaaggagccatccgcttccaggcaagcatcagtcctccagaactgggtgagacagaggaaggcagcatagaaaacaccccatcacaaatagactcctcctgctgtattgggaaggagagcgatgg

SEQ ID NO: 19537 - DNA, 1035 bp, Homo sapiens
ggcagccaggagaacgtgttatcacttgaatgttacccattcattatctggtttcccgatacactgtgttgttttctttctttatttttttattctttttattttttagatagagtcttgcactctcgcctaggctggagtgcagtggcaccatttcggctcatggcaagctctgcctcctgggttcacgccattctcctgcctcagcctcccgagtagctgggactacaggcacccaccaccatgcctggctaattttttgtgtttttagtagagatggggtttcactgggttagccaggatggtctcgatctgacctcgtgatctgcccgccgcagcctcccaaagtgctgggattacaggtgtgagccaccacgcccagccccctttggttttaagagcagctgatcttgcctgctggctgccaagtcttctcaccttctctgaatctcaggcttgctatgtagaaatgagaccatgtgtatgtgtgtgtgtgtgtgtgtgtgtgtgtgtgtgtgtgtgtgtgtatgaaatctggactccttctatgactgcctttcctgtttgttctgacccatgaagcaggtatggttctttcgtgttcctcaagcgtatcaaatgttactgagtgcttcctatcgctaagtgctgggctgcactgtctagcctctaggagcttggactctaatcaggaagccaaggcacataccctaactccacagagtgccaagaggctggcacggtgcaattactgcacctttggaaccaaccctgggagcgaggtcagtgcaggttcctaaggcaggaagacctgagctgagccttgtcctagatctttggagaacattaatgccaggccacgatgctgaacctcagcatcagtcccagaaagttcaggactggatgctggctgcagacacagtctccatggtgagcaagagccaagtatctagagccaaaagtatccacgctcatctggggagtggttaactggcatcactcacagcctgtttgctggcagccgaaaggtggatg

SEQ ID NO: 19538 - DNA, 1053 bp, Homo sapiens
ccagcctgggcgacggagcgagactccgtctcaaaaaaaaaaaaaaaagaaaagaaagaaagaaacaaactacctgataactttgtcttaatgtctgagtgatttctgagggctaaggaattcttttggtgtgatttgaaaataggattcaaattctaagatacagtttccttatttctccaagagagataaaattctttattatctattttgtgaaagtttatattcaatgaggtgttaaagtcatctgtgcatagtgtattttctgtaactacagggcctagtcaaatagtggggcttaagaaaaagagagctaggaggtttgcttcatcctactaaagtcacctcttttattttgacaaaactcttcacagttacacgatggctaaaacatttttctctacatttgctagtacctgtagtaaaatgtaattgcatttctttcattgtgttttggttttcagacatccagtagcatcgtttttccacttattctttcgagtcagtgcaatcatcgtctatcttctctgtgggttgctcagcagcagctttattacctgtatggtgacaattatcttgttgttgtcgtgtgacttttgggcagtgaaggtaattttgattgtttttattttaaaattatatttaatatgaaaatgatgtataaaaatatgagttagcattttgcattattgttaatcttttgttacttcaaacctcatctgtgttgaagtgctagatatatcaaattgcatgtagtttttttttttttttttttttttttcattttttccctttgacaatacaagatgagacatgcaggttactgtgctgctgatttttctgtgccatattctaacctacatcagctttaaagtcaaataaacaaacaaaagtgactagcaaccatagaccctacaatgttgcttctaatccataccatgggttttgcttcaggcttacctgtaggtgtgttgtatataatttctagataaggccccagtgtagtttgtccacaaatacctaaaaaatacctaccttttgaaaaggctccta

SEQ ID NO: 19539 - DNA, 1089 bp, Homo sapiens
cactttgggaggtcgaggtgggcatatcagttgaggccaggagtttgagaccagccaggccaacacggtgaaaccctgtctttactaaaaatacaaaaaattagctgggcatggtcatgagcgcctgtagtcccagctactcaggtggctgaggcacgagaattgcttgaacgcaggaggcagaggttgtagtgagctgagatcacgccactggattccagcctgggtaaaagaacaaggctccatctcgaagtaaaaaaaaaaaaggctgggcgaggtggcttacacctataatcccagagctttgggaggccgaggcgggcagatcaggagttcaagaccagcctggccaacatggtgaaaccctgtctctactgaaaatacaaaaattagctgggcgtggtgatatgcgcttctaattccagctacttgggaggctgaggcatgagaatcgcttgaacccaggagacagagggtgcagtgagccaagatggcgccactatactccaggctgggtgatagagtgagactctgtctcaaaaaaaaaaaaaaaaagcctgtaatcccaccactttgggaggccccaggcgtgcagatcacctgaggtcgggagttcaagaccagcctgaccaacatggagaaacgctctctctgctaaaaatgcaaaattagccgggcatggtggcgcatgcctgtgatctcagctactcgggaggctgagacaggagaattgcttgatcctgggaggcggaggttgcggtgagccgagatcatgccattgcactccagcctgggcaacaagagcagaactccgtctcaaaaacaaacaaacaaaaaaatgatttagtgttgtcagatacatcttatacttcattttactacagattagtgctagcactaaaaataaaagagaaatttaaaattaagaaaattccatccattaactgaagttttcctgtatttcaaacaagactgtccttatctgagttcagtaatggaaagccttgttcctccactcttatccttcccatagaatacttttctgaaaatctttttttttcctaagttaattaacagggtgaaagtctc

SEQ ID NO: 19540 - DNA, 1051 bp, Homo sapiens
aaaaaaaattaatatgtgggaactcagtgttaaaaaggaatttttgtgtattgcttttttcttttttttggagacagtctctctctgtcactcaggctggagtgcgattttggcttactgcagcctccgcctcctgggttcaagcaagcatatctggctaatttttgttttttgtttttttttgagatggagtttcgctcttgttgcccaggctggagtgcaatggcatgatctcggctcacagcaacctccccctcccaggttcaagtgattgtcctgcctcagcctcccgagtagctggggttacaggcatgtgccaccacacccggctaattttgtatttttagtagagacagggtttctccttgttggtcaggctggtctcgaactcctgacctcaggtgatctgcccaccttggcctcccaaagtgctgggattacaggtgtgaaccaccgcacttggcctaatttttgtgtttttagtagagatagggtttcaccgtgttggccaggctggtcttgaacttctgaactccagtgatctgcctgcctcagcttcccaaagtcctggtattacaggcatgagctactacacctggcctgtattgcctttttatagtatacgtatcttgtctcttttgttttcgtgtgttagagcctcttaaagcaggggatagatattcatgtttcactgaatctaaggtgctgtcagtccaggcttacattattttacgtcaccaagaaagaagaaaacactgctaattatactgtggcactgtgccttcttgtcacttagtgatcctattctgcaggttttgatgctgacgctttctccatctcttgtgtttgtcactggaatttaagcaccttctgccagagtcagaaggaacattctggtactaggatgctcgttgccttgaaatttttgccatctatacttttttttttttttgagacggagtctcactctgtcgcccaggctggagtgcagtggcgcaatctcagcttactgcaagctccgcctcccgggttcacgccattctcctaggcc

SEQ ID NO: 19541 - DNA, 1857 bp, Homo sapiens
tttcaatgctgataaagttcaatttatctttttttttttttttttttgagacggagtctcagtctgttgcccaggcttgagtgcagtgtctcagctcactgcaacctctgcctcccgggtacaagcgagtctcctgcctcagcctcctgagtagctgggattacaggtgcccgccaccacacccggctaattttttgtattttttagtagagatggagtttcaccatgttggccaggctggtctcgaactcttgacctcgtgatccgcctgccttggcctccccaatcaatttatcttttttgtttgttattgcctctgcttctgatgtcatgtctaagaatccattggccaggtgcagtggctcacttctgtaatctcagcacttcgggaggctgaggcagaaggatcacttgagcccaggaatttgagaccagccagggcaatatagtgagacctcgtttttaagaaaaaaaaaaacattaactggatgtggtggcatttgtctgtggttctagctacttgggtggctgaggtgggaggattgcttgagcccaagaggtcaaggctacagtgagccgtgattgcaccactgcctggctaatttttgtgtttttagtagagacggggtttcgccatgttggccagactggtctccaactcctgacctcaagtgatcttgacctcaaatgatcatcccaaagtattgggattacaggcatgagccaccgcacccagccaccatagctttttaatttttttgagatggagtttcactcttgttgcccgggctgcacaatcttggctcactgcaacctctgcctcccaggctcaagcaattctattgcctcagcctcccaagtagctgggattacaggtgtgcaccacttcacctggctaattagtagagatggggtttcactatgttggtcaggctggtgaccaacctgatctcctgacctcaggtgatccacccacctctgactcccaaagtgctgggattacagacgtgagccaccatgcaggcctctatagcttttttttttcttttgagacggagtttcgctcttgttgcccaggctggggtacaatggcacgatctcagctcaccctgcaacctccacctctcgggttcaagtgattctcctgcctcagtcttctgactagctgggattacaggcatgcgccaccacgcctatctaattttgtatttttagtagagatggggtttctccatgttggtcaggctggtcttgaactccagacctcaggtgatctgcctgcctcggcatcccaaagtgttgggattattggcatgatccaccatgcccggccctctgtagcttttcaatagtcttttttttttttttttttgagacagagtcttgctctgttgcccaggctggagtgcagtggtgcaatcttggctcactgcaccctccgcctcctgggtttaagcaattctctgcctcacctcctgagtagctgggattgcaggcacctgccaccatgcccagctaatttttaatttttgtatttttagtagagatggggtttcaccatcttggccaggccagtcttgaactcctgacctcgtgatccacccacctcagtctcccaaagtgctgggattacaggcgtgagtcaccacgcccagccttaatagtcttcaagttgggtattgtcacacctccaactttgttcttcaatattgtgttggctattttgggtcttttgcctctccatataaacttcagaatcagttttttgaaatacacaaaataacttgttgggatttagattgggatttgcattaaatctgtagatcagattggggagaactggcatcttgacaatat

SEQ ID NO: 19542 - DNA, 1029 bp, Homo sapiens
agtactagtgggattcagtataatccttaattttttgtttgtttttagtaattcttgtaagcagttagttaagaacttgttttgaatttttggtgctggtaagccaagactgcgagaacttgttggattcttaaacacttgaacatttaccatgcattaggtgctgaggatggaaaaaagagtaagactcagcatggcccccaggaatcaggagtggctgtattaatatcagacaaatcaaggcaaataattttgccatggttgaagaaggtcttttcctaatgataaaggggtcagttcttcaagaggacaaaacagttctaaacatttataaactaaatgacagtgtttcaaagtatatgaagcaaacactgataactgcaaggagaaatagatatatccataatgatagtgattccattattcttctcttagtaattgatagaataaggagactgaaaatcattaaggatgcgggagacttgaacaaccccttcagcctgctggatctgactgacagtcatagcacaccatccagagagagcagaatgtagttcttttttagtataaacacaaagatagatcatattcttgtgagccataaaataagccccaaattgataattatgcaagccatacaaaatatattctctgaccacagtggaattaagaataattctaataacagaagtatctttggaaatgtcctgaatatttagtaactaaataacatacttttagataacccataggtcaaagaagaagtcaaaagtgaaattaaaaagtatttagaaccaaatgaaaatgaagacacaggccaggcgcggtggctcatgcctgtattcccaacactttgggatgccaaggccggcagattacctaaggtcaggagttcaagaccagcctggccaatatgatgatgaaaccccatctctacaaaaaatacaaaattagccgagcgtggtggcacaccctgtaatcccagctactcgggaggctgagacaggagaatcacttgatccagaggtg

SEQ ID NO: 19543 - DNA, 1019 bp, Homo sapiens
acttccctgcagtcacatagtgacaagctggacatgtctgactaaaacctgtgctttttccactgtgttcttgggtctcttggacttagtaatggggatttaaggaggaggaaggcagtgagatagagccagggttcaggatttggggctgggagggtgttaataaagcgtttggctcaggacctcaaagccttttgcttgtgtgtgcatttctcacagcctcacgtgcccaggctgttggtgctggggggtaggcctggggctgccgctccctttcagaatccttgcctggcctcagaggggcttgtgtctaggaacctcagcagaaccctgcaagggctggctgggaccattggtgagatgagccatgcccgggagcatggaagaatatatgttcctcttcagtcctgtaagcacatgggctgtgatgaggaacgcgttggcagtctttagatgaacgctgcttctttggaacttgctgggtgttagcttttggtgtggcctttgggagtggactctggactgcagacactgaactacaggtttcccatctggaaatgagttcataggactggatgatctctatgttctttctaatatttctttactcgtgggatctttatgtttcattcataattttaattataatgtttctatgtttatgttttgactcaagtagtgatcactacaggccgtctttgggaatgcagtagaattttagtttcatagatcctaaatatttgattgtttttatacatttgatgattggacaccctacatagaatacttttttaaggtactagcaaataatatatgaagggaaaagaaagcattcttcctgtagcatctcgaatataaagattttgttatttagtattagattttaaaaattattttgtatcctctgatttcttatagatgaaaatatgcctactaaaaaacaatgaaaatactttttcagaatataagcactatatataatatttgaaaatattatccataaaagttagaagaaaata

SEQ ID NO: 19544 - DNA, 1026 bp, Homo sapiens
aacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatgagggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaaccttgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgc

SEQ ID NO: 19545 - DNA, 1029 bp, Homo sapiens
ctgggtgacagaatgagactcttgtctcaaataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacaga

SEQ ID NO: 19546 - DNA, 1049 bp, Homo sapiens
cccttgctgggtacccttgctgggggacctgggccatcccagtttgtgcagagcggccggaggcagttaggagcccacgttcagtccaaggccgtccactgagccccgtgtgactctgacagagctgggggtgtccatgtcctctctggacctcagttcctgtaaaaaggcccgttggccagatcggccgccgggctgctcacaggtgcacgggctgcacgtaactccgtgggaagaagccaacgcgcccgcaggaccggccccgccaccagtgggggtctgggcgctccaggacctcaatgatgtcgccacggcggaagctgagctgcgaggggtcctgggctgagaagtcaaactgggcctgggcaaagcaggccccaggtgactgcaagaagaggaggtggttagtagggtgccttcagaagccctgcaacccaccctccctcagaggcacccaagagaagtgatttgccacaggtgaggaggggtctcgggcagcaccggagttgaactttaagtccagatcaatggtagtgccaccactgggcctcctgctgcccacacccctgcctgtctgctgtgcagatgctgcatctacatagaacacggctttcccagccgcccagctgggacaatagggctggtgggtcaggggacctgagtcctggtccttagggtgggattttggttaggtccctgcttctcttgggatcttatttacccgactctgcagcagccatggtagcttttgactccaggccacaaagccatgagaatgggccttataaactgtaaagtgacgtgcagctaagagtcgtgtttattgctcttgcccttggtcagccgttgagggagagaattgtcactttgagctctcaggcctgggctccactcctatctatgccccatgtgtgatgttgggtaggtccctgccctttgtggaactcagtttccccacctgtgaatggcagcaggacaggagctctctgcagcacatctgcctggcaccgtgactattgcacccagcaccctggccctgcctgcccacc

SEQ ID NO: 19547 - DNA, 1163 bp, Homo sapiens
gcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaacttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcaaggaggccgttaagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttctgggctgttcgctcctgcttggcatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggattgcagtggcgcgatctcggctcctagcaacatctgcctcccgggctcaagcgagtctcccgcctaagccctcccgagtagccggggcttaaaggcgcacacgccactccaggctttttttttttttttttttttttttttggcagaaacggggtgtcagcatgttagccaggctggtctcc

SEQ ID NO: 19548 - DNA, 1611 bp, Homo sapiens
tgttctgggatggggcctgagcaaaaatgtttccaaaattctccaaaagctgggcgtgatggcttgcacccattatcccagctactcaggaggctgagaggggagaattgcttgagaccagaagtttgaggccagtctgggcaacatagcaggaccctgtctcaaaaaaaaaaaaaaaaaaaaaaagttccttaacaatttggatgtgtggccaggtttgagaactgctgctttaggccatttcatgtctttttagcatcaaggcagggataagtaatcaaaaaggatggagtctgggaggatagagggaccaaaggccagtggtatgagctcagagaagcctcgtaaaggggattatatagcgtccagtggttttcggctggtggcaccccgtgggaaagctctgaggggctcctctccttgtctagaaccacaggagagagactcagctcctggagctgagtgacttaaaatttagctgtgaagtccatgggcctgtctaatggtggcacagctttgtaacagggtcttctgggcctttcaggacccaagtcccacacttggagcctgatttgtgcttaatacctatttgctgtataatgtgattgcagagaagacttgacaaataaagagaacatttaaaacatggtctttgcaactaatctggtccttcctgtgctttaaaaaagaaaaaaattcccactgtccctgctttaaagagaaacaagaaattacaaaagaaaacacagactttcttgatttaaaagaatactggtagaagaaaatagcaagtcgcacaagaaattactatgtaatctgactgcaaagtgttgggtagattttaacatttgaagaaaaatgtttctttaagcaaatgaaaccctaatttctcccttccccctccaaaaaaccccctagattttcatttagctattttgtctttgaacaaaaatcttgctttttcccccttctttgcctttgccctctggtaatcagtagtttccaaagactgtgtaaaagtcaggtctaccaaaacagaatatatgccacatggtgtttgcaggctgtgtttcttttttgtgctaggtcccatggagattgtttggaatgcctgttttaatggtcatcagagaaaattcggaaagtatgcctaagtaggatggaccaaactagcacttgacctatagccttaggacctatacgtcaagtcctagttcggtctgtaatcaatgttaatattttgatttattttctctctctctctctcttttttttttttttgacacggggtcttgctgtcacccaggctggaatgcaatggtgccatcttggctcactgcaactgccgcctcccgggttcaagtgattctcctgcctccacctcccgagtagctgggactacaggcatgtgccaccatgcctggctaatgttttgtatttttagtagagacaggtttttgcatgttgaccaggctggtctcaaattcttgacttcaggtgatccacccgccttggcctcccaaagtgctgggattacaggtgtgagccaccacacccagcccggtttattttctctaggtaaattgtgtttgtttagtcctcaggggtctt

SEQ ID NO: 19549 - DNA, 2658 bp, Homo sapiens
ggatggtctcaatctcctgaccttgtgatctgcccgcctcggcctcccaaagtgctgggtttacaggcatgagccacagcgcccggctgagtattgggtctttaggggtcaaaacttttgatctttgcttgcagtttttgtttttttctcttttacactctccctgttccctgattaaatgaaggccaggcttgcctagttccagggaaaaggccaagggtgcctagagcaaggtggatgggactttgttcgcagatgggccttgagagagcgacccctcgctcctaaatgcccggaggaagggacggacttctttatctttaccatgggtattctgccttactgctttggcctgtggcgtttcttcacttgcttttcctcattttgcttggaatgtgctttgcctgttgcatacccacctcgtctgcccccttgcacactccatggctggcctaaaagcccagtctgctgtcctgtgccctttagacttccactgtaggattatgtttccacactccctgtggactgtgccactggagctctctgcagacagggactgtgtcaggttgacctccatccttcagcaccagcccagtgcctggcaggtagcaggaaagcagaagctgaggaaggacttgctgcacaagtggatgccaggagctctggttcttcccttcttgaatctgctaccttatgatgggagggacacagggctgtgctggatttgtgcacgatgctttggacagcccatgggagagggccaggaggaaggaaacccagactgagtggatagcaggctggatgggggcattgacagtgggggaagcattaaaggccatttatagccttccaaatgtgaagctggaggggcctggaagagagtcacagaaaggaagggacagacgcgggacggtgcagggtccctgccctccagcttcacaggtcttggtaatgggctcttacacgggttggtggcggaaggacacaggtggacctgggctggtggtcactcctgggctgctcttggccctggcatctgagacctgttggccaaaggctttgatgtggctctggtattttttcttttttttgagaatggaactttttttttttttaatgaaatgctcttttgaataggcaatacagtcacgtttctaaaatgaaaatatattaaaatatattttaagaaattttgcccctcactcctgatctcatctctgtcctccctcctccctggtaaccacctgtagcagtttgaatacccttctagtttttcttaatgcaagtacagcaaacacaaattgtgtattattatttctcccttttcagtaaatgaaagatagcattctgtgtgtactgttcttcatcttgtgctttttttaacttattgtagagatttttccatatcagtgcatggagaatggttgtcattctctttcagctgtgttgcactgtgaagttgtccctgtttgaatactcacccctgaggaaaggcacctggctgtttccagcttgtttcatgacatgccggcgacagttgtctcacgtgcacatcgtttcccacattgcagtggtcctgcagggtggcatcccgcaggcacattgctgagtcaaagaggaaacacagttgtaattttgacagattttgcccagttgccctctacagggcttgttccatgttgcactcccactggcggtgttgatgcctgattccccactgactcgtcaacacaaggtgtagtcaaatgcttggagttctgccagcctgacacttgtaaataatatctcagtatagttttaatttgtatttttctgaagaggagctgatcatgttgtcatatgtttaaggaccatttatagttttctgtggacagttcttcgatttttctcttgggttattggttttttctcaatttctgaaggtgttttttatatttttggaaggttagttcattgtcttatgagttataaatttttttcaggctaggaattattctgatctaggcagagtctttaaataattctattcctccccttccctctgccccatctccttatgtttgaagatttggacagtggctttgggacagaaccacacctttggcttccttccaggatttaagttaattggccttagacacattttcggtatgaacttatgatagcgtggatgtgtttgaggtgtatcaggatgggctacatgatgtgagaacagccaaccctctcacctcagtggcctaacagcagaggctcatttctttttcatggggcatgtccagtgtatgtagtcaggagacttcactcatagtcactcatgaacctaggatgatggtggcacaagctttttgttttgtcttattttgttttgttaacagttttattggctgggagtggtggctcacacctgtaatcccaggactttgggaggccaaggtgggtgtatcacttgaggtcaggagttcgagaccagcctggccaacgtggtgaaacccatctctactaaaaatacaaaaatcagccaggcatggtggcgcatccctgtagtcccagctacttgggaggctgaggcaggagaattgcttgaacccaggaggcagaggttgcaatgagctgagattgtgccactgcactccagcctgagcaacagagcaagactcc

SEQ ID NO: 19550 - DNA, 1048 bp, Homo sapiens
tcttaggacattctcaaccatttgagaccattttactgggaaggaggtggccaaagtcctcttttttttctttacttttcttttcttttttttttttttgagacagggtctcactctatcgcccaggctggagtgcagtggcgcaatcttggctcactacaacctccacctctcgggctcaagcagttctcgtgcctcagcctcctgagtaagctgggattacaggtgtgtaccaccacactcaggtaattttttgtatttttagtagagacagggttttgccatgttgcccaggctggtcttgaactcctgagctcaggcagtctacctgcctgggcctcccaaagtgctaggattacaggtgtgagccaccatgcccagccaaagtctttgtcagtggtgaatcctagctctgcccacttctctgagaagctgaagagtcatacctgctctacatcaaatggaacaacaaattgaagggcctggtggtccctggcacattgtaaggctcctgaacattaagtacctctgaacattactattgattttgacacatatttgccctttaagctgggaaatattcattaaaaattaaagtgttctttttctttgtgaggcccatcgtatctttgccagcagtgaatgttgcatcatgaatgaaaaacctaattacatcaaatgtgcaggtcaccgtgcaaaagtttttatccctggtcctttcacagcctttgcagaatatgcctgcttttagctgaagccctgttctgtggcttcagatagagtcagattccttgacatatttgaggatggagagaaggcctccttggccagagcagatgtatgggttattaccagggtgaaattttatgagctgtcccctttttgtgtgtggaaaaatcatacaaagtgctttttcctattttctcacttaacagcaatcaatacagataacttctgtaactttctccccacgtaacaagcaagcagtcagttttgcaggacaccagctaggtgtccttcagttcaactctgatatttacctggagat

SEQ ID NO: 19551 - DNA, 1041 bp, Homo sapiens
caacaggtgtttctccattttcacagtgctattccagccacagtgtggaccccacactcagagagacaggtggccctagtggcctttgggggacagggtgaggatggaggtggggattgtagaaattatatcttctggctgctaaaacaaaagtgcagatccctagtaacactatgtcagcatagcagaaaacttctttttaaaggaagttgtctgtagtttgacagacctcagtcaacccttacttagtcagtgttctgttaccagaccatttactaacatttcctgcttttgcaggtttcgatttgacattgtaccgccaccactagcattttgagaaatgtgttaaatgagagatttgcatattaaagtcagatttcctgcttctaggaattctgaattattaccgagcttggagcaggttaacatattcttgtcccatatgtagttgtcatttttcttcttagtttgaactgttttgcttaagcaaaggttgtgaccttggttaaaccacttgaaaacaatttaaccttaatctccagaagcctcaatgcagggttaaattgcaccaaaacaaatgaagattgccctttaagaagtgaaattgttttatttctctcaaggatcctcttaccaacccccagagaggctctctttggattgagttggtcccaacctgccttgacttcctctgtccctgtgactgtggctgtggctttgatgcaggccaaggggagctgccattctctttatgtgcttttcatggtcattattctcaagaagccagaggatgctaagcaaggagctgaaacagcttcatgttccatgaacaatttgtggaactttgcagatgcaggggttggaacagtggggatgcaggagcctggtttgatccacccctcctcctcataccgagtccagggcctgtagccataggtcctgctgggctaaatgatactgctgcagttccagctgtgatgtttttggttccctcagaccttacgcttgagctgcatgttcagggtcagaatgtggtcagtg

SEQ ID NO: 19552 - DNA, 1079 bp, Homo sapiens
tgcaggcacaagccaccacactcagccaggaatacctaattaaaccattatttaattgggccccagatcttaaggagctcctctgattgtcagaatatgggattgttctcagaattgaaacagtgctatcaaggctgggcgcggtggctcatgcctataatcccagcactttgggaggccgaggctggtggatcacttgaggtcaggagtttgagaccagcctgaccaacatggtgaaacccctgtctctaccaaaaatacaaaaaattagtcgggtgtggtggtggatgcttgtaatcccagctacccaggaagctgaggcaggagattgcttgaagcttgggaggcagaggttgcagtgagctgagatcgcaccactgtactccagcctgggcaacagagcaagactctgtctttaaaaaaaaaaaaaagaaacagtgctatcaaaattgctgattgggaggccggctgcagtggcccatgcctgtaatcctagcacttcgagaggctgaagcaggtgaattgcttgagcttaggagtttgagaccagcctggacaacacaacaaaaccccatcgctacaaaaaaaaaaaaaattaaccaggcatggtggtgtgcacctgtagtcccagctactttgtggggctgaggtgggaggaatcgcctgagctcaggaagtccaggctgcagtgaaccaagattgtgccactgcattctagcctgggtgacaaagcgagaccctttctcaaaagaaaaaaaatattggggattgggttattgattaaatgattgacattggcgtgtgccatagaaaatggatcaatacaatatttacctgttttttaaggatcctttgtagtataggtaaacaaactattgtttataaactgtcaataagtgtagaaggtttctcgatgctttaaggttgagtttagcaacagtatgatacatagttgttagtttttgtttagtgatacaaggcagttcctcattttgacagttgccttttcttttttccctaaatcactagctctcaagcttttaaatctcccaaaatgtcccaaatcctgggccacacct

SEQ ID NO: 19553 - DNA, 2082 bp, Homo sapiens
gactagttgtctcggaggctcaggggagcattccctggtcttctgagattgacacatcactgccaccttctgctgcctttctctaggcctcagagctcagccaggctgtcacaagcttgctgggtgccaccctaatgtctggtgccagggctgaaggtagccctcactccagggagtttacagtgcatgagagactcatagttaaataatagttatggtgctgtatgataagtgatctaaaagtcaagggggggattccagaggagtcagagaaggcaggaagagaaaataagagggccggagaggcccagaagatgccaggcatttgggaagcagttgggaatcagtgtggctgggggtaaacacgggagcagagtgaggacacctaacacatatctgtttggagtttcagaagagctaatatttgaaagctgacagggttttccagaattttggaaagatgctccttctcagatccaggaagcctggtgaatcctaagcaagataaatcaaagaaatccccacctggacatatcatcaggaaactgcagaacaccagaggaagaaaataccttaaataaacctacagagaacaggccattcattacaaagaaatggcaactaaatggatagctaacttattgacagcaacagtagatgtctgagtggcatagagtcttcagtgtgctgcaagaaaaacacagtcaactagaaagccattgctagcaaaatcatctttcttccaagaattgataatttttttaaaaaagatattttaaatttggaaacaacaacagcaacaaaaactgccaacccccagaattctgtattcagtgaaagtgttcttgaagagtaaagttgaaaggatgacatctgttaataaaacactaagagaatttgttgccagcacatctgtaccacagaaatgttaagagaagttcttcaggctgataggagggaaaaccagatggaaactcagatcttcaggacagaatgaagagcatcggaaatgggaaataatttgggagaacatttcagaagtaataaggatataagaaaatttgagcggcacaatccataagcttatgaatttgttgttcccagcaattggagaatacacattctttgcagtcacatgcagaatacttggaaaaaattgatgatgtcctagacagaaaagctagtctcaacaaattgcaaaaaattggtatcacatataacacaatttctgatcacagtacacttatgtaaaaaatcagttaaaaggataagtagaaaaccttcatacacctaaaattttaagaacacttctaaattcttgagtcacagaaaaaattataatgaaaatcagatatatttagaaccaaattaaatatatatttagacggagttttgttcttgttgcccaggctggagtgcgatggcgtgatctcagctcactgtaacctctgcctcccgggttcaagcaattctcctgcctcagtctcccgagtagctgggactacgggcatgtgctaccacgcccagctaattttgtatttttagtagagatgaggtttctcaatgttgatcaggctggtctcaagctcccgacctcaggtgatccacccacctcggcctcccagagagctgggattacaggcatgagccactgcgcctggccaatagtatatttttacataagaatttgtgggacaactgaagcaatagtaaaataaatttatagctctaaatgttcacattagtaaaaaagatataatgaagttagaatagcattacactgacgtaaaataaaaggaaattataaggataaagatagaaattaatgaaaagaacataaacacataatagtatccgtaaagacaagtcagtaattgaaaagagtaatagacaaatttctggcaagaaatttttttaagaggaagggcacaaacagcattaggaatgaaacagcataactgccggcacactcaggatttcatgtcgggtgagaggctgactctttgatcagctctgtgcttacaaatccaaaaacttagataaaatggataaaattaaaaaggaaacagcaaagctaactga

SEQ ID NO: 19554 - DNA, 1032 bp, Homo sapiens
gttattagaattaagaattatttgaattattattagaatcaataattggaatgacttctaattaacagtttggcaagattgctgggtacaaaagagtatacaaaagtttttctgcataacaataaatagatttctatgaaaagtttaaaagatactagttcctagaaataatgcttagttcctaggaataaatcttacaaaagttgtacaaatatctgtgggagataaagggtaaaaattaaaaagattaaatttgaccaaaagatattaaaacttaagcaaatgcagagataccatgtgatcttggtttggaaaactcactattgtaatgataatgcttctccccaaattgatcttggatgcaatgcaattctggccaaaatcccaaaaatatttaatttttgtttcttcacttttgttttttaacttgacaagatgattttgagatgactacagaagagcagagggccaagaatagccaaaacaagattgtgatttgctgtatcagatatcaagaattctcataacactgtttgtgaggataattaagaaggtgcaagtggccaggcgtggtggctcacgcctgtaatcccagcactttgggaggccaaggcgggcagatcacaaggtcaggagatcgagaccatcctggctaacacggtgaaaccccgtctctcctaaaaaatacaaaaaataagctgggtgtggtggtgggtgcctgtagtcccagctactcgggaggctgaggcaggagaatggcatgaatctgggaggtggagcttgcagttagcgatgattgcgccactgcactccagcctgggtgacagagcgagactccgtctcaaaaaaaaaaaaaaaaaaaagtgcaaggacggaaataggtaaatgtagagagcccagtaataagcccacaaagacttgacttacgacagaggaggccctgcataccatgctgcgaggagtggatggactctagtccatgctgctgggatgagtcaagaagaaggtaaccataagggacgatcggtaaaa

SEQ ID NO: 19555 - DNA, 1065 bp, Homo sapiens
taaagtgcagattcatgcagtcagcagatatttgctagtgtctgccatggactcggccggcactgtcacgggctctgagggcacagcagggaccagaacacccgcatgcagtccctgacctgggagctcagaaagccacaccctgacggctcagcctctgcccctccttctgtctccccaggtgctcccgccacctcggcccctgttaaccctttccaggtgaaccagccccagccgctgacactgaaccagcttcgggggagcccagtcctggggaccagcacatcctttgggcctggcccaggagtggagtccatggctgtggcctcgatgacctccgcggccccacagccagctctgggggccactggttcctctctgacaccactgggccctgcaatgatgaacatggtgggcagtgtgggtatacccccatcagcagcccaggccactggcacaaccaaccctttccttctctagtgcctgggcctgggacccacccagagcacctgtgctggaggatgccgagcagggactctcgtctgtgggacgggatccaagagtttggggattaggggtattagggcttttcagctccagcttcctgatgaaagggctgtctttacagccccaaccctcagaccctcgccttccaaggcaggcccctcagcctggcctgctctcaccacctcctccaaagcactgaggtcctggcagggctcctctgaggccttggacgaggacgtggagtcatcagtgttgcccttgcccctaacctcagcccgagggtctccaggatgttgcctggcccaggacttgggacagtggccttgtctttgtcctccccaccccccagccctagggacaccccaggcagtcctgggtgtggacacgatgaagcaccggctccataagacaccttttggggaagtggttgtgcatattttatttttctttgactcgtgtgagttcaaagtaaacaccaccaccgtggacaactcttgaattaaatccactagagcgagctttaaaactaatctgagcataacccccaacgtggctcta

SEQ ID NO: 19556 - DNA, 1035 bp, Homo sapiens
tctttttactccaggtcctccccactggctgaggagaggccaaatggtgagcggactggccagagtgtccacagctcagccacgtccaggctggctcactggggcctgcctcctactgcaggtgttgctctttgctgccccggggaagctcacagggtagggcttctgagtgcagtcttggtggatggatcagggagtccaaccatggctgtgtcctctgctcccgctttaccaggaacactcatgtttgggttcccctgaactcagtctctacctcttaacttgttctgaatggggaggggaaggatatgacaccttcagaaaccccaaaagtcatgaaggcggtaagggaggcccaagagtccagcttaccgctgtgggggcccagtcctggccgtacacaaagcagtacttgcagtagaggtcatcatactctggaaactgaaaaaagcacagacagattctgtcgactggtattcatgctgaggccaatgcatttgctaggcaggtgcagccaaggggaattctgaacgtgagacacctgggagtgggtctaagagacggctggagatgtgttcagaggagaggctgaggaccaagaagcgggagtccacgggagactcccaggtgccacggcccctggcttttgctcaggctctgccttgtctgatttgtccttcctacttcatccggaaaactcctgctcacccttcaaaacttacccttcagggagcctgctctaactctcaagctggtttaaggtctcctcttggctcccttagccccgtgcttccctccataaaagcaatgattgcctgtgtctaagtctgtcagttcctctagaccatgagtagagaagagatttaatgcctttctgtgtccccactgcctggcacagggctgggcacagataaggtctaaggcaggggtcctcaaccagtccgtggcctgttaggaacgggtccacacagcaagaggtgaggagcaggcgagcaagcaaagcttcaactgtatttacagctgctccccattgct

SEQ ID NO: 19557 - DNA, 1031 bp, Homo sapiens
tatggctcgtggcctgtgcacctcgcccgctgaacatcagtacttcatgactgagtatgtggccacgcgctggtaccgtgcgcccgagctcatgctctctttgcatgagtatacacaggctattgacctctggtctgtgggctgcatctttggtgagatgctggcccggcgccagctcttcccaggcaaaaactatgtacaccagctacagctcatcatgatggtgctgggtaccccatcaccagccgtgattcaggctgtgggggctgagagggtgcgggcctatatccagagcttgccaccacgccagcctgtgccctgggagacagtgtacccaggtgccgaccgccaggccctatcactgctgggtcgcatgctgcgttttgagcccagcgctcgcatctcagcagctgctgcccttcgccaccctttcctggccaagtaccatgatcctgatgatgagcctgactgtgccccgccctttgactttgcctttgaccgcgaagccctcactcgggagcgcattaaggaggccattgtggctgaaattgaggacttccatgcaaggcgtgagggcatccgccaacagatccgcttccagccttctctacagcctgtggctagtgagcctggctgtccagatgttgaaatgcccagtccctgggctcccagtggggactgtgccatggagtctccaccaccagccccgccaccatgccccggccctgcacctgacaccattgatctgaccctgcagccacctccaccagtcagtgagcctgccccaccaaagaaagatggtgccatctcagacaatactaaggctgcccttaaagctgccctgctcaagtctttgaggagccggctcagaggtgccttgtgggcaggtcgggtgggcagaggggagacttggacttggacaaggcttcaggcttttaccttctcccctgcccaacttccccgcagatggccccagcgcacccctggaggctcctgagcctcggaagccggtgacagcccaggagcgccag

SEQ ID NO: 19558 - DNA, 1040 bp, Homo sapiens
gagaataacatgagcatgctaaagtgagatatcaaatttatgaaaagaaaagcaaattgaattgcaagagatgaaacaaaaaaatctgaggtggaaatacattggttgacattaacagcagattagacactgtagaagaaaagattagtgaatttaaagatacagcaatggtaaatatcctaaataaaatgtagagagaaaaaagactgaaaaaaatgaaaatgagcaagttgtaagtggcctaaaagcacataatcgtacgtagttcccaaagcggaggagagggaagaggggcaggatactttttttttaaagaaataatggcaaaaaactttccacatttgataaaatcttcagattaaaggtctaaaagggtatttatttgatgtaatcactgatctgaccttgggattcctctagaacatcctggccaagctgtcgtttatacttaattaactcactgatgaggaacttgctacctcccaatgcagcttgattctcagaacacttttcttttgaactgaaacctacctttcctacccataactttcacccactgatactagctgttgggcttatgattctgtaggagagtctgtccatttttcagttactgccctatgggtgtttttatgatggctcatgctccacaggatcttcatggtaaacatttgtaattccttcagtcatttctcatggaatgtggttttgagtctctaccatcttcatcttgaattaacagaagcctgaaggcagtgtccatagtacaaacagcaccatttagagaagaaccatttccattagagcagaacccgttagacttctagggaagtactaagtttttggtggctacaccacatgacctgccaatgtgccactgaccagccacagcatcaccacccttcctttgtgtggttgtcctcctgagcccaagtgcagaatcctacatttggacccattaattgtttttttcttattttctagtcatcttgacatttttggtgtctaatttttccagtgacagtatgtcctatcctttc

SEQ ID NO: 19559 - DNA, 1059 bp, Homo sapiens
acaagaaagttaagctggcttttttgacaggcactgcctgtgaagccacttcatcccaaagggcctctatgccagctcctcagtggaacctccagatagatcgaaacacacaactttaatttttagaggataaggtttttattgcccagtttggcactagtaagccacactaggaatgcaggcagccatccctgcagctgcctgccgcggaactggaagacgggaaaaggtagccactatgtgaaatgcaattcacccatgatcaccaggccctttcttcaggcattccccttgttgctcactgcgagtttctcactagcctccagagtgccaaaatcattgactgtgacatctctcgccatcagtctcacaagagactgattcttgagcttcctactccactgttgttcatgatgtcacctggatagaggcttctcatgctgatttggctctcgttcttttgtagaacaaattttttttttctggaaatctttcagatattatttttgtctctgctgggtgtgcttaggtgtgggtgaatcttttttcttatattctgcttgctattttgtagactttcaatctgaagcattggatttttctttagctctaggaaatttaccctttaaaaaaaattttactccttttccttttttccgttctctccttttggaattctttttggataaaggatagaatgtatggattaatctgacatgtctcttttctcccagtttctatctctgtgtttgggatattttttcaactttatctttcaagttgaaatgtagtttagccatgtctattcattatccagtttctaaaaaaaggtctttagtgttcatatttttcatttccaattacttttctctcaattgctcctcttccttaattgcctgttgttagctgataaatgtctctgataatagtaattataattaaaaaaattttttttctctcatgttccttgcattctttgtttcctgttgtattagcaggcttattttggtctttcctttttttgtgctgttgattttcctcagtgtctggtgaacactg

SEQ ID NO: 19560 - DNA, 1048 bp, Homo sapiens
agaggttggatgaacaatgttcattttgatttgggatgaaattgggaactctcacaaggctttgaagtgatgcagcaattcagtaattttgtttgttttactaagtaaatattgattgtatgattattgacgttcttttaccttggtaatttaccaaagctgtattttgatccttcgggtggtttcaccatcatgtgtaagtggtggaaataccagttcaaagaagaccaaaacaacaaagtggagcaaagattggcaaatggtttctgtaaagggctagatggtaaatatttcaggctttgcagatgttagggtctctgctgtaactaccgaacttactgtagggggaaagcaggcacagccaatgtgctaacaaataggcaactctgatgcagagcaagacttctttccccagcctgctcccactgtcagccccaggaggtgaaggcctgtgggtggactctaagagatccataagaacctttggaactatggacaatgacagatctctgtgtgtgtgcatgctttattttctggtcctcgacctgccaaaaagctgaaacttgctactatcatactactgttaaattacttgaggggtggggtgttagattctgtgaggatataaaaccagattgattttggggcatggctggattttgtacttactgaaattgaattgtgggtctttgtgacatttatatactcctgttgttttaaataggaattttatggagaaaatataaaagagtctcctgattatgaaaggatcatcaatcttcgtcattttaagaggatactaagtttgcttgaaggacaaaagatagcttttggtggggagactgatgaggccacacgctacataggtaatggaaattctccttttcctatgggaagatggcaatttggcagtttttgctgacactacttattaacactagataaactattaaatatatagcatttaattgttaaagtactaaatcctgctttctggtatactgtacctgtagcttttgttataaactatttaaaatgtctgtgtttc

SEQ ID NO: 19561 - DNA, 1048 bp, Homo sapiens
actctgtgatcaaacttaaaagtcattgccattcatcattaataaaagttgccatttcaactacgtcccaacattccctaatagggtattcagggaacctgtcttaaattgtgcttatctaaatcttggaactttgagctaggggaggagaatgtattagactaaatacaaactgcggggttgtaagggagtctcagaacctcactgaatccttcactccagttaatggcactgctcacttcctgcctctgctgccaccatcactgtgtgaagctttcaagagcttggtacttcccagggctaccggcagtcctctgtagtccagagaggtgagattagatcttcttggttccctgtgaggtttcaggcactaaaactctatgtggggaagggaggggttactcctcctccaatgggactcaaggacttgacctccaggagtaggcccctggtcagaagtgccatctcaccagtggtcttcattcttcctcattcattctttatcatcctgtgttctgtttagttgcaacaatctcttgtgactaatgtcactcaaagcatcttgtaaatcctagggcttcctggaagttagttgccaaagtcatgcaagcatcacctgtcattcttgtgttggagttatagaattctacatcttataaaacctaactggcatttaaaaaatactgtggccgggcgtggtggctcatgcctgtaatcccagcactttgggaggccgaggtgggaggattgcttgagtccaggaatttgagaccagcctggacaacacagtgagacctcatctctatcaaaaaataaaaattagctagatgtggtggcatgagcctgtgttcccagctgcttaggaggctgaagcaggaggattgattgagcctgcgaggccaaggctgcagcaggctgtgattgcaccactgcacttcagcttgggcaacagagcaagaccctgtctccgaaacaaataaaaaatactgtaataaaagtacttataaacatactaatcctctttcaggaccctaaagttgcaggttag

SEQ ID NO: 19562 - DNA, 1096 bp, Homo sapiens
gaagaaattaaggaaatttttaaaatttcttgaaacaaatgataatggaaacaacatatcaaaacgtatgtcatacaatgaaagcagtactaagagagtttataggaataaacacctacgtcaaaaagtggaaaaacatctaataaataacctaatgatgcatcttaaagaactagaaaagcaagagaaaaccaaacccaaaattagtagtctgtgtcctgtgaggccagccagaaacatagaaaagcaagagcaaaccaaacccaaaattagtagaagaaaagaaagaataaaggtcagagcagaaataagttaaatggaaacagaccaaaaaaatacaaaagatcaatgaaatgaaaagttgtttttttgaaaaaataaacaaaatagacaaagctttagccagatgaagaaaaaaaagagaaaagatccagataaaatcagaagtgaaaaaggagacataactaataccaagaaatgcaaaggattgttaaacgttactatgagcaactgtataccaataaattggaaaacctagaactggataaattcctagacacatacaacctaccaaaatgcaaccatgaacaaatctgaaacctgaacagactaataacaaataatgagattgaagctgtaataataagtctcctatcacttctcagccttttggctaagatcaagtgtaatcataagtctcctagcaagcaaaagcccaggacccaatgacttcactgcttaattttactaaacacttaaagaaccaataccagtcctattaaatctgttcaaaaaaataaaggagggaggaatatttccaaactcattctataatgaggccagtattatcttgataccaaaaccaaagacacatcaaaaaaaagaaaactacagaccagtatccctgataaacattgatacaaaaattctcaacaaaaatactagcataccaaatttatcatgaccaagtgggatttatctctgggatataaggatggttcatcatatgcaaaccaatcagtatgatacatcatatcaagagaattaaggacaaaaaccatatgatttcaattgatgctgaaaagcatttgatgaa

SEQ ID NO: 19563 - DNA, 1031 bp, Homo sapiens
caaaaatcctggttgacaagatgccatcacctcggtctgaaaagccaaagtatggattatgtggaagactcagaggagaagagcagccctataagggggtttccgtaaaccagaaaaaaatctgtaaccagctaggccccaaaaaggtcatggcactggcctggcagagaggtgggtgtggctgggtctgctgggactgcacactgttgggacaccccaccttcaccctgacctcttccctgcccagctcccttgccccaaacattccccctggtgccatggaggctacactgtcagaaagtgagctgagcctggtagggctgtctagcacacagaactgccagtcgtaacaggcatcactaagctgcaagtcaaacagtgaagcactgggctgcagaagagacatacagatccccgggtcactggacatacaatcactgacctagatagatgtactgttgattaattaacaaattaatgcagaaaggagagaatatgtaataaatggtgttcaaaaaaattttagttggattaatatcttaaatgtaaaaatagaaaccctggaagggtccaaaaaagtataagcaaatgtgtatataatcttgcagtgggttaagtcttttttttttagacagagtttcgctcgtgttgcccaggctgaagtgcagtgacacaatctcggctcactgcaacctccacctcccgggttcaagcaattctcctgactcagcctcccgagtagctgagattgcaggcacccgccatcatgcccagctaatttttgtatttttagtagagacggggtttcaccatgttggccgggctggtctcgaactcctgacctcaggtgatctgcccgcctcagcctcccaaagtgctaggattacaggtgtgagccaccgtgcccggctgggttaagtcttttaagctcgttaaagacataaggaataggacttacatacacattcacaaatctttttttttttttttgagatggagtttcactcttgtgaggctggagtgcaatggtg

SEQ ID NO: 19564 - DNA, 1046 bp, Homo sapiens
cgctcaccgcgagggtccacggcttcattctccaagtcagaccaagaacccaccaattccggacacaaaaggtgttcccaccattcctgtcctcttacttctctcgccttacaagtaggtaaccattgttgttagttacttatgtaccttccaaagtttcttcatgcaaatacaagcaaatatgaatcagattctccatttctccttttttgcacaaatagtagcattattctctatctggtcttcatcctgtgtttttatttcttggtatatcacaaagatcgtcacataccaactgcttgctctttataatgtccccttaggtcttcccaagaatatctaataatttcttctatgtgctctagtaattatctttgcttgggtttgtgttctgttgattcagtgtccctgtttcatcatactgaataaaaacttggtgattctttatgtgttcatcttcgaagtttgagaattccttttttcctgtcttactaggcgtagcgtgcctcctgtgattgttgaagagctgtggtgtgctgctgagtggcgtgtgtattccatgtgaggggaagggtccaacagtcctggtcattcagactgcagttccccaggtaatcaccttgtcaggttctacctctgctgttctatctgctgttacaagtctgttcctggaaacctgttaccatttccttctgcataacagcctcctcccaagcttgtattgggctatggtttgctcaggtaatctggttctgagtactttttacttttcagaaatttcctagacattttagttggccatcggcactcttgttttccaggtttcttttgatttagtgttttaaaaatgtttctaccattccattgaattttaagacacttggaaggcagaagtatgtgtttagtttattgttttggggacagggtcttgctctgtctcccaggttagagtgcattggcgcagtcataggtcactgtaactttgaacttttgggcttaactggtcctcctgcctcggcctcccaaagcgctgagattaccggcat

SEQ ID NO: 19565 - DNA, 1105 bp, Homo sapiens
tcttgaaagggtgaaaagtatttcagtcctggctagagtgactgaggggtgagctcctgctgttgctagggcctgggctgcctacccacctgtcctcactcattctcttgacctcctggccactagtgtcatttgactttatgaccagccactgctgtatgtgaggcaataccttaaggataaacaagcatggtgatgatgttcccaagattgcttggacatggttatggagtgggtggactcggcattgagaacacagtagtagctgctgcatctcatgacactattggatgggtgtcagcatggcagcagaatactgacggactgtgtgcacattctttcagcagtaatgattcattcttttcaaccttttctggatcggctcattcctttttgccaaaaaaaaccaaacaaacccaaaaaactatggtttagtgaaattgcatatgaacaagagttctaaacgagggatctgaaaactttttctgtgaagagctatagagtaaatattttaggctttgcagggccgtgtgttcccttggaactacttagctctgctcctgtagtgtgaaagctgctataggttgtatgtaaatgaacatggtctcttcatttggtctggatttgggctgcagactgtagtttctgatccatgttctaaaccatagtcttaagacttaattttgtcttccttctcttgtttttaaggtgcaaggttatacataacattttgctaatgaatacatggtaagtacctactaggtactaggtgctgagattatagtgatggacaagacacaaatccagtctattcagcttaatgtctgggtggggagacagatgagggagcaggcaattactaaagaggatggcaggccaggacacgggagagcacacaattgggcagcaggggttgggagcagggcatgtcaggtaagacgttctagaagaaggtgatgtctaaatgaagggggaagagggcgaggcaggataatgcaaaggtccttttgaacttcatctgcaaattccatggggtgagagtatagctggaaagctgagattgggttctgtgctgatagcaggaatgacaagaaagactctgaat

SEQ ID NO: 19566 - DNA, 1050 bp, Homo sapiens
ttttagcacccatgtctgagtgagaacatgtactgtttatctttttgtgctttacttatttcattaaatataatgtcctccaggttcatccatgttgctgggatgacaggatttcattcttctttaatggctgaatagtattctattgagtgtatatgccacattttctttatccattcatctgttgatgcacatttagatttattccctgtcttggctgttgtgaacagtgttgcaattaacatgagagtgcatatatttcttcagtatactgacttctttcctttggataaatacccagtagtagggttgctggatcatatggtagttctattttcagttttttgaaaaacctcagtattattttccataatggccattaccaatttgcatccctacccacagtgtataggagttcccctttctccaaatctttgccagcatccattatattttgtctttttgatagtagccattctaactggagtgagaggatatctcatagtggtcttgatttttatttctctgatgattagtgatggtgagcattttttcatacttgttggctattttatacttgcaaggctcccagaatagccaaaacaaacttgaaaaacaagaacaaagtgtaggatgactcacacttcccaatttaaaaatttatacactaacaagtaatcaagacagtgtggtactggcagaatgatagtgacatttgtatgtcttcctttgagaatgtttattcagatcttttgcccatataaaaaccagattatttgcttttttgctgttgagttgttttagtcacttgtgtgttctggatactagtcccttgatggatggatagtttgcaaatattttctcccattctacaggttgtcttttcattctgttgtttcctttgctgtgcaggagctttttagtttaataaagtgctatttttccatttttgtttttgttgcctgtgtttttgaggttttagccataagatctttgcctggaccaatgtcctgaagcgtttttccttatgttttctaccagtagttttat

SEQ ID NO: 19567 - DNA, 1033 bp, Homo sapiens
tttgctacttacttttctatttttcctttttcttacctattatgtttcagatccataaactattttgtctatgtctttatttcaaattattttgtggccgggcacggtggctcacgtctgtaatcccagcagtttgggaggccgaggcgggtggattaggagatcaagaccatcctggctagcacggtgaaaccccgtctctgctaaaaaaatacaaaaaattagccaggcatggcggtgggcacctgtagtcccagctactcgagaggctgaggcaggagaatggcgtgaacctgggaggcagagcttgaggtaagccgagatcacgccactgcactccagcctgggtgacagagcaagactctgtcgtcaaaaaaaaaaaaaaaaaaattttgttctccagtctaaacataccgtaacagtcgtagcattaacctttgtgcattaaaacgcttaacatttccatccaaaaaatttcaggtatttttattttaaaattaaacaggttctccctctttcatccaggctgaagtgcagtggtgtgatcacggctcaccacagccttgaactcctgtgctcacgtgatcctcccacctcagcctcccaagtagttgggactacaggcatgtgccactgtgcctggctaatttttaaaaactttttttagagatggggccttgctatgatgcccaggctagtttcaaactcctgagctcaagtgatcctcctgcctcagcttcccaaagtgcttccccactggcatgagccaccataccaggtcaaaatttcacgtataacacaagaaatacattttttttttttttgagatgtagtctcaatctgtcacccaggctggagtgcactggtgggatctcggctcactgcaacctctgccacctgggttcaagtgagtctcctgcctcagcctcccgagtagcaaggattacaggtgcacgctaccatctcggctaatttttgtatttttagtggagacagggtttcgtcatgttggccaggctggtctcgaactcct

SEQ ID NO: 19568 - DNA, 1051 bp, Homo sapiens
actccaggagaaatcatgtaatcttttggtcgtaataattatattattgtctcagccttgcctagggcgccaacttgccatctgtcatgggtggtattggaactgcttgaatggggaggcatgagcttcctcattcttttcaagactatttccagtttctggtttccaggccttatgctgttctctggggctatgccaaagtttgctccaacaatagcaagaacacagcaaaaatcacaaaaggggcttctatttttgagccctgccacctgcctgcactgtgccggcttctctgagctgctgtctctattcatgctcacaatagccataggaagagcatggttattttatctagaccaggaaccttggctttggaaaggtcaaaccagttttactttttctctcccgtgcccaccacaggtttccatatggaacatccactttttctaattggttttatttcattaatattattcacttatctgaattccaaaaaagaattctgaattcttttttttgttgttgttgttttttctatagacggagttttgctctgttgtccaggctggagtgcagtggtgcaatcatagctcattgcagcctccaacttctgggctcaagcaatcctcctgccccagctctcgagtagctgggactacaggtgcacaccaccggggtctcgccatgttgcccaggctggtcttgaactcctgggctcctcctgccttggcctcccaaagtgctgggattacagacatgagccactgcgcctggcctggattccagttcttattattctttttctccctgaggtgtcctttgtgtgtatctcatgttacacagtggtgtggcttttagagaatgaggaggttccttgtgtgcagggtcctccctgcctgccccagggtcaagtgaaaggttgtggaacccccagaaggctgtcaaggaatccagccactaggtggcagccttgtcaaaagcacccaccttctcctctgctacaagttctggttctgacaaatgtttctgactttagaaacaatgcttgtat

SEQ ID NO: 19569 - DNA, 1472 bp, Homo sapiens
agcacacgtgggatccaaagacatgtcactattttaaactgatatcagtgttttctaaaaggcaaaataaatgtgaagggctagttttactgtggccaaactctgatgcttgcagaatctcagacatctcagatggtgatcagtaagggcaagcagtcgtgattggctcactgccaagaaactgtcagtgtcctcgctgatacctggacccctgcatgctcccagttacctgcatcacaaccaggtaatgcctgaggctccaacctgagacacctgtcctctctgacatgaggagggaataactctgtcctctctgacatgaggaggggaactcgtctaacatggaaggtaagtattcttatccccatctgacatgtgaagaagcgaaagctccaggataggtagtgttcccaaattcaaacccaggtccgactccagagttcttttttctgctactctgtttgtctcaggtagggagacttgttttcttccctcatcatctttacctgttgtagaattactattaccggtgactagcattctttgctcactatgtgctaaccactgttctcagtgtgcgatgaatatggtctcctttagtctttactacagccctatgaaatagtatccttattatcattcccattttatagatcaggagactgaggcataaagagattaagcagactgtccaagtccatgggatataaatattggtaccaggacttgcagattaggaaacaggggctgaaagaaaaccatggatgggttggcttgctggggtgagagtggaggaaggggatgttggaagttttggagttgagaggccggaaggtgggtgggtcagtttcttggatgccacagaaggaggagggccatgagccagggatgtcagggaatggggagaatggggtggggatgtgtagatggcaacagggaggggaagaggatgccaggtcctgctgtgtgaactgcagaaatggaaggtgtctgtttacagtggggaggggaacagacggggggaagcaacagtcataggtatgaggtacagcgagaccttcagtttgggaaatgtgagaaaatgaacagactggccttgggaaggcagtggtgggattcatccagctgtggaagtgaggggacattcagagagctcagcctatgggaaatgttgatttcactgtgagttctgaagggccctgaagaagtgttggggactcaagggaggggcctggggcaggtggggctgaatcgctttggagatgagaacctggaaaatcacagaatgccaggaatgagtttgttcttgttttcataattttagagaggtcatttatcaatgagtatattttgtgataaaaaaaatttcagattcggtatagatgctcctccacttacttcatcggttacttccagataaactcatcataagctgcaaatatgctaagttgaaaacacatttaatgcactta

SEQ ID NO: 19570 - DNA, 1053 bp, Homo sapiens
catggcccactgcagccttgacctcctggtcccaagtgatcctcccgcctcagcctctggaatagtctggatggaccacaggcatgcaccaccatgcctggataatttgttatttttgtagacagagtcttactatgttgctcaggctggtcttgaactcctgggctcaagtgatcctcctgccttgacctcctacagtgctgggactacaggtgtgagccactgtgcctgatcccaacatacatttaataatctacattgcagggaattacattaggaaccatgtgtgggggaccagaagataagacttgcacgtagtcaatgcagtaatgagaagaccataagaaaagtctgtataagagagggcataggcatgactttgttctgtcctcttggccacatcctggctgtgtgaccttaagcaaattaacctaccaactacaaccattccttctgttgggaggagccaaatctgtgggagtggaaaaatcactgagaagaagccaaactctaggatgttgctgtagaaagggcctacacaccctgctgtagaaagggtcctagagtttggcttattttgtgtactggggatcactatgtctccttgcaaaccattgcactgggcgcggtggctcacacttctcacacttgtaatcccagcactttgggaggccaaggcaggcagatcacgaggtcaggagttcaagaccatcctgaccaacatagtgaaaccccgtctctactgaaaatacaaaaattagccaggcatagtggcgcacgtctgttaatcccagctactcaggaggttgaggcaggagaattgcttgaacacgggaggcggaggttgcagttagccaagatcacgccactgcactccagtctgggtggcagagctagactccatctattaaaaaaaaaaaaaaaaatctgtcttttcaaactctagtcttttatcaggtaaacattttctaagttttattcattttttttggaacaagtaagacagtttacttattcaaaatgtaaagggttacagtgaaaagttttgctcct

SEQ ID NO: 19571 - DNA, 1078 bp, Homo sapiens
tgccccaatttggaagataaaatatactgtctcctacttaaccatttcaggtctcagtccagtgtcacctcttcaggtagacctttccctttctctctcagggggcaagtctcctggtttgctgtgactgcagaataaaccccagggcttggttgggctgagccagggtttgccagcagacaaattcaggcttctttctatgtgagggcccatggcaggccagcgtgggaggacgtgagatgggaggggcagccaggtgctgggagggttgggagagacatggggaggaagagtgaggactgaagccagggggaagaaacatggaagtgtgctgtaagctctgtgcccactagcccttgatgagttttaatctgctttacccctcaaggctgtaagagtcagatctgagtgttttgaaaatgagacggtgtgtgcgattaacttgaagagaactgatacaggagagatctttggtgaggcctgattataagtggatgacaagcttcatttttcctaggtgataggttggactgttagacaaaactttggattcagagaaaaggcactctaggtgcattttgcctcctttctttaccttgatggattttcatgttggtcaaatgaagacttgggctacatctatgaaatcccttccaatttttagaagtatataattctgttgtacgctctagtgagtccagactataaagcattttgaattttactatttcttttcccctaattgtgggccagaaaggaaaatttccaaataaggatgcacagtccactctgggaaacacagggaaacaataactagaatacaagtctagcctttgccctggcatgaaaagaatgcagactgttagctgacctaaaggtttctgttttatttcacgtttaggtgaaatggtcagctttgaccattactcccaaagaagtttctctccagactttaagatatttgtgcaacattaagatggttttattatctgtgagacagctgtggtcacttttatttatcaaagtgccatgtttattgtatatgtatcaggagcagtgctggaaagctaaatttaga

SEQ ID NO: 19572 - DNA, 1062 bp, Homo sapiens
tgacttctcaggctcaagcaatcctcccacctcagcctccctagtagctgggactgcaggcatgagccaccactcccgactcctctctattttaaataatactaacacatagatctgtgtttaagtttttgaatgtttcctcagggcaggagtgcttctcctctgtttattctcttgagacgtgagatcaggtagaaatgttcccgtgtctaggtggaggagaccccagtgtgccctttcatttactcctgggctctagagtggaaacttctgtgtttttctctgtgtgatgatttgtgtgggtgccaagggccaaacccacatttagcaaagaaatagtgtgatccacttaaaagggggtttaataacttgagatggagatatcaagctgaacattcacaacaagcataactaaatcagagaggcagaagaaagcattaaccagaaaaataagtactaacttttaaagagtgattactcctgatttaaaacttttactagatgaaatacaaagggtaacagactgtgttgagaactgaattaattttctggaaggagtgtcttgtaaaacaaagatattgtgaggtgaaaaatgtaagatgcttaagggatctatgtaggagacctaataattgaatgataggattcttagaaggggacaaagtaacagatggaaaatacatcgtattataaaagaagaaacccatctgagctgaataaaatgttagacttcagattgaaaggactcatggaattcttttttaaaagacaattgctggactgcagcaataaagatagaaatcctgtcaacttctaggcaggaagataggtctgttttgagggaaattgggatgccataggaattcttacccacttcacaaagaagctagaatagagtctgtatggattattgactctaaggaactaatataaatcttctgtattcagacatatcagcctgggtttttacttgcatgccacagaagctgattttggttggctaataaatttttaaagatgttgagttgctgtgaaattgttagaagggctagagagagatgt

SEQ ID NO: 19573 - DNA, 1027 bp, Homo sapiens
tcctgagtagctgggactacaagtgtaagccaccatgcccagctaatttttgatttttttgatgagacgagtctcactatgcagggagaccccttgagacaggggtctcaaggctgcccagactggtcttgaacccctggacacaggtgatcctcccgccctggcctcccaaagtgtgctgtgctgggattacaggtgtgagccattacaccgagccctcattatcttactgttgagttttgagcattctttgtatattttggataacagtcctttatcggatatgtcttttgcacatattttctcccagcctgtggcttgtgttctcattcttttgatgttgctatttttttccccaattttgttgattcctcttatgatagatgaggatttaacacatggccctgcaaccctctcctagtgtcataatatcactgtttttagtttctttcttggttattgcttttagtaatgtatttcatctttatttcttgtcttgtcaactgtatatagtatctttgacaccctgtttgtaaggtgagggtggatattattgctgccatcctttttgcccactctctctgctttctcttctacctcccagtttctttcatctgtactttacctttttcactagcaaggatgacagtattcatatgttctagaaaatagtcttgcatgttctgtgtgtagtatggatattattgtgactacatatatattgtgccctgcagagtgaagttatgtgctgtgattttgttatctgtcttatacagcttatttttatgaagtttcttgttttgtgactatttttgttacaggaaagggggcccgatccagaccttaagagaggattcttggatctcgcacaagaatgaattcagggcaagtccacagtgcaaagtgaaagcaagtttagtaagaaagtaaaggaataaaagaatggctactccatagagcagccctgagggctgctggttgcccatttttatggttattttttaatgatatgctaaacaaggggtgg

SEQ ID NO: 19574 - DNA, 1141 bp, Homo sapiens
tccagccccacgggaattttcagtaactgtctcaagagagaggtctgtgccacgtggtccctccaaccccaggaaatcagtgtccagtccaacttcttccaacactcccactcctacgaaacacctgaggaccccttccacaaagcccaagcaagagaatgaaggtggagaaaaggctgcgcttgagtcccaagttcgggaacttttggcagaagccaaagcaaaagatagtgaaattaacaggcttcgaagtgaactaaagaaatacaaagagaaaaggactctgaacgctgaggggactgatgctttgggcccaaatgtcgatggaacatcagtctccccaggtgacacggaacctatgataagagctcttgaggagaagaacaagaactttcagaaagagctttccgatctagaggaagaaaaccgggtcctgaaggagaaactgatctatcttgagcactccccaaattcagaaggggcagcaagtcacactggcgacagcagctgcccaacatccataactcaagagtcaagcttcggaagcccaactggaaatcagatgtccagtgacattgatgagtataaaaaaaacatacatggaaatgcattacggacatcaggctcctcaagtagcgatgttaccaaagcttctttgtcgccagatgcttccgactttgagcacattacagcagagacaccctcaaggcccctgtcctccaccagtaacccctttaagagttcaaagtgttctactgctgggagttccccaaacagcgtaagtgaattgtccctggcttccctcacagagaagatacaaaagatggaagaaaaccaccatagcactgcagaagaactacaggctactctacaagaattatcagaccagcaacaaatggtacaggaattgacagctgaaaatgagaagctggtggatgaaaagacgattttagagacatcctttcatcagcatcgagagagggcagagcagctaagtcaagaaaatgagaagctgatgaatcttttacaagagcgagtaaagaatgaagagcccaccactcaggaaggaaaaattattgaactggagcagaagtgcacaggtattcttgaacagggccgctttgaaagagagaagctactc

SEQ ID NO: 19575 - DNA, 1030 bp, Homo sapiens
agcagccctcccactttagcctcccagagtgctgaagagttctttctattctttggatacaaatcctttaccagataaatgatttgcaaatatttcctctcattctgtgggttatcttttcattgtcttgataatgccctttatggcacaaaattgtttaatttttatttttatgaagtcgaatttagttatttttctttggtggtttgtgcttttggtcggaggaattttaagagttatggaatcacatttactgttgagaaagatgacttgggccacagttaggtgagaaagaatgaaggacagaacagggagtgagttgggtgggaagatgagggctggaaagacattcattttatttacttatttatttttgagacggagtcttgctctgttatccaggctgagtgcagtggtgcatctcttcacgcactgcagcctccacctcctgggttcaagcgattctcctgcctcagcctcctgagtagctgggattacaggcacctgccaccacgcccagctaactttcctatttttagtagagacggggtttcaccatgttggccaggctggtctcaaacccctgaccttaagtgatccacccacctcaacctcccaaagtgctgggattacaggcgtgagccactgcacccggcctggaaagacatttagatgttagatgtgtagaagggaggctcagtagggtcaggtgactgatttgatgtcagggacgggcaggaggaaggcatttcagcctattcatagatctccagcttgtaggattgaatgtgcggttgtgctgcttcctgggagaggaaacacagaatgtggggcaggcttgagaagggagcgttatctgctggagctaacaaggatacccaggcctgcaagcccaggctgctgtcagcaactgccgatgcagccacagaggagatccgggagcctctgcccttccaggccaagagtcctccaaggccggggcctcgtgcctgaggtctctctttgcccctccagtacctttagaagctgt

SEQ ID NO: 19576 - DNA, 1026 bp, Homo sapiens
ctgaggactctacaacatgcagccaggtagttatgcagaaggccacagtctgccccaggatgcaagactcaaaagccaccttctattgctgcttttcaaatgatttcagacatcagccttccaggatctaaaatgcattacttcttttctccttaaattcatcttctggccaggcacagcagctcatgcctgtaatcccagcacttgggaggccaagatgggaggatcacttaagcccgggagcctgggcaacatagcaagaccccacctataaaaaaaaaatgaactgggcattgtgatgcacacctatagtcctggctctgagggaggccgaagtggggagaatggcttgagccaggagatagaggctgcaatgacccgtgatcgtgccactgtgctccagcctgggcaacagagcaagaccttgtcccttgactccaaaaaaactaaaaaatagtaaagtcagcttctgtttaataaagtagctattgctaagtatatattggtctttcatgtattgtgatttttcttggtcaaactgacctgtattatattactacctagtgttgtatatataatacatagggcaattgtgagagaaagaatgactttcattgacttttactgttacatgttccaggcactatgataaactctccaagtcattatttcacttaactgcccaccccccaaccctgcattgttagattatgaaacagaggcagagggattaaggaatacaaggcttgattcactagaattggggtttaaaccctggcggtctggctccagaatatatgtccttagtcatcttgatgcatttaagcagctttcaagcttcagagcacaacctgcaatgatctattttgtattacaatccagagtctcacgcctttataattaaaacacaagcttcacagagcagtgctgacccctgagcacaggcagggctctctggctgtttcccaggctgtttctctctctcttctcctgtcctttccctccgtcccttcctcccccctccct

SEQ ID NO: 19577 - DNA, 1019 bp, Homo sapiens
gtacatgtgtcttttttacagtctgcttaataccatgcttttaacatttttgtgcttttgtttttggtgactttgctatttaaaatggccctgagtgcagtgctgtccactgtccccaagcacagtgaggttgagacgcacctacagagaaaacacgtgtattagggaagcttcatgcagacgcaagctcttgtcccgttgtgcgtgagttcggtgttattgaatcaacaaagcgcatcaggctaagtgcagtgacctcatccctgtaatctcagcactttgggagactgaggcaggaggatcgattgagcccaggagttcgagaccagcctgggcaacatagtgagaccctgtcttgacaaaaaaataaaataaaataaaaactagccacgtgtggtggcgcatgcctttagtcccagcttctctggaggctgaggtgggaggatcccttgagcctgaaaggctgagactgcagtgaaccaagattgtgccactgcactccagcctgggcaatagagcaagactgcatctctaaaaaaataaaaaaaccaaaccaaacaaaaaagcccaatacggtgcatcagagaaagggagaagtttgacaatatgtatataaggctgccctgagacatgctaaagcgatgtgctaaagcagccaaattcatggatttgtgagatgacagccagttttaaaaagctgtgggcaatattgttgtgtggctgaaaaccaaagcaatatttgttcacatcacccagggtcaggaaaatgttaaccccttcttggctagtgctggttggctcccaagtttcaaaaggccataaagtgtgagaaaggttaaccttgcaggcaggggaggttctgcagatcaggaggctgaagaagaatttaaaaatacttgctaagtgttattcaggaagaggaaaaaaggaaagagtgggtttccatggttgatgagcctggcttgtttatagagacattggcagatacgtctatataatgcaaatggcattttagttga

SEQ ID NO: 19578 - DNA, 1129 bp, Homo sapiens
tatttttatttcagagtcagaataactgatgttaaggtatgtggggaaggaaggcggtagcctcatctttgcagtcaaccagcaatatctcattcccagtgtcatgtttgcagccaaccagtaacatctcattctcagccctgcctcttgcctctgttaaaagaggtgggaagagggggtcgtttttgaggtctctttaagctctgctgttctctggactggttggttagctgacctttccctggtgggagagtaagaaactccagtgccagccttagagttattctggtgcaatgccttgaacctctttgacacagtggcatctccatatcttagttgtggcttgggagcctgctctttctcttccagaaatgtgaacaagccagtgtgtttttagggacctaaaagtgatctgtttcattggacacatataatgtaatagatgaaaagataataactttttcagctctggctcctcccagttttgaaaactaccaattgagaaaaaggctttgaaatgaaaactctcactgaaatgaacccgtcacatctttttcctgaaaagttgagtcctgggacctggcaaaaacagaaaaaacacaggcagctcaatgtaatgatatattgtgccgcatacaagctttctaatgaaagacatggttcgtgagcagtgcatggcacaggcttctcaagcagcatcagggaaagacctctgtgtttgtggcatttgttcctcttgttctgaaacagcaaatgccattacttttagggtgacttatctgattcttactgtgtctgtcatataacaccaataaacatccatggaaaacgtctttaaaagagataattaaacacacttaatatctgtgcctaattaatgctgttggtttctaaatagaatgtctgtgattcgaatgtgtttcattttgcctataccacaagttcttgcattgtcccctcttggaggtgagcagtgtggcagcgcagcacgtgcagactccactggaattggcttaactccatgtgtgcacatccgtgtcagcctgagtgtcactgtgtgtgcctgtgctgccctctgtgttgctctgatggctctaatgggtcacagccgctcagcatgtgttctcca

SEQ ID NO: 19579 - DNA, 1031 bp, Homo sapiens
gggggaaggatagcattaggagatatacctaatgtaaatgatgagttaatgggtgcagcacaccaacatggcacatatatacatatgtaacaaacctgcacattgtgcagatgtaccatagaacttaaagtataataaaaatatattaaaagaaaataaataaatatcaagaaggagaaagaaaaaaaaagaataagaagtcagagggaggcagctgcctgcaggaggtttagcgtaaagaaaataggaatggtgatgggaaattgaagaaaacatttaaaaagagctgtcattcaagaatgactccactgatgccgcctgtgctgttccccacctgacagtaatggaccaaggcagctgccagagtgcatatgaaaagacaattcacgttttcagaaggagtggccttctatgatgtaaccttgttgtaatgcagggaagagacagacaataagatgtttccagtcaggatcacaagaacactatttcctgctggagtgatttgtgtgtgtgtgtgtgtgtgtgaacattttggattcgttttcaaaacattttacgtttgatgaaacccaaaactcattttgcctgtagtacttttcattcatcatgaaatctctgtaaaattagaaatatgaccatgtgtctgctttatttacccttcacaaaatatgtctagacctgtttgtctgagacacctcatagtcttgttctctcagaattaggaagccaaaaataactggtgaaaactttttgaaaaccgggaaccatgtgtacttgacttaaaataactttccttttatttcatcaaaatacagcgtgaaaggttatgttacatccctccatatatatatatttttatttcagctttagttatagattcagggggtgagtgggcaggtttgttacaagggtatattgcttgatgctgaggcttgagttatgggtcccgtcacccaggtagtaagcatagtactctgtaggtaggttttcaactcaggccttcttcccttcctcccttgtctagtagtccc

SEQ ID NO: 19580 - DNA, 1015 bp, Homo sapiens
ttttctctcacgagccagtgtgctgtggggcacccgctcccactcccactctcagtggtgtgtgcatgcccagaggtatgaaacttcaaggaataaaagtggctttctgaacaaaaatatcaaagtgtgtagagacctgtcagactgttcgcacagcagatggggagggacacgttctcccaccttagtctgcacaaacaccgaagaagcagccctgacaagtctaagctgggcacatccccaattccttgggaattttggaaataaaactgagaaagattactctaaaatataaagcccagatgctattggcagccatgtttttgcctctgtgcaaaaaagacttaacccagtaggcctgggacggctctctttagcaaggctgcttgcaaggctggcccttggctggcgtctgggaactgggattacaggagggttcccattgtttccagaactgatgagaggggctcacggtgctgaaactgtttgtgcaaacacatggtatgtgctgaacagcagctttcctttggggagtctggaatgtagtatgtgctgggcagaaggggctggatgctgagtccctagtgagcttccctggttggcagcattttttcttgagatggggtttcagtcttgttgcccaggctggagtgcaatggcaccatctcggctcaccacaacctccgctcccgggttcaagattctcctgcctcagtctcccgagtagctgggattacaggcatgtgccaccacacccagctggtctcaaactcccgacctcaggtgatctgcctgcttcggcctcccaaagtgctgggattacaggtgtgagcccctgcacccggccggttggcagcatttcacacgtgttgtcatggcttgttgccaggggaattaaacatgtccgtgactgctggagagaattcttggaagcacgtgcctggtttcctcgggacttcctgccctgtgccttttccctttgctgatctggctttgtgtcctttcgcagtaataa

SEQ ID NO: 19581 - DNA, 1912 bp, Homo sapiens
agatgttgtgagacttattcactatcacgagaatagcatgggaaagactggcccccatgattcagttacctccccctgggtccctcccacaacacttgagaattctgggaaatacaattcaagttgagatttgggtggggacacagccagaccatatcagatggagtcttgctctgatgtccaggctagagggcaggggcgccatctaggctcagtgcaacctctgcctcctgggttcaagtgattctcctgcctcagcctcccaagtagctggtactataggtgcacaccaccatgcctggctaattttttgtatttttagtagagatggggtttcaccatgttggccaggctggtctcaaactcctggcctcaagtgatccatccgcctaggcctcccaaaaagtgctgggattaacaagcgtgagctactgtgcctggccaaaaagggaacacttttatactgttggtgggaatgtaaattagttcagccgttgtggatgacagtgcacacggctttgaattgtcccccagctgcactggactgggagttgctggtgctcctgatgctcagctagaattagagataattttagatggcaactaggggactcggttggggttgttccactctgagatgaaagggaacgtctttatttaggagtataatgttcttggagcgagtgttatgtcacaaaccatagttgggtggcctctacctctgccaacgtcagcaataaaaagtctgaggcagggaaactttttagagagaagaagagtgtttcctgatcatgggcttgggcttgtctacctgactagatttggacttttataataattcttttttaagatggtacacattctcctttttcctgtgttgtttctctgtggtctcactgctgcagtgccaggatctgcattcaaatacggccgagcccccagagcaccaccagtgcagtctgtcctgaggcactggactctcagagctctcctgcgggtttcagtcattttgtttggtttttcaaccatggctttgatcttgccagactttagtctcaacctgtgacccatttatagttacagatcaagaactagtggtcactttggcaacatacataccaacatggaaatgatacagagaagactggcagggaccctacacaaggaaaacaaaaaaataacttttttttttttttttaaagagagtctcactctgtcacccaggctggtgtgatcatggctcactgccaccttgaatgccagggctccagtgagtctcccacctcagcttcccaagtagctgcaactacagacatgcaccaccacacttgtctgatttttatttttatgtattttatatttatttttttgagacagggtttcactctgttgccctggctggagtgtagtggcatgatctctgctcactgaaacctctgcctcctgagttcaagcaattctccctcttcagcctcctgaatagctgggattacaggcacacaccaccatgcctggctaatttttaaatttttttggtagacgtgaggtttcaccatgttgcccaggctggtctcgaactcctaacctcaagtgatctgcccaccttggcctcccaaagttctgggccaccactctgagcccaaaaactattcttgacagtgttcaatgaactagcatatgggcgccttcttggttgtgggagatggtggcattgttgagcttccggatccatctgacctctcaaatgcttctgaagattttgcagatgaagaaaaatgctgttttgtatcagaaatgatagaagatgtaagtgtgtatataatgttctcatgtttttggaaaagaaggatttagcaagtgttaaagtgaatttgggaagggagcgaggaagggtgagaaggagaacctggcc

SEQ ID NO: 19582 - DNA, 1059 bp, Homo sapiens
aatcttggctcactgcaacctccgacttccgggttcaagcaattcttctgcctcagcctcctgagtagctgggattataggcacgcaccaccatgcccagctaattttttgtattttttttagtagaaatggggtttcatcatgttagccaggctggtctcaaactcctgacctcaggtgatccacccacctcagcctcccaaagggctgggattacaggcatgagccactgtgcccggccctttatccagtctactgttgatggacacctaggttgatttcatgtctttgctattgtgactagcactgtgatgaacataagtgtgcatgtgtttttgatagaacgatttcttttcttctggatatatacccagtaatgatattgctgagtcaaatggtagttctgttttaagttctttgagaaatctccaaagtgccttccacagtaactgaactaatttacatttccaccaagagtgtattcccttttctccacagccttgtcagcatctgttactttttgacgttctatcaatagccattctgactggtgtgagatgatgagatctttaaaaatgaagctctatagtgttccccagatattagaaagtgttctttctcagccaccgtgtaaggagagcatcttagccagcccaattacagatgcaagcaactccccagaaaaggaattaggcgagggacgatatgtgatgtcactgtcataaaaacggccaaaacatgtgtccccagggctgctgtgtctttaccaggccatgtagtccatgagggctgttgctcactgagtgccagcatgcccaccaggacagctgctgcaggactgggtgctggcatgcccccgtggagggaggtcaccatgcagcaattcctgaggcatggctgggcctactctgcaagtgtaaacttaatgagctgtgcttaaatagctaatttgtgcttgattgtgtgacaagcattttgtttttcatatttactgtatgtatttaccattttgggcatttttcatgcaaggacttgttggaccctcatggaggtcctgca

SEQ ID NO: 19583 - DNA, 1047 bp, Homo sapiens
catagttcactgatgtctcaaatttatgaatcttctctttggtgatgtctaatctgtgttcacctccatccattttagctttcattcctgacattgtaatttgaatctctacaagtgtagtttgctttaaagaaaaatcttccatgcctctgcctgtctgcttgagcttaattttaatatacagttgagttccatatgaacagcttgatctttctgatcttgcttttatgattggtctaatttcctgctcctgaggcaagatctttgtgatgactctattcattgccatgcgaagtctgagttttcccagcatcactcatgggaatggacactctttttggcacatcgtgaacaccagacatgtttctttccagtgttttttagatgtttttttccccttgatctggggcggttttctggcacacatgtgctgtttgttactctgctagatacccaggaggtatttttgcaaatcttcagtgttctttccctgtactttgtctcctttccggtgttctgttttgtgatctctgtgtgccttggctttaccagactctcagcttcatcatctcatctcagggaatctggtggactctatgtcagttttttctctctgtgcggtagcctggaaactccgtgaaggcagggagctggagtgttggatgaatttcctttgtttcctgtcttacggggatcattgtcttcattacctgaagtccactgcctggtaaatcattgtataatatattttgtctgttttctttttggttgtttcaggccagaaggtaaatcagtacttgctgtccattgtggccagaagcagattccagcagagcttcagcacctgctgtcgactggcaagaatgcttttctacccctttgcttaactgcttccttctcacccttcatttctcagtgtagccatctgttcctcaggggaatcttccctgggcccattatagatcaaattcttctgtgtgatcatagaactctgttttcttacaccatatatctgaatttataattgtcatttttgttgtgtttgtt

SEQ ID NO: 19584 - DNA, 1954 bp, Homo sapiens
cactttaaatctccagtcatttacagtgtcattggtttacttttgccctcagaaaaagttccaaattccttaacatgtaatataaacacccacattcatttggttcttgtcaagttactcaggcttatctctcaccacttactttactctgcccctttgctctaggatccagccaaactggactgcacagaattccacagtgctcgtccttctcctccagctctttgcacttgcttctttgctctatctgccaacctttttttctcatccttcaggtatccactaaccatgcctccaccgaaaaacctacagtatcgagacaaaactgggataggtgtccctcttgcattccaatagtgccctgttttatacctgtcagggtatctatgacttggtatggaaattgcctatttgtctgctttttcaggttatagcatgtgattgctgaggggtggactgtatcatcttcatcttgtaactccagggcatagtctagtaccttagcatgcggttgttgaataaatgaatgaagaatgagaaaaccagaagctgtgatacacaaccacaatgatcatttagtgtgcaactatgggcagattcttatctaataataagttagcattgtagtcatacatacttttcattcttgttaacactgaaaaagctctcaactcttttttactgatttgcacttagttaactatgaaatatatagaatataattctttggccaggcatgttggctcacgtttgtagtcccagcactttgggagcctgaggcaggcagatcactggagcccaggagtttgagagcagcctgtgccaacatgacgaaaccctgcccctataaaaaatacaaaagcttgccaggcacagtggctcatgcctgcagttccaagtacttggggctgaggcaggagaattgcttaagcctgggaggacgagactgcagtgacctgtgatcacaccacggcactccagcataggtgaaagagtgagaccctatcttaaaataataacaataataataataataataataataataataataataatataattcttgctttttttttcagctgctactaaatatgaacctggatcctatatagcttctcctctaggatttacacacaaggaaaatctgaatcaagatccagttttggaagtagcaaaagaatatgcacagattttaagaagaaaatacatactctgaaagataaggcaattttatttgggctattcacatgatattttgtttcccattaaatatatgatgtgaacatttttactaaagggaaatattctatgttatacatgtctgatgaaaatttatatagtattttaaataatgtttcttggcctcttcagctaacttttaagtggattttgcaaatgaaaaccagtattactgagttttacatactcgaactgcccaaatgttagctgtttaaacagccaaataatcaagttgccattaataatttagtggagccaattgatggcttgtttgtattttataattttatctttatacatagtgatagatttaagtttagatagacatcattttggtatactggtactgtggtcattgtcaatgtttggatatattacgattgttatagtgcaatcaaacttagataattttaattttaagcactgatttatttagatctttccttgtggaaaaataaggtttgcctaaggctttttgcttttttatttattgtttcatttctttattagattaacttttgggaaacagtcttaaaattggagaaaatttccacattttaggaaaaacagctttccccctgtgggccatttgagagtaaattgctgacattatgccatcacatctggtatgtgggtattcccacaagtcaggacattttatataactacttcataatcagaaagttaacatcaatacacttgatcatttcat

SEQ ID NO: 19585 - DNA, 1163 bp, Homo sapiens
ttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagtttcaagattttcagtatataaaatctgtcctttcctacctggacatgtcccattaaaaagtggaagatcttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattggtaattgtatatggggtgtacctatttatctgtaactgttatccaaacaaattaaatactgtggatgcctctatgtactgtttttcctcatacaagtaaacacagaaagtcaaattcttcagcctccctctctgtgatcctgttttaattctcctacttgaataatttctttctgacttacagaggggatgcttcatctctgaggttggaaactctgtagagcaggattccccaactcctgggctacagaccagcaccgtccatggcctgttaggaaccgggctgcacagcagcaggtgagtggtgagctgtatttatagccgctcccccttgctcccattaccgcctgagctctgcctcctgttagatcagcagcggcatgccattctcgcaggagaacgaaccctattgtgaactgcgcatgctagcaatctaggttgtgccctccttatgagaatctaatgcctgatgatttgaggtggaacagttttatcctgaaaccattccccccagccccccagtccgtggaaaattgtctt

SEQ ID NO: 19586 - DNA, 1657 bp, Homo sapiens
tcagcctggaagatcgaggctgcagtgagccatgatggcaccacagcactccagcctgggtgacagagtgagaccctgtcttaaaaaacaaacaaacaggggccgggtggtgtggtgtcggtgtcggcagcatccccggcgccctgctgcggtcgccgcgagcctcggcctctgtctcctccccttccagccctcacctccacgcgggaccgctcgcgccagtcaactccgcgcacgttgcccctgcttggcagccaataaaagggggctgaggaaataccggacacggtcacccgttgccagctctagcctttaaattcccggatcgggcacctccacgcaccgcggctagcgccgacacccagctagcgtgcaaggcgccgcggctcagcgcgcaccggcgggcttcgaaatcgcagtcctccggcgaccccgaactccgccccggagcctcagcccctggaaagtgatcctggcatccgagagccaagatgccggcccacttgctgcaggacgatatctctagctcctataccaccaccaccaccaccattacagcgcctccttccagggtcccgcagaatggaggagataagttggagacgacgcccctctacttggaagaagacattcgccctgatataaaagatgatatatataacctcacctacaaggataaggaaggcccaagccccaaggttgaatatgtctggagaaacatcatccttatgtctctgctacacttgggcgccctgtatgggatcactttgattcctacctgcaacttatacacctggctttggggggtattctactattttatcagtgccctgggcataacagcaggagctcatcctctgtggagccactgatcttacaaagctcggctgtccctgtggctctttctgatcattgccaacacaatggcattccagaatgatgtctatgaatgggctcgcgaccaccgtgcccaccacaagttttcagaaacacatgctgatcctcataattcctgacgtggctttttcttctctcacgtgggttggctgcttgtgcgcaaacacccaactgtcaaagagaagggcagtacgctagacttgtctgacctagaagccgagaaactggtgatgttccagaggaggtactacaaacccggcttgctgttgatgtgcttcatcctgcccacgcttgtgccctggtgtttctggggtgaaacttttcaaaacagcgtgttcgttgccactttcttgcgatatgctgtggtgcttaatgccacgtggctggtgaacagtgctgcccacctcttcagatatcgtccttatgacaagaacattagcctccgggagaatatcctggtttcacttggagctgtgggtgagggctttcacaactaccaccactcctttccctatgactactctgccagtgagtaccgctggcacatcaacttcaccacattcttcattgattgcatggccgccttcggtctggcctacgaccagaagaaagtctccaaggccgccatcttggccaggattaaaagaaccggagagggaaactacaagagtggctgagtttggggtccctcaggttccttcttcaaaagccagccaggcagaggttttaatgtctgtttattaactactgaataatgcta

SEQ ID NO: 19587 - DNA, 1102 bp, Homo sapiens
ggaatgcagtttattttgatgggcatcttctatggggcctgaagacaaggctttaattgcagtcagtgtttaagatttagcaagactggccggggatggtgactcatgcctataatcccagcactttgggaggccgaggtgggtggatcacctgaggtcaggagttcgagactagcctggccaacatggtgaaaccccgtctctactaataataccaaaaaaattagctgggtgtggtggtgcacacctgtaatctcagctactcgagaggctgaggcaggaaaatcacttgaacccaggaggtggaggttgcagtgagccgagatcacaccattgcactccagcctgggcaacaagagcaaaactccattaaaaaaaaaaagaaaaagatttagcaagacttggtgtcctgttttagatccaggactcaaagccctgtaactcaatgtcacaaggactttaaaagcacatacaggaagatacatggaggctgaatcacttgaacctgggaggtggaggttgtggtgagccgagatcacacctttgcactccagcctgggcaatgaatgaaactccgtctcaaaagaaaaaaaaaagaaaaggttttgtgggtttttttgtttgtttgtttgtttgttttgagatggagccttgctctgttgcccagactgaagtgcagtggcccgaccttggctcactgcaacctccgcctcccaggttcaagcgattcattctcctgcctcagactcctgagtagctgggattacaggtgtgtgccactatgcccagctaatttttgtatttttagtagagacagggtttcaccatgttagccagactggtcttgaactccctacctcaggtgatctgcccgtttcagcctcccaaagtgctgggattacaggtgtgagccaccgcacccagtcaaaaaaagttttttaatctcagtttttttatttctaagcaaaccaaaacttaataataatatggcaacttggtcatattaaagttttttggcttttaaaattttttttatttttatttcttttttttttttgtgagacagagtctcactctgtcacccaggctggagtgcggtggt

SEQ ID NO: 19588 - DNA, 1051 bp, Homo sapiens
aaaccctgtctctactaaaaataaaaaattaaaaaaaaattagctgggcgtgttggcaggcacctgtaatcccagctatttgggaggctgaggcagagaattgcttgaacctgggaggcggagttggcagtgagccgagatcacaccactgcactccagcctggatgacagtgtgagactctgtctcaaaaaaaaaaaaaaaaagaagttgccacttgttcctaacaagtaaaaagcttaacaaactgaaaaatcaactcttctttgatacatcagagacatgaaatcataccgcacacagttgcccccaaaataaaagacagataggtggatacatggaatcacacttactggagcagaaacctctgtgggaaccagtcctgtggtaggaaaacatgaagtgtaattgacaaattgctggagactcagtgtggacaagtctgagagtgatttagttgaatgttgttcccactaaaatctcatgttcaattgtaatccccaacgttggagatggggtatggtggaaggtgattggatcatgaggaatcttatgaaatggtttaatgccatcctcctggtgctgtcctcgcaacagtgagtgagttttcacaagatctggctgtgtaaaagtttgtggcatctttcccccttgttctctctcgctcccactctcaactactccctgttcaccatccaccatgattgtaagcttcttgaggcctccccaaaagctgagcagatgccagcaccatgtttgctgtgaagcctgcagaaccatcagccaattaaatctcttttctttatgaattacctagcttcgggtgttgtttttttatttttattttttgagaaaggatctcactgtgtcacccaggccagagtgtactgtcctgatctcagctcactgtagcctcagcctcctgggctcaagtgatcctcctgcctcagcctcctgagtacctgagacaacaggcacatgccaccacacctgccttatttttgtattttttgaagagacgggatttcaccacattgcccaggctagtgtcga

SEQ ID NO: 19589 - DNA, 1041 bp, Homo sapiens
aaaatgctcagttaaccacagtgggcagaagaactgtggaagacaaaaagaggagcaaagaacaagggtaacaaatgaaaaaaaattaacgaatatggtagctattaatccagctatgtcaataatcactttaaatgtcagtggttttgtcagttacatcatttaaaaggcagagattgtgagagtttatcaaagaataagacccaaatatatgttgtctaccagaaaccaactttaagtataaagacacatatagattaaacataaagagatgaaaaaagatccaccatactaacactaattaaagaaagtgggagtagctatatttctacacagagtagactacagagcaaggaaagttatcagggttaaagagcattacattatgaccgcagatcaatcctccaataagacaataatctttaatgtatatacacataatagagcatcaaaatatgtgaggcaaaaactgatggaactgcagggagaaagagatgaatccactattgtatttggagacttcaatgctcctttatcagaaagacagatttggcatgcagaaaattagtaagaacatagttcaactcaacagcggtcaattggatatagttaacatgtataaactactttgtccaacaacagcagattatacattcttcccaagtgaatgaaacattcacttagaccacattctaggccacaaaacacaccttaataaatataaaggaacagaaatacattgtctgcttccagaccacgatggaattgaactagaaatcagtaacagaaagataactggaaatcccccaaatagttagtgattaaacaacatacttgtgaataacacatgggttaaagaagaaatctcaagagaaaactgaaaatattttgaagtaaaagaaaatgaaaaccttaccaaatttgtagaatgcagcaaaagcagtgcttagagggaaatttatagcattgaatgtatgtattagaaaagaagaaagatctaaaatcaacaatctaagtttatactttaggcaactagaaaaa

SEQ ID NO: 19590 - DNA, 1093 bp, Homo sapiens
attttgggaggctgaggtgggcagatcacaaggtcaggagttcgagaccagcctggccagtatggtgaaaccccgtctctactaaaaatacaaaaattagccaggtgtggtggcgtgcgcctgtagtcgcagctacgcgggaggctgaggcagaagaattacttgaacccaggaggtggaggttgcagtgagcaaagatcgcggcactgctctccagcctgggcaacagagcaagactccgtctccaaaaaaaaaaaaaaaaaaccacattaaaaaccaaaattgtgtgtgtccaagttcctaggtagccatagtaagtgctataattgataaggagggctttaggccataatgaacagacagacttggcgcgggctctgcctcctgttcattgtcaccgcactcctgtgccatcatattacagggcccggggctgggctttggcacctttctccgccccccctcacaggattgccgggaagcatgtgcttggcatcttactggagagcagagctcacttcaatgtggctgctcttcccaggattgaacactcaggagcctggtctgaaatctccagccttccttcaggttttatttttactaaagccagcctgtactcttttaaaccagggagctgaaggctggcttctgaaaatacaccccacaggccactctgccgtggcttgttcaggcattccagggagggcttgctgacctgaaggtgtcctctggcccaggtcaaaagaccagagaagacactggcgccaggaaccgccactggcaaggtagctgccatctgaggtaggatattgttcttttttttttccagtcgaaggcggccttaatgtggcttctcagacatttgagaccaaaaaaaaaaaaaggcagtttgaccctgcctttactttctgaaaatgacagaagctttcagatatatttcaagatatgggtcataagcatgacccatagtttatgtcaccttaaatagagcagctgattagaactggccattggttataaaataaaagagtacgtgtaggtttgtgggagcaggatcctaactgctttagcaatactaagccactccttgccg

SEQ ID NO: 19591 - DNA, 1101 bp, Homo sapiens
tttcttcttgagtcagtttaggtaatttgtgtttttcaaggaatgtatccatttattctagtttttctaacttgttggcaaataattgttcatagtattcttttataatcatttttataatctttataattttttttatcatctcatcatttctgtaaagtcagtggtcccactttcatttctgattttagttatttgtgtcttctgttttttccttgtcattctagttaatgctttctcaattttgttgatcttttcaaagaaccaacttttggcttcattgatttttattgtttttctgtattctgtttgtttatctctgttctaatctttattataatgtttccttcctctgctggttttgggtttagtttgctattctttttctagttccttaaaatataaagttacattattgttttgaggctaagtgatccgtgggacacatagctcagatggcctgccactcagaaagtgaatttgtatctgttgtatttgaccaggtgcagacacacaagccttacttggtgaccttcgacctcacagactctggggccatagttgcagcagcagctgagatcctgcagtgctttggctatgtcgacatacttgtcaacaatgctgggatcagctaccgtggtaccatcatggacaccacagtggatgtggacaagagggtcatggagacaaactactttggcccagttgctctaacgaaaggtaacagtcttgagaaaagagcagtgataagtgatatgttggcattctttttacttcacttggatccttttcagctaaacgttccccatctccatcctctctgttgccctggagtgggtgttaggtgttattgttacagtttgggtatttgctttatagcttccaatcaagatgttctctttagtgacagccacatttgtgcagcattacctacatgtctttttcatggtgcctgcaaacccctacaaggtggggatatttttatgtcccaccatggatttcagtccaggggagaggctccagcaggaaaagggaactgagctaaccatttgcagtgacctctgtccctgtttccttgcctctctcctctctcctgctggc

SEQ ID NO: 19592 - DNA, 1755 bp, Homo sapiens
acgcacccactcctgccctggccgctgcgacggcataatctcgggatctttgaaggcagatgcggggctaaaccatcccacctgacgggaaccctgccacaggacccgacatatccctgtctggacactgctgtaacgagtcaaagtcaggaaggactaactggagcccagagattcccaggtgctgctgcctcagacctgtggactctttggaggatctcttacagtttgtgaacttctcagttcctctactgctcccacagacaacgttgctaaacatattaattggtcccataaatacttgagcaaaacaaatgcgaaaatctgtcccgaattcagcctagaagaagcccagccctgcgcgtcacacttctgtgtagtggaaccccccttcccaccccgccgcaggccacagcaggagggccagcagacggaaaggcgaccctctccttgttgaggattcctttcgatttccttccagctgacattctaccacagttttagctgcttgcaatcctctcaccgtccctcatcacctacagtgtgtgattcaaattccttagcacaatcaagaagcccctccttagtttggaagttgcctagctctccaaattcaactgcctacctttcccgtctggaacttgccaggctagtaaattcagagggtttgcagatacgtagatgttctatgctttacctaaaatgcttttacctcccagccaacttttttttttttttttgagacagagtcttgctctgtcgcccaggcttgagtgcagtggtgcgatcttggctcactgcaacctccgcctcccaggttcaagcaattctcctacctcagcctcctgagtacctgggattacaggtggtgccaccacacccagctaatttttgtatttttagtagagacggggtttcaccatgttggtcaggctggtgtccaactcctgacctcatgatccatccccctcagcctcccaaagtgctgggatttacaggcatgagccacggtgcccagctctcccagccaacttttgtccttcaagaccttgtacctgtctggtctctaaaaagtacctggccttcctgttgagtcatacagccctgcctccaagtgtcagcgtagttcatgctggagacctcttaacagttccatggtatgacactgcggatatggctgtcttttctttgtatcagtgtggtgattcagagggtatactagggattctagaacgcacttctggctcaggggctgcttgtgtaacttctgtttctcagctgcctggtttgtatcatgggatgatagtatctcccctcagaggattgcggtatttcatgaggtgatacgtgtatggaggccaagtgctgttttatattttaagtgatctacatcttgattttcacaacaactgtataaaagtgatactgttggccaggtgcgttagctcacgcctgtaatcccagcactttgggaggccaaggcgggtggatcacctgaggtcaggagttcaagaccggcctggccagcatggtgacacctcgtctgtactaaaaatacaaaaattagccgggcatcgtggcacacgcctgtaatcccagctactcgggaggctgaggcatgagaatcatttgaacccgggaggtggaggttacagtgagctgagatcgcacgactgcactccagaatggatgacagagcaagactctgtcttaataatagtatcacttttttttttaatcaacaatctcattttg

SEQ ID NO: 19593 - DNA, 1026 bp, Homo sapiens
gaatttaccattaaaagcatcaaaatgagcattttaaaagtagaattttaagtctgaatgggcagtatattcacatggtataaaattcaaattacaaaacaatatacagtgaaaaataagggggtttttttgctcatcttcttgtgacctggctctttccatctctgtccacaaccctctgcaggcaataactggtacctttgttatggatcctctgcagatataaagtagacatatattaacaaatgttttctttggcccagaggatgcatattatgcacattcctccatttcttgtttgtttttgttttttccacttaattgtatcttggagatcactctgtatcagtatatatctgatttgttttagcagtacatgataatccattgtttggatatgccataattgtatcagccagtctctggacagtcttttactatttcaaggagtgctgcagtaaacatgtttgcgccacttcctggtacccattgcaaataaaactgggataatttcctgacgagaacttgctgggtcagagtgtaggcacttgttgttttgataaatattgccagactacaccccactccctccagcagtacatgacactgcctatttccccacagctgtgccagcatggtctgttagcaagtgttttctttttgcaaatttaaaagtggtatctcgctaaatgcaatatggtagcagaggacatttgtggaaaaacaggtgaaatctgggctgggtgtggtggctcatgcctataatcccagcactttgggaggccgaggcaggcggatcacaaggtcaggagttcgagaccagcctggccaatatagtgaaaccccgtctctactaaaaataccaaaaaaagttagctgggcatggtggtgcaagcctgtaatctcagctactcgggaagctgagtcaggagaatcgcttgaacctgggaggcggaggttgcagtgagccaagatcatgccactgcactccagcctgggtgatggagtgagactctgtctcaagaa

SEQ ID NO: 19594 - DNA, 1048 bp, Homo sapiens
tttggggttggagttgggagagaatgcctgagaaaaggtcaggtgtggtggctcacacctgtaatcccagcactttgggagcccgaggcgggcagatcacgaggtcaggagttcaagaccagtgtggccaatatggtgaaactctgtctctactaaaaatacaaaaaatagccaggcgtggtggcgcatgcctgtagtcccagctactcgggaggctgaagcagaagaatcgcttgaactcaggagactgaggttgcagtgacccaagatcatgccactgcactccagcctgggtgacaaagcaagattccgtctcaaaaaaaaaagaaaaaagaaaatgcctgagaagataggaattggtggagatgaggggacacaggtccccaggcctcctggacttacatagcctgggaaggcggagtcagaagaaggaggatggtatgcgggaagagaggcaagaaagatgccagcgagggagaacagcagggggcatgggaataatttgggatttgcttccacggattgggggggcgacaggtcttagcttcctgtggccactgtagcaaatgaccagaaatggggtggcttcaaacagcaagcatttgttcagaagaatgaaatcagggtgctgggagggccgtgttccctgagaggctctggagagatgctccctccctctcccacttctggtggctgtggcctgcctggactcgtggccttgtcacgccagcctctgcctcatggttgcacgtcagccttcttggtctcaactctccctccgcctccctcgtataaagacacttggttgggtttagggcccacccagataatccaggatgatctcctcatctcaagatccttaatctcactgggtgtggaggctcacgcctgtaatcccagcactttgcgaggctgaggtgggaggatctcttgagcccaggaggtcgaggctgcagtgagctgagattacaccactgcactccagcctgggcgacagagcgatatcctgtctcaaaataatcatcatcgtaatgaaagatccttaacc

SEQ ID NO: 19595 - DNA, 1047 bp, Homo sapiens
ggccagggcaggagcatctgccacaggtcaaggggcagggatgtcgggggtactcaggatggtgacccctcctggtccatgctgtgacccacagcaggggtttcgaggagactccggggctcggggacccccatcggcaggctgccaggcctccctgcacatgcaggtctccgtggtcctgcgtccaggcaggaaggcccctgggctgctgttgctggagaaggaatgtggggggtctcggtgccaagactggggatagcaaggaggtgagtgggaaatgcaaccacaggccagccagcgcccgtgcatggagtcaaagggaggagtcagcatggtgaccactgcccctgcaccgggggaggaaggcatgggggtcctggtgaacctctccctgtactgcccagagcccagcctgactccccccgaagccgggtagggatgcatcactccgactaacaaatgtctcagccctaaagggcccctggctccaggtcaccctccagctctacagaagggcagggacgaatctgatccttgttagcactgacacaagagggcgggacctgagtcagccccaggggaagccagcatgccctggaaaggctggtcccaccaaagcatgctagtgtgtctcccaggctgcacccaggaaggctgggttggggaggagcccagggccagatgggcagcaaagtgtatccggctgtagccagccacaaaagaggacactgatgtctggcagcagcacagaaacccctgtggctgatgtttcttcctcttggatgctgagggtggtttttggagaatagtcagcttcactcccaccccagccccaaggcatctcctcggagaaggctcaggcaggtggccaaggccagcaaggggcgggcctgcagctgctcaggcccccttggatctcctcctggcagacaggggtataggggatagcagcccatggggatggggccttggtttcctgcagaacctacacgagaggccaaaaaaaagatgggggtaccaaggagaggaaaacacccccggcaccca

SEQ ID NO: 19596 - DNA, 1021 bp, Homo sapiens
cagacctgcctttatggccactcctcaccagacgcccaccgtgtggcctctctaagtcacctcttctcccgcatgcttgatacaacagataagtgaacctcccctactcccttgtggagtcactgagagggtggacaggggtggtctggggctgagggtggtgttctcttgggagctgtgcacttccagatggccccatctaatctccacgcgccaggcactgctatggcatgacgctgataacccggggaggtttgtctgtaatctccactttacatatgtccagagaggtgaagccacttgcctgagggcacacagctaggaaggggcagagttgcagttgagcccaggccttggctccagagtgagtgctcacaggtgacctgctgactggctctctgagatggtaactgcagaacggccacctgtgggactccacagcagagaagccatcaggccacagggagagccggtcactggggcctgcgcagtcaggcagcctctctgaactggtgaaaggcaagacgacgtagtagctaggacagtcacagggaagagcatttcaggcagagggaagggcatgtgtgaaggccctgcggtgggaaagcaggtgtctcattcagagaagggctcactcaagggtcgggggctctagttgggggtgagtgggaggagatagggcagagctgccacggccagtgagagttgtgttctagtctgggggtgcctctctttacctgtggtgtagcctcaggtcagtggctgaattctggtcagtttcagtttccttgcccctgcctgggggctgctatgaggctggagtatgtggaggacaccccaggacaccccgtgctgagagccgggacaggcgggcttatcgtgggttgccagtggccgccgagagcctctgtttgttgtggtgatggttgccacaacggctgcacctgggcagccctgggctgcctggccatctgggcccagctctgacgtctgcagcagcctgaggcctgtttctaggctg

SEQ ID NO: 19597 - DNA, 1079 bp, Homo sapiens
caggattttggcctcattcctgagctcagcaggtggctggggatgtggcctgcacaagacccctgccctggggggctgacatctcagtgggtggggcaggatgaaatagacaaaaaacacatgagccatcacgggcattgtcatattttgttgaatataacagtttttaattataagagtgttatgtgctcacagtaaagtgataaacagttgtaaggggaaaagtgaatttctcctcctcaccccctgcctcccccacccccagagtttcttgtccttggggtgaccatcattagagaggcttctgggtttctcagtgcttatgcagacgtgaataagtaaatggaggcatagaaacgtgctaatatctaagttgcctttttttaaattcgtatgggaccattgcatacatgtcatggcgtcccctgcactatgcgcactgctgtgtggtgcccgtgcccactggacccagggggtctcatcctgtcgtcctgggcatggattgagggctgagtcttgggactgtaggatctttgtggcatctgaatgcacagagccaccgaagtccgtgagtcatgggttcttttcgttgtcattttagctgcgttgagacagagatcctggattgcaggatttggtttaagtaccaggagaggtaccgagtcctcgcctgggtgcctccttcgtcacatccctctgggagttgggataatccagatcccctgcctccatccccagagctcagagggtctggggggcttcagagtcgcagcctggggctttgggacctctgggtgaacctggctcccactcagggcagagtagacacgctggagctcggaggggaggcgctcattgctgctcccactggggtccttcttcctttagcctctcttcttcccttagccctgacctcctagaaacaggatcacttgttccctcactgtcttcaggctggggcaggcctctgtgtggggaatgtcactttgtttttttttttgttgttgtttgtttgtttttttttttttttgttttgagacggagtctcactctgtcgcccaggctggagtgcaatggcg

SEQ ID NO: 19598 - DNA, 1025 bp, Homo sapiens
cccagaaaattctacaataacccttatgaaacctgagggtccaaggaggatttagtagtaaattaagaacagagtgcttaattgaatagggccataaagcacgcacacaccacccatcaccctcctcaagtatatttcaaggactatctaactaaaacccctatgcatttatatagaggagataagttggataaaccaaggtgtagcttaacataaagcaccctgcttacacctgggagatttcaatttaatttgaccaccctgagctaattctagccccaaacccaactaattctactaccaaataacctcaactaaaacatttacccaaataaagtataggcgatagaaatgatatctcggcacaatagacataataccgcgatggaaagatgaaaaaacataaccaagcataaagtagcaaggacaaacccctataccttctgcataatgaattaactagaaataactttacaaagagaaccaaagccaagacccccgaaaccagacgagctacctaagaacagctgaaagagcacacccatctatgtagcaaaatagtgggaagattcataggtagaggtgacaagcctaccgagcctggtgatagctggttgtccaagatagaatcttagttcaactttaaatttatctacagaaccagctaatgcctttgtaaatttaactgttagtctaaagagggacagctctttagacactaggaaaaaaccttgtagagagagtaaaaaatataacttccaaagttggcctagaagaagcgatcaattaagaaggcgttcaagctcaacacccaaccacccaaaaaattccaaacacataactgaactcctcacatcacattggaccaatctatcatttcatagaagaaataatgttagtataagtgacatgcaaacattctcctccgcataagcctacatcagaccaaaatacttcactgacaattaacagcccaatatctataaataatcaatgaaaccattattacccacactgttaaccca

SEQ ID NO: 19599 - DNA, 1048 bp, Homo sapiens
acagggaagggccactcagggactttaggtttacaatggggaaaagtaaacttgtgggttgtaagcggtaatgaaaggagggggtcctcgtgtgtaccaaccactcttagatagaaatgagatggaagaggtcccaacagcctggcaaaagcaatacagtatttttaaaatggtgtggccttaagaaacgcagcggttcgggggaggagacttttagaattatctttcaaacacttaagggaggagctgggtggttgggtggagtgacagaaggaaagcttttgtgcggaagaggaaactctggaaaaggcttttctggcttagtgtctagccctggtcggcttagtaaagggcaattagtgttgaaggttgtgcgtccacacctacttagtggctcagtggaaagcacgtcgcattatttaaatcctcttttaaagtaaaataactggaacaacgtttgacggtgttggggggtgctgtacattggctgataacacttagcaaacactgatcttactgtgtgaagtaataattagctgcggccgctgagcagagagcatttacattttcctactcttgaagtgaatgtgtgcctttactaagtacaaggaggagttatttctagagaagggaagaggctgaagtagccaaaacgcgcactattttgtatgtgggtgaatttttatatctagaaacagctgttttagaattctggacttttgttgtcttagggatgattgattaggaagggactttaaccctggttttaataaccatttttaaagatacaaacacagaaaaaaaagggaaaaaattgtagcagagttcacacagaaaaaagaaaaaaaaagatgcaaagaacacagaatttgtgtccagttattattttaactgtattttaagactagaaagtatgtcgcgaagtgggacaaagaactcaaaagttcttatcagtccagtgggtttttcttttactttagtacaccataatgttatagacgagtgatctgccttttttttaaatctgtattttacttcatcctgataa

SEQ ID NO: 19600 - DNA, 1021 bp, Homo sapiens
ttctccatgttggtcaggctggtctcgaactcccgacctcaggtgatcgcccacctctgcctcccaaagtgctaggattacgggcgtgagccaccccgcccagatttccggttttgttttctaagagatggatagagatggatagcatacctacataaagtagaaccatccactaagtgttcccccactagccccctgatttctcttttcttttctttctttttttttttcatatttaggtctcagtgttatttcctggatacgttataaaaacttactagctaagtgccagatatctagaagaacttttgctttttctgagctttttttaaccccagtttttttctttgtttctttttttgaattatcatttggatacaaggttgaacatttctctgcgtagctttttaaatctatgaataaggatttactttttttcttttcttgggtgttaattaaaagccaagccaagtttagtttctcaaggacatacggagagtagaggcaagatttccatgaatgattaaataattctgtgatactactgccttgagctactgccctttttcacaaggcactgccacagatcatccctttctggttatgaaattttggggaggaatgtaaagaaggagctaaatctggtttgcttggttcagcagtgactcagatggtatgttactgttttacagatattaataatgtagtgttgtatcttacggctgatttcccatggcagcctttcccttaataaggtcattaaatcatacatttctgttgctaacattaaacagttacagataatgtaataaaggtttaacttaaaaattttttttcaaagcactttattacaaactttgtgctaggtttataaaattgtaccagtatttaatctgagcacttaaatcattttattaaagtgccaaaggcaatttgatatacctgttatccagcaaagaaacacaaggcaattattagtaaattttaacagattaatgcatttatttggtaggttttataa

SEQ ID NO: 19601 - DNA, 1049 bp, Homo sapiens
cgtggtggtgggcatcatgatggtgcatacctgtaatctaagctactcgggaggctgaggcagggagaattgcttgaacccgggaggcagaggttgtagtgagcggagatcatgccactgcactccagcctgggcaacagagcaagcctccgtctcagaaaaaaaaaaaaaaaaaaaaaaagtcacgtatgaaaaatttaagtcttgcttatgcttgctaagggagagcttaattttagtctcatttactagatgttcttgaaattgaatgcaagggctgttcctcgtatacaagttacataaatattctccatagagacttttaagttgaattttaaaacttgcttcccttatttgtgaacttagcatttttttcctcctaaaaatgcttgtaaaatgtttttaaaatgctttaaaaatgttttcaaagatagatgtggttaaacaggaatccaagttaaaaaaaaagtgtgcctgatgcagtgggtcatgccttaatctcaccgctttgggaaaccaaggtgggaggatcgtttgaggccaggagctggagaccagcctgggtaacatagcaagaccctgtctataaaaaattgtttttttgccgggtgcggtggctcacacctctaatctgagcactttgggaggccgaggcgggcgggtcacaaggtcagtagttcgagaccagcctggccaacatggtgaaaccccgtctctactaaaaatacaaaaaataataataataattagccaggcatggtggtgcacgcctgtaatcccagctactcgggaggctgaggcaggagaattgcttgaacccaggaggcggaggttacagtgagccaagatcaagccactgcactccagcctgggcgacagagcaagactgtcttaaaaggaaaaaaaaaagtttgttttttgtttttgtttttttcagttagccaagtgtgggggcatgtgcccgtagtccctgctacagctactcaggaggttgaggcaggaggatcatttaagcctacgagtttgcctctgcactccagccttggcaa

SEQ ID NO: 19602 - DNA, 1048 bp, Homo sapiens
gaagattttgagtcattaaaaacggtctcagttgcaccaaaatagtgtaagccttattatgaatatcatagaaaagtaggtctcaggctttttgtttttgctttctaaaccacacctatttgttaaggtgtcaagaattgggcagataacatatttaaatcactttagaatgggagcataaatgtgtgctttcatattcattccgtaaatatttactgagcacctgtcatatgccaggtgctatactagctgttgatggagcatacattcaggctgaagaagtacattttgggggtgggtgtgtccatgtccaggttctctagctatatcagtgtaaggggttcttatgtgaacagcaataacatagaatatattaaagcttaggtgttggaaagtttaaaccagaaatacataaaaatatattattatacagtgtacaattgaccagacaactgaccacaaaataggtaatagggaaaattaagaccaacccaaaataggtgatacactgataaagaggctcctttccccaaattgaggaaattgtagctgagtttgcatgcatgcattgcagtatgagcttgttgatcatgctttttgttaaatatggaagtaatattctccatatactctggtaatatgccaatttttgttaggaatacaaaatttgagtaatctgaatttaaaatatatgacattgtccattttttgtccttaaaaaccaaaataattccatttttgagtcagtttgaggcctattaggaagactcttaaggaccagtatttgagaatcacaaatataatgcattttggttttttttgtttttttttttttatgacagtcttgctctgtcacccaggctggagtgcagtgatgcagtcttggctcactgcagtctccacctccaagattcaaacagttcttatgcttcagccttccaagaagctgggattacagacacactccagcataccaccatgcccggctataatgcattttcttttattttagcttattttttttttgagatggagtctcactctgtcg

SEQ ID NO: 19603 - DNA, 1057 bp, Homo sapiens
tttggatagtgtattttgtagtgctttcctttgagtaatggtgtaatattgtattttatggtgaggtatggtttttgaaagctaagaaacttaatttggaagatacttttcctgccaactaagtttaatttcttgcattttaaatgttaataatttgatgagaacgtaatacaatgcaaaagttaggacttttgtaattgttaggtctaattggtcattacattattattgaccagttttttttacggaaactttcttaaaaactcttgcattgggaaattttagggaaatcactttatcaaaacttggagatagtcattatcgttaaggggtcttcatatactgcataccccccgttagaggatggaatgcagaactcactataccctgtctgcatagaagagggaagaaactcaatcccaaagtaatatggaagcagtctcacatgtattgttggttatatatgatatccagtatttttatttttccttttagtgagattacgtactataggtgaacttttagctcctgcagctccttttgacaagaaatgtggtcgtgaaaattggactgttgcttttgctccagatggttcatactttgcttggtcacaaggacatcgcacagtaaagcttgttccgtggtcccagtgccttcagaacttgtaagactgttacttttctgtattttgtatctgtttgtggaatttaccattttctctcagtgtagggtaataaaaacattttgatatttaagttttactttatagatgatgtcgtgagttttaatcatgggctgaatatatttattggaaattttgtgtaaagaattctttgggccgggcgcggcggctcaggcctataatcccagcactttgggaggccaaggcaggcagatcacttgaggtcaggagtttgatacccgcctggccaacatggtgaaaccccatctctactgaaaatacaagaactagctgggcgtggtgtggcacacctgtagtcccagctactcgggaggctgaggcagaagaattgcttgaacccaggagccggaggtt

SEQ ID NO: 19604 - DNA, 1054 bp, Homo sapiens
tttgttcaggaaacatgatgaaagtattgagggggcatcagaattgggtgtacagctgtgcattctctcctgactcttctatgctgtgttcagtcggagccagtaaagcagtacgtgtcaaagttcttgtacattcattatgaattggattatgataatgtgtgcataatcattttaaatctaagtaacctatgaagtctgtgctcggtgtcatgaatattttaaatgttttatttcatgatgggggagaatttgcatgaaggaaattaaatatagttattgattgccaagtgagaagttggattgtttttagagataatagataataatgggcatatcagggttttttttttttgtaagtctagaaaagtttatgtgctgtagaagagatctagtctatatgttaagacattcccttgctaattattttcttctctgttgttctatttttttggtccagtttgctgtttttaaagttttgagtcccagctggtcctgtacatttaactgaaaaaaaagtaacttaaaataatataaaaatagcactcatgtatgtcctacagttataggtgaaatttgatattgtttgtcttacatagcatacctatagacagcttaagtaaagtgactgttaagagggttatgcttattgatgaactcttgtagttgtttaccagctctgttagtatagttaaattgatctcagtagcttcaagtatttataaaatggttgaagtccaaatacatgtgataattacaatacactttgaattaatggagggtgggaggctagttgaaatgcattttatttacccaaggagtatgttaaaatgatagttataaatgttggaagtttaaagcaagatactcagtttagttctttacaaatcataagaagaacaaaattagatgttgacattgctattttaggctgtgtgttttccatatgcttcttgctttccctgtcacaggtggtggcagcaatattggtgtgattgaggttatgctggcaccactcgcacacaggcgcacaatggtgttagctgggcagaaa

SEQ ID NO: 19605 - DNA, 1023 bp, Homo sapiens
acatgtatatattgcttcagtagagccacaatatgtatctttgctgtaaagtgcaaggaaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaattagccaggcgtggtggtgcacacctgtagtcctagctacttgggaggctgaggcaggagaattgcttgaacccaggaggtggaggttgcagtaagccaagatcacaccactgcactccaacctggacaacagagcgagactccatctcaaaaaaaaaaaaaaattgtgttgcctcatacgaaatgtatttggttttgttggagagtgtcagactgatctggaagtgaaacacagtttatgtacagggaaaaggattttattatccttaggaatgtcatccaagacgtagagcttgaatgtgacgttatttaaaaacaacaacaaagaaggcagagccaggatataactagaaaaaggatgtctttttttttttttttactccccctctaaacactgctgctgccttaattttagaaagcagcttactagtttacccttgtggtataaagtattataaattgttgtgaatttgaagaatccgtctactgtattattgctaaatattttgtttatactaagggacaattattttaagaccatggatttaaaaaaaaaaaaaaaaactctgtttctgcaggggatgatattggtgagttgccaaagaagcaatacagcatatctgcttttgccttctgttgtttatcttacctgcagatattaagaatgtatgcattatgtaaaatgctcaattatatatttttgttgagttttttaattaaagacttgtaaaaaaaaaaaacagtatattgcaaatgtttcttaaataggttaggtggagtactttctctctgtctccattgtaaggt

SEQ ID NO: 19606 - DNA, 1044 bp, Homo sapiens
tgtttgctcagcaaagttcagtttttaagctgacaacaatagggggcctgtgaggctcagttccgggaggaggggtcgctgtctggcagagtgtgcgtggttggacttcggtgttgctgggcttggagaatgctctctgtgttggcctctgtgggattgtccccacgttgctctgaagtgctcctggcttccagagtgtgtatataggagaaccacttgctgtgcattctctggaatggccttttgtcctaccctaacttccggagtccctcattttgatggcagtgtggcgttcatgacaccccagagcatccagctatttaagtgttggagctggtttattcagtggcttccctcctgagtgtttgtttagacgatcatccctggcagcagagaacccatccaaaggcccacaggggatctgcagctccctgttcttcccaccgtgatgtggattcgggttcactccacttcctgaaaaggcagggcctgggttgttttgggggatgggaatttagacccctggagtgagttccatggggctgccaccagctagtttagatgagtcacttcatcccggaggcctcagcctcctcacctgcaaaacaaggaggctggagtggatctctgagggctctggaagctcgaaattctctaggttagagaaggagacttggttgggtgaaatcaaatgtttgtgattgtttttatactaccctggtttaagaataaccctctttaagaatggttctaaaatccagatttactgaacccataacataggggttaagtttattagaagaatctttgccataggagcagcgtggtgaataggaagccccatggctttcatactgggcctgggttctgtctgtgtgaccttaggcaagtcccatgacttctgaatctcaagctctcctgtctgtaaaataggaacgagactgctcacacctgcagcattttgtctgtcagtccgtgctgatactacgaaaagagtctgcctggcagctgcccctagtgagggtccagtagcatttatggcac

SEQ ID NO: 19607 - DNA, 1027 bp, Homo sapiens
atgccaaacagacagacgtgctctcagaagaaaactggaagtgggttagagagaggtgggggtatggaagaggtgacttctttagatggggtgatcgggaaaggccttcccagagagggtgacttttgagctgagtcttgaaagatgagaaggccactgtagcctggaggagtgttcccggcagagggactggcttgtgcaagagccctgaggcagaatcgagcttggtgtggtcaagggccaggaggaggctggtgtgcctggaacacagtgtcaggggaggatggttggccttggggtcaaggaggtaagcaggggcatggggctgttttttcagtgctgggccgcaggagagaattaatgcaccaactcagcaaacaggtgtcctcctacttccccctccgccctcctggccgggtttcgtgccaggcactgttctggaatataagagtgaatgagagatgtattgtgctccagaaagccagcttagtgggggagtttgtggatgagtaaactcatagaaggtgctggtgaggtgtgaatgaaggctcatcaggccgcgcagctgactcatctctgtactgaggtgtgtagggacttgggaaatgtgtcttgatttgcacggaactgtgctctgtgctgtcagccttcaccgtggtaactgaaactcagttctctgatgtaaagcctggcagtcccggcctgcttgggggcacctggacccctgccagggaaggggtcctcagacttgaggttgccagctcagatgtggggctgctgatactaggtatgagtgtctaggctcccagttatgggaaacaagaccaagagacagccatgggaaacccccttcttactgagctgcctgccctgaccctttctcccctgactgcggactctgatttgtggctctggttgggaatgtagatttggggacattgtgctcctcatgggtttcttcccgtaggatggggcaaagaaggggttatgagattgagcagatgcttctgggagtctagagtgtact

SEQ ID NO: 19608 - DNA, 1025 bp, Homo sapiens
acggggacagcgatgcccttccgtccaccccatccttacaggggtgttcctcctgaggcaagaatgcaatagaaaagcaaaacagaatgtatgaggctatttgcattatccataatacagaaaaaaatgaaaataaggtagctgtccagtggtaaggggaggtttggcagaccatggcacagcatgcgatgggtgggtcatcacacacacagatgtcagtgacagaggctgggtaagaacatgagcatattcatactgttacatcgaggaaaaatacacagtatttaagattgcatgtatgtggcatttgtagtcctgtaaatatgtgatgatatgtatgcatatggggaaaactagaggtgaaattgaaatgagttatttgtggtgggactgtttttcttttgcaaaaattcctttattattgctataattgcattccttcatttattaaagtaatgaatatttgagcacctcctagctatcaggctctgagaaggtgcttgggtagagcagtggactggactgcacggctcctgccccggggggaccatgctcagtgagcgattcttgagcccccaccccttctcagcgctcaaggattgaaggctaatgaagtggtgcaaaattcaaactttctggaataaaacggagagttggtcctccaggttctctgcagggcgcttgttgagccagtcccagattctgctgagaaacagggaagtttccagagttgccaccccctcctgagggtagagaactcaggggtagagctggcttggcaccaaaagggctccctgagtcttggctgctgggacttgagcagtgctggggcgctgccggtgagctgtgatcccatcttctcagggagcgcccctgcctgtttgactgtggtgccgttggtatgagaggttgccccaggaaggagaccgcagctgtgggctcatctcctgggtgcccaacactcacagggtccacattgcccgtgatgtgccctgggaagcccatggttgactcagaaggactga

SEQ ID NO: 19609 - DNA, 1131 bp, Homo sapiens
atgtaaggggagcttccccgaggcatggacagaatgggtcaatagtggaggaggagcagcagcttcagggaccactggaatgaaggctggagtaagttgccagggctttggtggcatcctgaagttcgggatggtatagtcagggacttggcaggagcaaagactgctgtgggcaccacgtaagagtctggtgctgcctactgaggagaaaggagtcagggtcttgtgggtgctggtgagctggaagctggtccacaactgcacctgccacaggaggactaaataaaacaagaggcaagtgatggacgaatggagtggctgtccagttacttcgtgtcactctgtaaagcatactaggatcttcttaaaagggatggcctcaggttataggcagcatgatggctagttttaatgaatttaatgctggcttagagccaggggtggggtacagcccagagggtaggttattgcaagtcaggaccagaggtggtggcccagttgggtggctggatacatttagagggtgtgggcaagcctgtggctcttattcacaggattcactgcctggaacagtctaggcgtggctggattttgggctttggatcgcaaaagaggtagaccctgcccactgccatcctgcttgtaccagtcaagacagcttagggtgtgggttgcaggagtcattattttgagaggtgcatagagagcattagattgaggttggaatcccttctttaaccacaggattcaagaaagttacaaaggctggtgccttggtttcttcattgtaagatgggaatgatgaagtacacctttaagtcttgtgggtttcacatgagaggtttcatgatttgtgagtgacggcaaaggatgagcagtgacttgtcatttggctgaggctggactcgatggcaggcatgcaggtgagcatccctgagccagtgagtgagcccagtgtgctgtccagcacccacatcccgatgtagctttgtttttctttactcaatgttgaatacacagtacatcccatcagaagtctggaagggtctgtagtattttcagttacacatgattgtattttgtggagggaatgatgtgctttagggacattgccagctttgggtttgtgtg

SEQ ID NO: 19610 - DNA, 1032 bp, Homo sapiens
ctgatgtggtagcagtggtttcattattatgggtctcatttcatgctcacatctctctagccacaggagttcttgacctggcgtctgtggatagaattcagggggtccatcgatgaacgtagatggggaagaaaattgcacttttattttcattaaccttaactggaatttagcatgtcattccacttgattgtaggcaatgaggcacagttatcttaacaaacacctgtgactcggtcaccagtaggaatcacagttgtggagctatctgaaaaagcagtttccacttgtcacaactttaaagttatggcagttattagatgcactgttggatgtttaatactttaataaagaagcttttatgactctatcacaggttttttttgttttgttttgttttgtttttgagacagagtcttgctctgtcacccaggctgaagtgcagtcagacaagggatactcagcctgtatctcaatatatttttcttttttttctttttatttgagacgatcactaaggctggcaggctggggtgcagtggcatgatcttggcttcctgcaacctctgcctcctgggttcaagtgattctcctgcctcagcctcccgagtagctgggattaccggcgtgtgccaccatgcctggctaatttttgtatttttagtagaggcagcatttcaccatattgaccaggctggtctcgaacctctgattttaagtgatccacctgccttggcgtcccaaagtgctgggattacaggcgtgagccaccatgactggctgtctatcacagttttcagtaatttgataaatgtgtttaaatagaattgatttcctttataattcgaagtgtgtcgttttatacatttcaaagtattgttctgtccaggtgcgatggctcacgcctgtaatcccaggactttgagaggctgaggtgggaggattgcttgagcccaggagttcaagaccagcctaggcaacatagtgagaccccatctcaaaaaaaaaaaaaaaagataaagataaaaaaag

SEQ ID NO: 19611 - DNA, 1072 bp, Homo sapiens
tattttctcaatgacactgaccactttctggagtgacctaaccgatttgttgtctgtggtctgtctgctccccctgggatgcgagcaccatgagacacggccttgctgtttgggtttgtttgccacaaaatccccattgagtgtcgggcccaatatggcagttgcttggttgcgacagatataaaaataaatacctatttatttactgaataagtagatttcatcatgacatggtggatgtctccaatagcccagggtttggccccaagtgggtggtgacacaggttactcttagctctggctttcagttaagtcctgcaagagaggccagtgtagggatcatagccccaaagaacccccttcccagctatgcctgctgccatgagtcacctccatgagtcacctgccatgagccctgggagagttggtgcccccaggggagatggccctctccaggaaggctagggcaagtgacccaaagatttcttagatgcagtagcactcccctcttcccatgccaacgtccttttcattcatgaagggtttgtgctgccaggagcctgagcagccctttcctgggaggcctctgctatctggttattgagctgcactggtggccacagtggggtcctggggcccctgagagcctctgggttcttttgcctcaaagttgacacatagcacatctggcgtgtcatgatgggtacactgatgtgttgtttaattatcccaacaccctacttaatagagaccattttccccacctcacagttgaggaagctagcactcagtgggtatagaaactcaccagggtcctagagccacagaggagtagagccgggtgcccctccacacctgactgtgagtcctccgtctcaaccacttctctctccttcttcttggaatgcctggattcaggcacctggccaagccctttcaccttccaaagcttcagtctcctcctcttgtgaaatgggaataacccatgtgctgcttgctggcacaggcagttgtgaaagtcaagtgcgggggtggaggaggaaaaattaacaatttcccacctctctcttac

SEQ ID NO: 19612 - DNA, 1050 bp, Homo sapiens
tctgctcttctgcagagccccctgtcctggcacagagcatacatagtgtgttatgtgcctgtcatgcccattcgactctacaagcacaaggatgggtctttttaggcctttccacccagcatccagcatgtgcttgaatggctgtagctcaaacactacagagccacacaagcctcgggggcctcaggcacaggatcatggtaggggcagcccacagtcactcgaaggctggtgtagaaggaagtggctgttgatccctttcttcctggatcttttttcacaagccccagagcactttgctgttggatgctcagaatagcccctcgtcccaatgtttgaattttcttaaagtggagtttttccttccttcacacacccagcttccctttcctaactcttaaagattggtcaccccttcggtttctgaggtcaccccacttttggggtgggtttcctggattgctcccccaagacctgcccataagagccctgcacgagccagttcctctctgggctgtgcttcctcctctgtaaaacagagatccaggttgagtatcccctatttgaaatgcttagaacaagaagtgttttagagtctgggtttttttagattttggagcatttgcagtatgcctacctgttcagcattccccatccccaaatccagagtgctcccatgagcatttcctgtgagtgtcatgtcggtgctcagaaattcccaagttttggagcgttttggattttggattttcagattagggatgctcaacctgtggtagtatctgcgccgagggcctcatggttggctagataatgtgtgcgcatgagtgagcggcctttataaaccaggtaaaggttggtagttgaagccttcccttaagaaacagtgcagcctcacaccaggtgttgaacatctctggcccctagccatctcccctgtgaattccttccagccctgaccatctgtgactccacgtcttggtccacaggaggggagcacaaggaggactccagttggagttcattggatgcgcggcgggaaagtggctc

SEQ ID NO: 19613 - DNA, 1044 bp, Homo sapiens
tggcctgctgggctgccacggtaaagcagcacccctgggaaggcggtgccatctgcctgatttcgctagactttagccatctccagaaccccacctgatgtcctgggatcccactcttcaggaaagggacattcctggaggcagaaatgtagcgcagctctgaatgaggccccaaaagatgggagatgcagaagcccctttgggaggagaggacacctgggcaacccttgaccccctttcccacccccacctccaggttgggagcacgttcctgcacgtggctatgctgtggggcctctctcatgagtcagagcggagggagacagctgtgcctctggagtctgcttttaattgtctggaaatgcagagatgtctggtttttgcctgagcaaaataggagtttatttttgtactatcccgagctggctaaggagagtcacgtagctgtgggcggggtcttggggatgaggaggggtacagcaggcagggactatgctgaagtggagctggctgtaggaaccccagggaggcacagggggagcatgaagaggagctacacttccctcccttagtgcccgggcagaaactcccagggcccttcacagaaccttggaggaacattcaacacccccatctctaggacagccccagccttgtcatcctccaattgctgtggtaacacggggactggagcagtgagattattaggccttcagggccagtgtctccatgcagatcagatggaggcggtgcttggcacatacaccacctcactgcccatgcccccagaagttggtgcagatcataaggtggcttttggggctaattgattgaagttccaacatagtctgtttctcctaggctggtagctggcacctttggccccatgtgttttttaattattttttcttttgagacgaaatctcgctctatcacccaggctgaagtgcagtagtgcaatctcagctcactgcagcctctgcctcccgggttcaagcaattctcctgcctcagcctcccgagtagccaggattaaaggtgcct

SEQ ID NO: 19614 - DNA, 1047 bp, Homo sapiens
cccgctgtgggaatgcctctctgttcccccaccttgagcccttgtcctgcctgagagcacagaccagctgtgcatatcctgacagaaaaccccagctcatttaggccctttatgactgtacactgataaatctcactgtccctgaccccccggctccctgcccatcaccctgttcacacctcctaccttagccaaggttaacatggttgtttagaagcatggtaacattaaaagagcatagaccggtctgggatcagatctcagctctgcttcttcactgctgtgtggcttggagcaagtgactttccctctctgaacctcgatttcttcttctgtaaaatggggacaatatactgcatggaattgtgaagatcaaatatggggatttaggtaaatcatccagcccagggtggcacctccgtcatcgttgcacatcttcactcctcctgatgtgtcctccagggcatgggatatcttcatgccaagggcatcgtacacaaagatctcaaatctaagaacgtcttctatgacaacggcaaggtggtcatcacagacttcgggctgtttgggatctcaggcgtggtccgagagggacggtgagttggtcttgagtgtctgggtgggttgtgggtgctggatggggaagagcagggctgaggtctgggcactttcactgtttgttgctgagctgcagccctccctgcagggaagcccaggtcgctttggtcctgccctcgtagttctggttcagaatcagatttgggtcgcgtttggattctcaggccgacttccacggaaaccaggtccccacactcacatttgccctggctgttcacccgcttggccaaggaaccaggtcatttccccacgatgaggaagagtgtcaaattttatttccccaaatcttgaagggattggcatagggagaaaggcccctcccctcacatctaggggaacccaaaagggagcatggcagcaaggctgcaaggccagccccagccaagtttgagatccacaggcagatcagggttcctggttagagaggcg

SEQ ID NO: 19615 - DNA, 1034 bp, Homo sapiens
caccacacctggctaatttttgtgttttttggtagagatggggtttcatcatgttggccagggtggtctcaaactccaaacgccttggcctcccacagtgctgggattacaggcatgagccaccgcgcccggccttcgggccctgtcttgataaagaaccaaagtgggccccaagctgcagttgaggagaaactcagcatgagttttctctcctgcagaagtcactaaagaaatgcttggttcttcactgattcaggccaggtagagggatggtctggaggaacgactgtgtggggttagggaataccatgtctcatgcaatactgggttcagtattttgctcttaggatgggtcggagtccagtacaactgtggggtaatggatcgtagccatagaggtatacattttaggcagccattgctgcacacctgccgcatgcctgcacacctgccgcattgctacacagatggccgaggccagggttccaccagcaaggagattgcagtgtcctaaagacaaacagacacactgtaatgaaacctgcacacatcaggactctttcttgtcacctttgtattcctggctcctagtacagtcccaggaacattatagttgggcactaaatatttaatgtgcatgaatgaatgtgagcaaagggtgataccatgccaagtgctgtgataaagcccagatgggggcctctgcatccacctgggggacaggaggaagagtctctggaagaaggtcgtcagggctgggttttgagccagaactatcccagcagagaccaggagcatggggctcttagcagttcaaggagggtgatgtgaggcagcgaggccaagctctaatcagaccgtgggcaacttgcttaacaagctgggccctggttttctccgtgacgaaagaaaaggctccactaggtggacactggcattcagaacatcattccagattccccaaaaaccatatagtcccaccttctcatttcacaggcaggaaactgagtcacagatggggctgttccctgccc

SEQ ID NO: 19616 - DNA, 1046 bp, Homo sapiens
ttgtttttattgtagttattgttggtagaaaaatcaagctgttgtgttaatgtgcatggaagtgtcttcatagattgtcagatttatcaggtgaaatcagcatgcagactatttttggaggcatgactctaaataacgtagcgtgtcccctcagttgtactgtatgtcagggagatttgaaaatggttgaatttaaagccaaggggaaaatactctgtgctgtcctgtcaactaattaaaaacaaataaaaataatacacatttgtatggactttgtaggtgttttagtcagatcatctgcactgttttagaaagtattatggatttatatactgggaaattaattttttcttttcagaatgtaacaaatgaaagacatccttattgtcgaagtagagattcactttgcttatgtttggatgaaaaagtgtgaattgctaaagatcccagtgaggtgggagaaatatagtgatttaacaaaaaaattactcagtataagcccttgtgcatggtagagattgtctagcttgctcatcttgtgaacatgagaggcatctttttttcttatgttttgtctggtcctcttactccacataacaaactaatttggaaaaatgcagaatgcttttgggatatgtttggggaaaatcctggagtaagttgcatcagaaagagtagtatactaaagggtattttgttattaactgtgttttacaggttgagaatctgtagtactgagaagtttctccactatcagccgagattaacagccacagctggattctttgggggctctgctttgtgaaaagagctttgaagaagcagagcctgcaccataaaaaggaaacggttgctcttctagacataacaaagcatccgtatgaaactagaaatgtggaaatctgtattgttaattttaactacaaacgaacttacttttggaaattacaggttcatgatcataaagtagataaagagtagagaataaaagtaacaatctgatgattctgcacccacttcttggtggttgaaactccatagcctat

SEQ ID NO: 19617 - DNA, 1030 bp, Homo sapiens
tttttgtatttttagtagagacggggtttcaccatgttggccaggatggtctcgatctcttgacctcgtgatcggcctgcctcggcctcccaaagtgctgggattacagttgtgagccactgcgcccggctttttttttttttttaaacaatggggtaatagattactaaactaaacttgttaggagacaaggttctggtcctagccttgctgccaacaaccctgtgaccttggtaaagttatttaaactttctgagccttggttttctcatttataaaatcctgtgtttcctaagattctattataaaatgatattaatatttgttggagtttgctggtgaccacaagacaactttctctcttcaggactacagtgttgaatagcttctaaaattgtttaaaggaggaatgagataaatgtcaccctgttccagagtggtgacttttatagagttttctaatttgggattagattttaaatgttcatttttttttcatcaagagacttgttttcttctattactgagttattggtaaggattatacatgtagttcagctgtggagaagagcaggcctgtttgcaaatgagcaatttcttctacatgtccatttgatactactattttcctgataatatttacctttttagtgttttagactttaaaaacttgcttagtttcttataagtcttacaatagttttcttacaatattttgagtgatttttaaatttttaaataaaatttaatgttcagtattttgtcatcttttgtgtgtgagtaatcaggtaagatgatttgggagccagtgcttacattaatttgcaagtttctttaaaacaaatttctttccaggagtctcttttaaattctgaatttggataagagagttactagtttgcatgtgggcctcccagaaaatgagctttgacacagctttcaggctgtagtagtttagggcttacagtgcccaaagagggagagtgacttcctaaagctcttgtccaagaggaagggagcatttttgcag

SEQ ID NO: 19618 - DNA, 1067 bp, Homo sapiens
cctttgttgggccttcagtgttctctagcaagtcttagacttgtctcaagtcagctcatttctccactgctcacacagctatttctaaccactaccactttcctcaagttcctactccacctcttcctcagtttctacagatgacttcattcccctatttcacagagaagataaagccaagggatgcaggaactgggtaacttcctgttacacccacagacgaagttatgtcaacgtagctttcctttacttttcagtctccagatcctgttctcttccagtttttccagaggctttactccactattatcttctttcaggtgttcaacctctgcccctctccctttcctcttaccctgtaaacttactgaaacctcatccctaaattcaaccctcatcctctagattaccagtctaacctctttctttcccttcgcagccaaggtccttgaaaatgtagttgtccatcactgtctctgcctcttcatctttcatttattcacagtccactgtgcagtcatttctacatataccatataccatacagcccaaactgctctgacaaatacatgacctgttattaactagcagttaagtaccaaatccagtgggcacatttcagtccttacgatttatgttgcatgtactaatagtttgttcttgttcattgtattaatatatcacaactttaaaaccctcttcacctgttgatggacatttaggttgtttgcagtttttggttattacaaataaaattggaatgaatattcatttacaatatttctgtggacataggctttcatttctcttgggtaaatacctaggagtggaatgactggttcaaattatatgttcaagcttaaaagaaactaccaaactgttttccaaagcaatcgcaatttgcattcccaccaacaaggtataaaagttccagttgcttgtgagcatttggtgatatccaattttttcttcctaattttagccattttaataggtatgtaatactgtttatagtggttttgcatttccctaataactcaagatgttgagcatcttttcaagtgctt

SEQ ID NO: 19619 - DNA, 1082 bp, Homo sapiens
catttttgttgttttgttttttaaaatactaattttaaagtaaaatattaattttaaagtaaaatactaattttaaagtaaaacactattctaaaatactaattttacctattctcacaacatccttctttaagaagattttttcacccttattgaatagccttgctccactgtggaaaatcaattgactatataaatatagtgaaattctaagcttttctgtttcattagtcttttggtctagtcttatgttaatgccacactgtctttatatactgtagctttagagcaggatttttccatctcagcactattgacattttgggcctgatagttctttgctgtgggagggtctcctatgtattataggatgttcagcatcatcccttgcctccaccactaaatgctagtagccactcagtaggtgtgataatcaaaaaatgtctacagacagtaccaaatgtcccctagggaacaaagtcaccctcagttgagaaacactattttaaagtaactcttgaagtcagatagcgtaagtcttccaacttacttgttttaattcaagattattttggctactctagaagctttgtgttttcatatcattacagaattagcttgtcagtttctttaaaaatctgttgggatatttattggaagatgtcaactctgtagatcaaatagaagagaatttttaagaaagttgagtgttccattccatgaacatggtatagctctccacttttttttttttttttttaacagcctttgtcaaccactctgatctccatttattatagtctttaatttctcttggcagtgtttgggagcttgcattttagaggccttgcacatgtttagtttatcactaagtatttaatatttttcgatgccattggaaatggtatttttattttcagtttcactgtccaatgtcattgactagttgtaggcactcctgtcctgccttcaaccttacattcacttaaggcaccatgttacttgagggcgatccctctcagcaatcctgctgtatcctacgtgaaggcttcatcagaaagaattggcagaacaggtctgga

SEQ ID NO: 19620 - DNA, 1021 bp, Homo sapiens
cactcacttcagatgttcttctctttaggtattctccccatctggctcaactcctacccctatatatacccccggtagaatgaattactcttttacgtttgtttctatacttctttatatatatatctttcttaaaggagaggtatccctgtagacacaaagatagagactgaattctatttatttctatgttcctagcatgtaatatgcattcactaaagtttgttgaattgagttttcaaagtctttataaccaactcttgaaattttaagcttctagctaggactgttataacttaatttgctagttttagaaaataacttttaaagcaattaaagcttattcaacacgttgaagataaaataattttatttggtatttggtaaattccttgggctagtcctatttaaggatggattaaaatatgatagaagtgttatcttacaatctccagatgggctggggtgatgtaattttggagcaaatgaacattcacatcccaattctaaatctgagctcattttaaaattatacacttgcgggatgatctgtgccacaaaccatgacacacatttgcctatgtaacaaacctgcacatcctgcacatgtacccctgaacttaaaagttggagaaaaaaattacgcactttgtatctgtaacatcaaggggaatttttgcctttgggttactatttttaaaaaatttttttaaatggatacagtgatagattttagagcataacagttacaaatggagaggtttcctaaatgaccttgattactttgtgtgtgttggggtagggggttgaggaggttgtttttctcctgttgcctgaatttaaatgttttttctatggtgaattacataattatttcgtggccattatatatttgtcctgcagttttttattatttttttacgaaaagagatctaagggcctttaggtgtccattggcaaagctgattttataaatatgtgtttcttttgcctagcatcttttcacatatttgaagatata

SEQ ID NO: 19621 - DNA, 1052 bp, Homo sapiens
gtcccttttgtatctgtgacagtgcctaacatagcaccttgtaggtgattgataaatatttgttgaatgaataaacatgtatcatccttctttgaaaaatacatgaatttgtggagactttgattactttttaaccaagtatgtttttggaacagagaagagtattatttacattatactgataagatgttgctgttatatcacattcagaaaggcaaagcttcctgtactagattacatagatttaaaatatagtgtctgagcctttgtagtgaatgctacccaggagtttatatcagatgtctaagttcccagcccagaactcctaaacccaagtcacagcagatagagacatccatttttaaaaagttctaacagtaactctaatggattgagggtacattttatgatttttgttgttgttgttggtttatatgtttgtttttagtgtcaaagaaaccattctttgacatggatttataaatatttgacattttgaacataagtcttgtgaacattgttttaaatctctggccattcaatagatgctgctttatttttctttcagaggtgggattttcgtagtcccagctaaccatgaaaattctttgtatgacccttaaataatatataggtatgaagacactatacagaagtagccacagaggagtggtttaagttatgttgagtagtcctcaaaatctcaccccactcccactagatagcagacttccatgagaactgcttgtgcctaccacaaaacaattatgaaaggaatgagccatatcatgatacagctgtgagggctgtgtggaagacccattagcccagtattcaagaagactaaggcccacttgagttaagtatagtgggtttaacgctggactcagaggtagcaacctagcttgcctcctaaattctgcatttaatagttgcgtgactatgaacaccttcttttaactacctatgagtattgtttcctcatctgcaaagtgaaagtaaaagaccctacgttacatggttattgtaaagattaaatgagatagcctttg

SEQ ID NO: 19622 - DNA, 1027 bp, Homo sapiens
gagaaagcaagttatatataaaagcttaggccagtgtgagccatttatgtaaattttaaaaacataaaacaaccatatttttatggctacagtcatatgtatcaaaagttaaagtgtgagtatcaaggattcataccagagccagaataatggtaaactgggacagattcagttaaagatgcagtctttggatgcatctgtagtagcattatgtcttaataaaatgtatctgaagcagatgtggtaaacacttttatctgggcaatgagtacacagcgtttaatttctacatttacacacatgtctaaaatatataattatatttatatatatatatatacacacacacatatataaaatcattgatatgaaaaaggtcaatacagttcttatagcttctgttgcttcactttattagatataaaataacccccttccacatagttaacatttcagtaatctaccaaataaaagttattcccagagatgtaagacctgtttctttagaatgtcatgaccagaatttccatagtaatctctaaaacgacactccagtgagacagtctgatctgtgggtcatttcctttcctgttaagagacctttgttaattccattttgcagtatcccagaagaaacattgcaggtgtgcaaccaatccaactgaaacagataatactgggtaatgttcccttcttactcttcctttttattaatgcacttattacccatcttccaaaataaaaagtctttgtcatactggcatctgatttttttttcttttgacaaccagcctgtcttctgtctcctgaattttattttaacatcttttaatatgttgccaggtaggcacccctagttgaacaagaaagacctggaaatcattagagctaacaatatacaggtttttcttaaatgtgctgccaaagggcataacctctttggattggtgacatgtagcacttgcacagcagcttttcttcccatttctaatggtaagaagtaaaatagccttctgtcaggaccaac

SEQ ID NO: 19623 - DNA, 1052 bp, Homo sapiens
accttgggaggccaaggtgggtggatcacgaggtcaggagttcgataccagcctggccaacatggtgaaaccccgtctctactaaaaatacaaaagttagccgggcatggtggcgcatgcccgtagtcccagctacttgggaggctgaggcaggagaatcgcttgaatccaggaggcagaggttgcagtgagccaaggtcatgtcactgccctccagcctgggagacagagcaaggctcccgtctcaaaaaaaagcaaaggggctaaaatgtctaatttcttaacctgggtggtatttacatagaaatatgtgtgtatataaaaatggatcaagttatactcaggatttgtataccttatgctacaactctataaaaaaaaataataatgatatagtctctaccgtaaagaacttagaatctattatggggagagagtgggaaaagagtagctcctttgctaaatgggatttagctgtgttccttatattcttattcttattcttattcttgtctttgagtccttggcagagtagaaactcagtaaatgttgattctatgaattaacagataaatttcttgtctttatagttaggattgagattattcacaggaattattttattgataaagggctgactgagactaagctattttcttatgtaaccagtttatagtgaatcttctaacatcatggaggttaaaatcctaaaaagcagctaacataatgagcttttgtgtttcttaaaagatttgtgacatatgcagagacactgttaagaaatgtgtttggtaatgactatcatttaaagacataactttaattcattttttaattagacaagtctgcttgtatttttttgtatttgaaatcctttgaagagtgtggtatttgaggatacttcaactctttataagccaaagtctttacaagcacgtatttatatcttaaggctaatctcacatactttattccctcaaataatagtggggcttatagagaatctctagctatttaaatggggtgtcaggcatgaagtctggagtttcgaa

SEQ ID NO: 19624 - DNA, 1046 bp, Homo sapiens
gattacttcaggcagaaaaaaacgataaggaaactgtgtggagaaaagacatttcagttgagcattgatggatgagaaggatttggacaggtagcattgaagaggatagatattccagatggtgagagtaagtatcaggagcataattagggaatggtaaatcatctagttggccagagtttgatatgcagaaataatgagaaattaagctaggtggggccaagtcatgggggattttgaatgttgaactaaggaaattggtctttattcagttgacattgggccccaatgaaagatttttatgatgaagaataacagaatcagaaatgtactttaaaatcttaacaaggagtttgtatttgataatgaaaaggttctggaaatggatagtgctgatggttgcacaacattgtgaatgtgcttaataccactgaattgcacactgaagcgtgattaaatgataaattttgtgtgtattttaccacaatttttaaaaaacaccataacaaggacctgactgttggagctgagaggcagtgactgtcgtgaaagaagaacagaatgatgcttggcattttcccagatggtttttcatgatgctcaatgtttgttttatgccctttctaactttaccctcagcaaagatgtaccagcaggtaatacaaaatatggttgttgccattacctttaaggagttcatggtttaatagagatgatagacagttttcaaataattatagtaccagaataatcaattttacaatagagacattaaccaaattgtcttatggataaaaaaaaaaaacctgccctggactccttctctactcccctaccccaccccccaaaaaagagctgggaagacttacctgcaacttaataattttcatagaataaaacatgttcagtagtccttcctgtatcaattcgtgtaagaacagttacatattagtaggataagtatattttcaatatctctagtaacactttcatttttccacaaaattttaatccatgtctaattcctgttcatgggtccgtgtaac

SEQ ID NO: 19625 - DNA, 1047 bp, Homo sapiens
tttttatattttttagtagagacagtgtttcactgtgttggccaggctggtcttgactcccgatctcaggtgatccacccacctcagcctcccaaagtgctgggattacaggcatgagccaccgcacccagccaaaaggagcttttttgagtggttgccagtttctttgttccttatattcttttgcttttttccctggggagaatgttggaaagaaataggggcacattcatacattttgaaaaaggccatggactttgatatcaggcagctctgagttcaaatcctgattttttttcctccacttactagctttttgaccttcaaaaagttacttgatactcttccctaagcctcagtttcctcaatgataatggagatgatattcttactcacagttattttaaaggaataaatgaattaatgtacgttgaacatttggcataccacctagcatgtattgatgttttaaaaaaaactcatttcccctcctccctcatataacgatgttgatgatgatgatgatgatgatgacgatgatgatgatgatgatagcagctaccacctaaatcgttttctgtgtgccaggcatttatatgtgattctaaatcctagcagtaactctgtgtagtaggtgttcctgtacctgttttataaatgcaggaacagactcagagaagttatttaacttgcctaatgttatcaagctactaagtggcagagtcaagattctaaccttggtcattttgattccaaagcctacaacaaacacaccgcctcccactgctgaacctgttaactccttattttaaaaatcaatttccaggccttctccctcctgaagtagaattgttttgttcttacctctttttttagttttctatttttgaagtttactttatcttttgaaggacagagtacaagaacgagggctgtgatctagtgccacgtccgctgcacactaagacctttgactaatttctttacctctctaaacctctttgctctgtataatgggaacccataatgggacttacttcttacagt

SEQ ID NO: 19626 - DNA, 1050 bp, Homo sapiens
ccagcactttgggaggccaaggcagatggatcacctgaggtcaggagtttgagaccagcctggccaatatggtgaaaccccttctctactaaataatacaaaaaaaaaaaaaaattagccaggcgtggtggtaggcacctgtagtcccagctattcgggaggctgaggcagaagaatcccttgaacccaggaagcagaggttgcagtgagctgagattgtgccactgcactccagcctgggtgacagagtgagactccatctcaaaaaaaaaaaaaaaagtttcaaagttcagtgccctatcaaaattttgatgttttgttttactctttcatttgtatttgcttgataatgttttgattgccttttctgtctagatttgtgattttggattggccagagtggaagaattagatgaatcccgtcatatgactcaggaagttgttactcagtattatcgggctccagaaatcctgatgggcagccgtcattacagcaatgctattgacatctggtctgtgggatgtatctttgcagaactactaggacgaagaatattgtttcaggcacagagtcccattcagcaggtatgatttcaatttaaggctttagttgcaattctattgcagatttgaaggaaaatccatcttgcacatgtgtcttgggcttattcattatactgtctaatttgcttttaggaaattcaggttcacttaaaattcagaaagttataaagttgaagattacaaagagattcattttgtaacttatgagcctttagagggagtattgagtttatttatgtatttatttattattattattattttttgagacggagttttgctcttgttgcccaggctggagtgcaatggtgccattttggctcactgcaacctccacctgccaggttcaagcgattctcctgcctcagcctcccaagtagctgggattacaggcacgctccaccacacctggctagtttttgtatttttagtagagacagggttttgctgtattggccaggctggtctcgaactcctgacctcagg

SEQ ID NO: 19627 - DNA, 1050 bp, Homo sapiens
aatatataggataatcctatatataataaataatatgttaaataggaataggatagataggaacttttaaataataaataggaataataacaggaatttatttaaattcctttacatgaggaatttatttaaattcctttacatgaggaatttatttaaattcctttacatgaggaatttatttaaattcctttacatgaggaatttatttaaattcctttacatgaggaatttatttattttaaattcctttacatgaggaatttatttattttaaattcctttacatgaggaatttatttattataaattcctagaaatcttttttaataggccagaaagtgaaagtaggggctcctgtcagttaatctagagcttgtcttaaggttttttcccccagatttggtccacttctctaaggctatgatttaagagtaatgaaaagttatttccatgagattactatctatctgtattttatttccttgtagttggatttgatcacggatctgttgggcacaccatcactggaagcaatgaggacagcttgtgaaggcgctaaggcacatatactcaggggtcctcataaacaggtgagaggaggggggaatctttttctggtaaccatctgtttgggcaagatttcccttccaatagagtaatctattaaggatttttaagcaaatgtattatctgtaggatttttttttttaacatcaaggtcctaagtaagaaaatgttcaatatttgtcaaactgaataaaatctcattcctaatgccgtaggagaaagtgcgtgtttgtgtagctcctttgctaatagatgacccttggctttgtgtctcctgatttattggtgtctatgggaaaaattactggagatggagctttgacctcaatgccataacctactacatgtatatcaagatgtcctttccaaatactgagccaaaatacctcgtatttcttattccagccaggactgtgaagctgttgctattgcactcttgccactaacacagaatcagatgtgaacgttgttagaaaagaa

SEQ ID NO: 19628 - DNA, 3657 bp, Homo sapiens
gtcaggatggttttcatgtgtatttgtttttttaaacaaagaatgatattgttgacagaaatgtcacatttgttcattcagcgaacaccctgagtgcctaccaagtgccagatacttattgttgctcctgacagtggccaacacacctggatgtgttatcttggaattatgaacagattctgggtaacacaaagaaggggctggaagagttgagaaaatttcagagaagggaacatttgagttagggatagtaagtttttattaaatgaccacctaggctgtgtcacaaaagccagctggacatgccatctgctgccggggtagtggggggtggctaattaatgacaggctcctccagtgtattttcaaatgagctagcgccgagcctgttgagggcaagtggctgtaattcatcatgatcgttttctttttcagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggttggtaaatggtgggaaaatcccatttttactcagaaatcaggtcccagaaatcttttgggaaagtatctccaaagggaaggggatggtccccatagtttgtgggagaatgctacaggatctggggtaaatagccagggtagatcttgtaaagggacattagtgtggctcaggctcatgtctgtggtcagcaggcctgcacggctgcctcagtcgtctggaaatcccttgcatacacatgaagcctgagaccacttaaacaatgagcttgttcccttttgttttgttccccaacagaattaatttctctttttgttggcttttatttctctgcgttggatagtatcatactgacttataagctgtagcatcaggctaatccctaatgtgcttctcattttaaaattattcttagtgttctcatataatcaatgcttttttaaaaaggtgaccatacacgtgtacttgataagctaaaaccactgaaaatgctcgtttcccattggcaccccctggggtcactgaatctgccttctgatcctctcacctatatataattactgaacaaacagatgccatggggcagggatttccctccccttggattttgtaccacacaggtttaaccggtaatggcagttttattgccctagagcttttccgagttatgttctgacccccattcttggttctttggcgagctgtcggtgagctgtcacgtaagtctgcatgttgggcagtgtggcacatccaggtttccagttccgagtttccacttggagaagggagtagaagaaagcaggcaggcagagacagtgggaaggtcatggacacctttgagtcatgaacagacctaaccatttttcttttcccctgactacctcaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccactgcctggtttgttttgtggactaggggatagagaatccagggttctctcatgaggagttaaacatatttcaagagcaacaggaaaaaaggtacatcaagccatttgaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattcattttgttctgcttctactttacacaaagcttcatattca

SEQ ID NO: 19629 - DNA, 2045 bp, Homo sapiens
tcagccaggcatggtggctcatgcctgtaatctcagaactttaggaggctgagacagaaggattacttgagcccaggagtttgattgagaccagcctgggcagcatagtgagagccctgtctcaattttttaaaattaaattaaaaattttttaaaagttcttctcaaccagaccccctctctggagataaaccactataacaagtttcttgtatatccttccagagagagtctctgcatatacaggcatttgcatgtatattatatagacatgtttgcaatatatatacaatcttcccctcctttggagctgggatttgaatccagacctgtgtaattctaaaatatctgcccatttcaccagacccacagcctctcagaccacagaagaactgggagctgggtgagtagttatcacaagagtgcagcacagttccactctgtaaaggtgccaggtgcatagggaaaagtgagggctggggcatcaggagactcaaaataaagtcctaggtctgaattgatatgttcctgagcaagtccttcccttcgctgggcctcaggtaagtcctctgaaaatgagagtgttggctggccaggggcggtggctcacgcctgtaatctcagcactttgggaggccaaggcaggcgaatcgtttgaggtcaggagttcaagaccgcctggccaacatggtaaaactctgtctctactaaaaatacaaaaaaaaaaaaaaaaaaaaagagccaggtgtggttgtacatgtctgtaatcccagctacttgggaggctgagacatgagaatcagttgaacccaggaggtggaggttgcagcgagctgagattgcgccactgcactccagcctgggtgacagagtgagatcctgtcaagaaaaaaaagaaaagaaaaagtaagggtgttggattagataatttccttcttatcttttgtttttgtttttgtttttggtagagacagggtctttctatgttgcccaggctggtctcaaactcctggactcaagcaatcctactgccttggcctcccaaagtactggaattacagacatgagccactgcattcagccagattaaataattttcttattttatttttcattttttgagatggagtctccctctatcacccaggctggagtgcagtggcacgatcttgggctcactgcaacctctgcctcccaggctcaagtgattctcatgcctcagcctcccaagtagctgggattacaggcacctgctaccacgcccagttagtttttgcatttttaatagagatggagtttcaccatgttggccaggctggtctcgaactcctgacctcaagtgatctgcccacctcagcctcccaaagtgttgggattacaggcgtgagctaccgcacctggccacattagatatttcttaaacatatcctggctcttacattctaggcatttatgcagtcagatgtctagaaacgcaaaatgaaggtgaaggatcttgaactctggagacaggcagatctgggttcaaatctcagctgtgcctctcagaaactgtgtgactctgggcatgtcatgtaccctctctgagttttggttttctcattggtaaaaggaataactgggccaggtgaggtggttcatgcctgtattcccagcgctttgggaggccgaagtgggaggattgtttgagcccaggagtttgagaccagcctgggcaatataatgggatcctgtctctacaaagtaaaagaaaacaaaacaaaaaaaatcagccagacatggtggtacatgcctgtagtcccagctactcaggtggctgagttgggaggatgaatttaacctaggtggccaaggctgcagtgagctgtgagcttatggcatgttccggactcaggtaggttctgcagtggacacaaaatcacatgcactatggtcactgtggtgccctttgggcaaggactccattgctggctaggcctctacctctttggcagtaatgtcacctgtggaggacatcactttttttttttagacggagtctcact

SEQ ID NO: 19630 - DNA, 1022 bp, Homo sapiens
cctgacgcattgtaggaacttattgaatactaacagaatgcattgatggatagctccatattgcatcttcaggttattaatcattaatcggtcagtaggaattggagttggggctgagggatgcagtagtcatctaagagacaggatgagacaagcagtcagctcagagacaagaatatgcccagagggctgggcacagtggttcacacctgtaatcccagcactttgggaggctgaggcaggaggatcacttgaggtcaggagttcgagaccagcctgggcaacatggtgaaaccttgtctctactaaaaaaatacaaaaattagccaggcatggtggcgcacacctgtaatcccagctactcaggagactgaggcaggggaatcgcttgggcccagaagacggagatcacaccactgcactccagcttgggcaacagagtgggaccctgtctcaaaatgactagatcgcatacaagttggtgtaaatgctgagccaggtaagcaaacatcttgcttgccacaggggtttggagaagggagagagcatcaaggtgtcaacgaaaagagtcagactctatgagcgaccatggcctgtgacacagccctcaggagaccctgagaacacgtgcccaaggtgatcagggcacagtttggttttatacatttttgggagacacgagacatcaatcaatacatttaagatgtacattggtttggttcagaaaggcaggacagctcaaagcaggggcttccaggctataggtaaattttaaatttttccagttgataattaattgagtttatctgaagacctgggatcaatagaaagggaatgtttaggttaagataaagggttgtggagaccaagttttattgtgcagaggaagttctcagggcagacttcagagggagtaggttataaaatgtttcttatcagacttataagggtgcctggctctttgttgattatctcctgagtccggaaagaaaaagaaaaaaatggggggaaggggattctct

SEQ ID NO: 19631 - DNA, 1013 bp, Homo sapiens
cagagcacgtggcaggcagccttttgagagaaagaaaagagtgtctgtgagctccatgagacttcagaccttgcctcattcatctgtgtccctggtgcctaaaaccatgcatggtacaaaggaggctctatgcaattgcaccaaaaaaaaaaaaaaaaaaaaagagagagagagagaggctgaggctgtagaggagtttatagaacaattgaatcaatgattaagcagacaagtgatactgatgaagctgagatgccatgcctgggagagccatacatatctagtagatttaccaggttagaggacttgactccgtttttttttttttttttccagtagagatagggtttcgctatgtcacccaggctggtcccgaactcctgagctcaagcctggagttcagtgcctgcctcggctccccaaagttctgggattagaggcatgagccaccgtgcccagccagaggacttgactctaattgttttcgttctcaaccagctaggtgatcctgaacaaaccattatccctttcttttatttatttaattatttttttttttttgaggcacagtcttgctctatcaccaggttggagtgcagtggtgagatcttggtcggctcactgcaacctccgcctcccgggttcaagtgattcccctgcctcagcctcctgagtagctgggactacaggcacacgccaccatatccagctaatttatatatatatatttttagtagagacggggtttcaccatcttggccaagatggtctcgatctcctgacctcgtgatccgcccgccttggcctcccaaagtgctgggattacagacatgagccaccacacacggccgccattatccctttcttggccagcctctgaatctgtgcgatgaataatttgtactgtctttggttttgtataattctggatgaaacaaatttctaaaaatttccaaataaattgctgcaggctcaggattcattccaatgctcagcagaaaggcagcagggct

SEQ ID NO: 19632 - DNA, 1960 bp, Homo sapiens
cttaatggaacccgattactagcaaataattcctcagaacaacgctttgaggtaggttttattatccccactttacagaagaggaaataataacacctattacgtattaagcatacactgcatgcaaagcactgttctaattacttgccatggaatgttgcgcttattccatggaacaatcctgaagacagggactatcattaatcctgctttatatattagaaaacagaggaacgagtgtggtagtgcaggcctgtgatcccaacactttgggatgctaaggtgggaggatcacttgaggccaggagtttgagaccagcctgggcaacatggtgaaaccccatctctactaaaaaatacaaaaaattagccggacatggtggcacacgcctgtggtcccagctacttgggaggctgaggtgggaggatggcttgagcccaggaggttgaggctgcagtgagccttgatggtgccactgccctccagcctgggcaaaaagtgagatcctgttcccctgccccccgccaaaaaaaaaaaagaaagaaagaaaagagaaaacagagactttgagaacctattatttttgcctcaggtcgtagagcctgtgtcagagactcagtgcaaaccccgatttgatgattccagagtgcagccctaactgctgtgctatgttttctcattcattcattcatccatctattaaatatttagcaagggctaactataagggctttgtgaaagatgctgagatataaggtcagtgaaaaatagatatgatccctcctcatgtctggcagagaagacaaatactgagtaatttacccattaattaattaaaatttgcaactataatatgttctgcagagcctataataggggaactgacttggtcagggcagtgggagacaactgccctgtgtaagagttgattgagctcagatcagaaaaatgaatgggcattatcaagggggaaggacaaggaagcttattttgtgtgtctgggaggacagggcaggggtagagtttgagaagtggactgtggccaaccacatagggtctcacaggccacatgaaggagtttggactttattctaagaccatgcaaagtcttgaagaattttaagtagggggtgacaggacctaatttgtcagatgtgcattttgcaaatattagctacatgaaagggcaatgtggagagtgaattagagaagacaagcgtggatgaggaaagacctggtgggggcttaaagataatggggattggaagagggtggtagtggggtggaggtagggaaaaatagtggatttgagaaataagtaaggagtacaattggcagggcgcatgatggatcaacctgtacgcaggagtgtgatgtttttcttctgacaccaaattgtttggggtttttcccacactaaccactaattctccagcttgccaacaccaactgggtatcccgcaattcaattcaattctgaaatgtcagtcacgaggcccaggcccccaggctgccacatttctgtttgatttggctacaaattcgggggtgcccatgacaccccgagattcaatttgccagaatgactcacagaactcaggaaagcactttacttactattagttgtttattatgtcaaccttaaataatgagattcagaaaataagactaagtatagagtttctttgagtgcaaagtttgagaatagccacccagtaagcattgactccaaaggcatggggtgagcattccaaactggagaagttaaggtttcacttccacaggcaaagagagaggaattttagcaggattacaacattttccatacaagaccagtgcgtatgttacagtgctttgattggttatagattgctacattccaaggaagatgactttattaccccctgagaaagggtggtgatctaagtggggatctaagggagtcttatctctggtgcc

SEQ ID NO: 19633 - DNA, 1034 bp, Homo sapiens
ggcctgggtctgggcatggggaggccgtgcctcaaagcccaccctaccccatgccttggtgctgtgcctcaggctccttcctggtctggcccagctggcttccccagcccctcagccatccagggctacccactgcttactcagggaccaggcagcccccatggcagtaaaagcagcctagacagaacctgcagctctgtggaaagaggcaaagtcctgaaaaggcaaagggttgtcacttagggcagcttctccaactttaacatgcatccaagtcacctgggaatgttgttaaaatcaggagatctggggtggggcctaggactctgcatttcttacagattcccaggtgagctgatgctggtggttaagggtagcaaatctctaaagcacgaagccctcacaaatctttgccatttcccaaacactccgctccatggtctccagtcatcagagcaactctacctggtattatcatccccattttacagataatgacactgaggctcagaaaggttgaggataagcccactttcctgtcattagtggcagccccagatccagacctaggcctcctggcacccagtccactggcagtggaattgctttcctgagaatcattctgaggctgggctattgcttctcccttgcttcaaagaatctagcagcgggggataggattttgcaacaaaaagctgacccagaggccatacagagcaggaatatcccattgccccctcctccactgggttcagagggtaagaaagcaccctccaataaacccaggctccaggccgtgggggctgctgaaggctctttccccgcaagggccaggtgttgacaccttaaagctggcgcccccagccccactcttggctgtgctggccaggtgactcctagttcttggccacatcatcagaaagtcaaaggtctcactccaggtttggggctccttccttccactcccctccctgccagagtctgtcttggccagtgccagcctcgatgctttggttttgaccccacctgatcct

SEQ ID NO: 19634 - DNA, 2119 bp, Homo sapiens
ttagcgcactggaggagcggcgggcttcagacaggtaaagttccgactggagagcgtgtttctcgcaggagtcaggtggggaaccgggctcctagggcctggtcacgtaagggaagaggcagtggggagccgtatgcgggaagaagggggagcctggccttccctgctctatggggggaagggggaggaaagcgctgtagttgctcagagtccgaaagcttttcccagcccagtgacacccggaacccgtgaatcgggtggcacgttgaatcaacaggcttcctggcatcccgtccttctctccgcaggtttttaaaactgggccacgcaaaaggattggggatggaagggacctggggcttctgagccaggatcaggtgatcgagttgtttgttctggggatatgaatcctgtggagctttcagcagctcggccatcaggctagagggcgatgccaaattccagctctttacatattgctgaataatacaaatagaactttttgtagatggttgcatccttcatccctttctaaagatcgaaggtcttgtagaagtcctaaagcccgtccattctctatagattcatttcctcaaacgtttgccagaggcctatcatgaacatcaaaattagttattaagtcaaaactccatcttctagtttctacctttctcctcaggcactcctttgaaccagctggagaagttaattttcctgggttgttgcaagaactgatacttatttcagagggctaagatctctgaaaatacttccgtggaaattcactgtaatatcaaaagtaacaagggtgtatgaagctacatcattaatgagcattagggagtgtaaacaatattgaatttgattaatttcttcggaaaaatgtctggttccactgtttatctggaagttaccagtttgtaagtcttcagtgttttgattacagaaacataactgctcttccatcagctgtgaatttagagcccttttttacgagtaatgtccctttcaccagtacaagtacatttttattcacttggcttgtgtggctgctagattggattagcatagccttgcaactctaggaggttttaacttcatcaggagattaattacatcagaaagtggtaccgtctggagaggcttagtcaaattttacagttcttcctctgaaagcctacctagtgtggtggaaacatgatctttgtaggcaaatacgtttgccctgattctatattcttgaccttaataaatggcactaccatcagtcctgcctgtaatccttgtcttccttcctgtccactatttcccaataaaatcagtcaccaaatcctgtctctccctgaaactgttcccatcagcatacaaattatgttctggtatccttcacatccctctccaattaccatgccaattttttaaatttccattcatagatttctacctgtaccaactcagctttctcaactttcattcactcttcattttataccaatctggcttctcttctgcccactccatttttttttttttttttgtggagacagggtcttgctctgttgcccaggttggagtgcagtggccccatcatagctcactgccacctggaactcctgagctcaagcagtcctcctgaggcagcttctagtaatcaagtgccaccacatctactttgcccactccattgaagttgctcttatcaaggtcaccagtgacttctatgttgccaaatccaatggatactttgttctcatattcctctgtctctgcaatattcaacatagttactcctgcctccaaactttcatcttggctttattgacatttcactcttggattttctccatttctccggctgttccttctgagtctcatttgctagcaacttttgctctctatctaatgtctaaatgctggggctggtcgcagtggctcatgcctataatcccagcactttgggaggtcgaggtgggcagatcacttgaggtcaggagttcacaaccagcctggccagcatggtgaaaccccatctctactaaaaatacaaaaactagccgggcgtggcgacacgcctgtaatcccagctacttgggaggctgaggcaggagaatcacttgaa

SEQ ID NO: 19635 - DNA, 1084 bp, Homo sapiens
aagagagacccatattattttgattgggttttgtgtgtgtgttgtgagtttattgtccagttctcttcctgtgcctgttctgtgtgtctattgtaatatataaaacgattttatggtccttattttcatatttctatctctaggagacattcaactccttgaaaatgaacaatccggccaggcgcggtggctcacgcctgtaaatcccagcactttgggaggccgaggcgggcagatcacctgaggtcaggagttcaagaccagcctgaccaacatggagaaaccccctctctactaaaaatgcaaaattagccagcatggtggtgcatgcctgtaatcccagctactcgggaggctgaggcaggagaatcgcttgaacccaggaggtggaggttgcggtgagccgagatcacgccattgcactccagcctgggcaacaagagcgaaactccatctcaaaaaaaaaaaagaaagaaaatgaacaattctcttcaaatccccagctcttagcagagtatatgtacattgtaggcattcagttaggtttgtggaaagaatggcatctgaaacctcaaccgaaaattgaacattccccctccctcctataccttcagttttgttttcttgagtttagttaatctcaagttcattggttatagtattgattgagctccgtaagggcaattttgaggagaattagagccacagaacttaaggcaccttcaggtagccattagccacccttctcttctctcccctcccactgccatctttaactgggaagatggcagcaatatgaaaacgtaagtagtttatttaacagacacttaacagttgctaatttgttagcagctaatttgttgctaatgtgttgcagcacacctgaagggatatagcttttctggtgcagaatcacagagtgccttgtaatgcctcttgtattgccatttatgttttcatgatttttattagtctctctattggatatgttctttatcttccagaagcttgtagtctaagtgagagaaaggtacatgggatatatcccatagaccattttactggatggggtgaggagtgatgc

SEQ ID NO: 19636 - DNA, 1227 bp, Homo sapiens
gcaaggattcacataagaagggcgctttccttaacaccgtgagaaaggagttcccttcacctcctctccctcccacagagtgacaggagtcaccagacactcttcacctgattgcagaaactgggggccagtacactggtctctcctgtccaccacctgcctcaccctcaccagggcttgcacacagtggctcactgttgctgtaatgtgctcactccgcccgcactgaagcggtggtcaggagagcctgtctcctgttctgctctgtctcctgctctgcctgctgctctgcctgcttctgtgtgactaacaggctggccttcctgaggtattcctttatctgagtccctctagcgcttaccctgaacctagaggacaaagtccagtttccttagactggcgtctttgtgtctgtgatacagactggtaatcacacttgcttctctgcctaagccctgcccccatccttccattggcctttggccatgtgcacttctgcttttatccctgtactggctttacctgatgcacagctcaggctgcattagtaggggctcagtggccagatgacaggaagccctagactctgtaccgtgtgccatcttgggcacatctggaatattgtgctcatttcttgagaagcctgttgactcaccagtgtgcttccagaggccagcagccagggctaagtggggctggaaactgtgtcctgtgtggaacagttgagcaaactggtggcgggggtgggggctctaaccaggaccaggtgcagcatgatagcttctggggaaaggagctgactctccttgtgtggcagaattaacacttacggaagagttaggaggcaggtgtcagcctaatagaaatgagaactgtgtactatgtagcattatctggttgccattgatagctggccttcattgagcacaacccagctttaggcattgtggaacgtgctctgtgcattctcatttatcctcacacccaccccataggcttcagtgctgtggtcctcactggacaaatgaagcagagattcaagtttggtaacttggtgcagcgtgtcatatgtggtgaatggcagagctaaaactagaactagaactggaactaacccagagcccctcttaacaactatctgctactctcagaagtgttgaacaagggcagactaccaccttccacagccactgcagaaagatgcctgctttaggggagttgcgattt

SEQ ID NO: 19637 - DNA, 1065 bp, Homo sapiens
cgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagttggtcgctttcgcctctggtatcgtgcatatgatggaaaagttttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggagg

SEQ ID NO: 19638 - DNA, 2549 bp, Homo sapiens
tacaaaaaaaattagccgggcgtggtggcaggcgccgctagtcccactactgagtcccaggctgaagcaggagaatggtgtgaacccaggaggcggagcttgcagcgagccgagatcctgtcactgcactccagcctgggcgaagcgagactctgtctcaaaaaaaaaaaaaaaaaaggaatttgcccctggcccgattctcctgcctcagcctcttgagtagctcggactacaggcgtgcaccaccatgaccagctaatttttgtatttttagttgagagggagtttcaccatgttggccaggatggtcacgatctcttgacctcgtgatcagcctgcctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctcccaggcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctgagcaaccaagcaaggccctttttaaaaaaaaaaaaaaaaaaaatcccctggacctttcagcaggggaaaaaggttccttgacttaaacttggtgtaggtttagcagtgtgtgtgagccttgaggcaggaattacaggctgctttagttacagacctttgtgtggacctgaggctttctaggacttgattgggggttggtcctcattttctgggtccctacttctattgggaaaggcaactagagtgcgacacgtggcagattaccttggtttaagtcttaatgtggcctgtggtgtttcccataagagaattggctttgtggcttcatggtgtcctctgggctaatgatggaaaaatcattattggaaaagaatgacatgaacaaaggaaccactgaagtgccggaggactggaggaggaagggggagggtgtgggggcagtgagggtggcagggactaaggcttccttctctaccctaggcctgatggagagaagaaggcatatgttcgactggctcctgattacgatgctttggatgttgccaacaaagtaagtttccttcctacaaaccccttaatgctcaccccttgggtgcaaatgatgcatatgttagcgaccaaagcctgatctttgctgattagtcataattaactgactgcacccctatccttgacaaaccttatcctcacattcctcattttgctttctaaaaataacattccagcttaatcttcatatttcaactccagtaacgaggctcccttttgtttttcagattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggattggctggctctctggtagcattttgtcctcacacacccatctactatgtccaaccggtctgtctgcttccctcaccccttgcccaataaaggacaaggacttcagaggagtactttcattagtgttttcaatagtgtgggcgcaggctcagaaggtggagaggctggcctcagaggacacccaggcttggggctaagtcccagtgtccatatgaagctgtttctggccttgtccgtttttgttgtcccaggctctgtgcccctcactcagtcaagaacttgtctttgtgttgcttcttggggacatgctcagggcagaagtcagagcggaggaggcgggaaaagtagattatgatcatcacgtccagcatgagcaggatacccagcag

SEQ ID NO: 19639 - DNA, 1040 bp, Homo sapiens
acttccgtgtcctgttgccatggaaacaccctcctggctgttcgatgtgagttgtaacttttcccacttcaccacacagcccagctggcccctgtccacactcccatccccagtgttcacagatggccacatcaccaaaagcatctttagcccccagataaaaaaagcagaagctgcggttgaaaagcttcaagcttcctgcctggggtggccaaggctggtgcttcttgggcctcatggaagggctgcctccactgctccccagggctcacatgcattctttctcctactgctgagtcccgttgatgctgaaactctctttctggcctaacagggtccagaatccagggcccagtgggagtgggaggtgggtgatgatttctggaggcactgccctcagaagctgcaagggtttctcttcggtaccctccagcggtcacagatgagccggtccccccctgaggcacccggattcacctctggaccaccctgatattgcttctcctctgaatgctctgaaaagtgcaggtgcccaaggcatgacttgcagctgtctcctggattgtgtcatcatggggtatcagggctggcaaaacccctgctctgcttttggccttggatatggaaacctcaaccactttgttctcctaccacctctttgcccttcctaccccttcctcccttcagtcagtgtccccagggtccagcctggctagagttagaaggcagacctagcctttggaagcagggtggcctccagagccttgccataaaaaggctgaaggcagccgggcgcagtggctcacgcctgtaatcccagcactttgggaggctgaggcgggcggatcacgaggtcaggagatcgagaccatcctggctaacgtggtgaaaccccatctctactaaaaatacaaaaaaattagctgggcgtggtggcacgcgcctgtagtcccagctgctcaggaggctgaggcaggagaatggcgtaaacccctccagcctgggcgacagaaccagactccgtctcaaaaaaaaaaaaa

SEQ ID NO: 19640 - DNA, 1032 bp, Homo sapiens
gcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcaggtgctggccggggagcaggggacagcgggggcggggcggggcggggggcgccgcctggggagggtctcgggcccggggcaaggcgggcctttgtctgcgctgcgaccctgtgacctcaggggcgccccgtgacgtcacggggagggatgacgtcaagccccgagggaggccccccccgcaggaatccgaggggtccgggcgggtcccaactgcccggcccggggcggaagacctcggcgccttctcgtggggtcaggaggggaagaggcccttccccgtcacctgagagccggcgcggcctcagccttgaactttgaatcctgggggaagaggacaaaacccgctcccgcgtggcagtttgagcctccggagctttcccccatctaacctcttctgattcttcgaacgttcagagaacggtagctattgttctcccatttcacagatcatgaaacgagattcaaagaaaggctgcgacttgcccagggtcacatagttacttaaaggcttaactaggatttaaacccggactgcttatgatcacacaatggaggaaggactgaatcctcccccgaagaaggacccctctaggcggctcccctctctcccgggggctggagtaaggcgggtggtccataagtcatgaagaagggggtcgcactcgtgttgttactgaactcccgctgccctctcaggacgcaggttagcccttggctcttgggcatccatcaagtttctgggcgccctgtatgtcttgaatctcctgctcacgcagggaacccctcaggcccgggtgtgggaagcagggtgaaggagccccgactctt

SEQ ID NO: 19641 - DNA, 1032 bp, Homo sapiens
gggagggggtgtagaaccgagttgtgcaggaatgggatattccacacttcagggcaaacttattcgcaggatcagtggcgggctttggaggtgggaagcaggaaggaaggggaatgcagataaactcttcttcttcagatctccggggtgaaatgaatgcacctgacgcccgcgtggcattagaagctccgcgaactcagtgaggccatgctggacagaggctggaactccgggccaccgggacaactctgcccgtagcaagccttgcgcgctcctgtgagggcgcgcgcgcgcgcatgtagtcgtgtctcgcgcagggtccggcctgtcaggcggaaaatctcgcgagatcggagacgggggatgacggtctggaggaggggagtggtgtcgggtaaagggggggaagctgggcagcggccgggctctgtggcttcagggctcggggagagagagggagggtggcaaagagactgagtcggtgccgccgcctgcctgaggagagaggaggggtcccgctcgccctgcgcccttcgcgggccgaaagcactaggcactcgcgaacatctgaggcctcccggccccgggggaccccgccccgccgtccgccggccggcccgcggcctctcttccctttgtgagcgcctccttaccaggggtggtgttggtggcggagggctgcgcgtgggcccgcccgccgaggggccgcggcgggggaccgagagggcctcggctgtgtgaggactagaggcggccgaggcccgggccggttcccccgaggcggcgacggagacggctcccggcacttccccgcgccatcttaactgagcccaagcgctgagggcgcctcctcgaccccggtcgtcccctcgcccccccccccaccccccgccgccgccgccccttgttgcagagcttgggctgggcggcttgctggggctcgggggtggggggcggcgatctgtcgccgggccccctcctcctcctcactcctcaccctccagggtagcggctaccggagcgctgcagggg

SEQ ID NO: 19642 - DNA, 1050 bp, Homo sapiens
gattacagacatgagccactgcacccggcccgatttccgtacttactattaatggttggattttaaaaattattcttcaggttttcctattataaaatatgagaggatacaacctgtattagttcattccattcttaaagtattttagtttttagtaataaaaattgatgtttaatttcattaaagatgtctcataccttctaaaaatctacatgaattaaaaagttgtgtggagggactagcagcaattattttcagctgggacgtttctgtcatcatatggtaacagttatttctgtatcagtctatttgtgccagaagcagactttttgttctaaaatacagtctaaggctatacctttttgatgacaaaattaagtatcctataaaagttggaagagtttttaaaatgttaagtacctggcatgtaaataaagtaagtaaaagtataaattattaagtgccttgcataatagatatactgcagcctcctaaaaatgccagtgaccgttatgctgtaggttgttatttaaatataatggcacttaattaccgtctaatttatctttaaagctgagaaggggctaatttttccttttgataaaattatttgatcaaatagttttatgcaggtttagaagtagatgaattactgtaacatttagaaagacattcaaagtttagtttctgagaaatattatcaaataataggatggaacaaaactttctggtttgcagctaccaataataaaattggcacttactatatattaatgttggctgggcgtggtggctcacgcctgtaatcctagcactttgggagaccgtagatcactttaggtcaggagttcaagaccagcctggccaatgtggaggaaacccgtctctactaaaaatacaaaaaattagctgggcgtggtggcgtgtgcctgtaatcccagctacttgggaggctgaggcaggagaatcgctggaacttgggaggtagtggttgcagtgagctgagattgtgccactgcactctagctgggcaacagagtacaactctgt

SEQ ID NO: 19643 - DNA, 1035 bp, Homo sapiens
tgcaagtaaatacatacaatagtgtagtgcagggtttcccaaccgtggtagtattgacattttgggtaggataattcattgttggggggatctgtgctatgcattatagcatattttgcagcatcactggcttttacccattagatgccagtagcgtcacccctggttgtgatgatcaaaaaatgtttcaggtattaccaaatgtcccctagggagcaaaatcacctgattgagaaccatttatttaactgttatacaggtagagttaaggggtgtttaggagtagtgactcctgagggagtgagattttatatgggtcttgaaaaaaaaataaaagtacaaagggtattatatacctgagagcatgaatgatcaatattgaagagggtgattactgatcatatgtggctataggttatttatgtgatttgggatgggtatttggtaaaatgaagctgaaaaggtacttttgggccatatcttttttcttttcttttttcttttttgagactggatctcactgttttgcccagactgaagtgcaatggcacaatcacggctcactgtagccttgcttgacctccctggcccaagcagtcctcccacctcaggttcccaagcagctgagaccacaggagtgcactacccacccccccaactaagcagctgggagactactggcatacaccaccatggccagctaatttttgtagtgacagggtttctccatgttgcctaggctggtcttgaactcccgggctaaagtgatcctcacacctcggcctcccaaagtactggcattacaggtgtgagctaccatgcttagccatttttctttttttaaaactgtttgaggtataattaatgcagcaaagtgcataaatatgaagtgtaagcctgttgaatttttacagatgtgtatgttcatgtaaccatcacaaagaacaagatagagaacattcctagtacctcttacagttctttctttttttagatacagggtcttgctcttttgcccaggcaggagggtagtgg

SEQ ID NO: 19644 - DNA, 1053 bp, Homo sapiens
agtgcagtcacgcgatctcagcttactgcagcctctgcctcctgggttcaagcaattctcctgcctcagcctcctgagtagctgggattacaggcatgtgccacctcaccctgctaatttttgaatttttagtagagatgaggtttcaccatgttggtcaggctggtcttgaactcctgacctcaggtgatctggccaccttggcctcctacagtgctgggattacaggcatgagccaccggcccagcctgttgagtgtttttattatgaaagtgtgttgcattttatcaaatgcgttttccatatttattgagatgattgtgggttttttcccttcattttgataaagtgatatattacattgatttcttttcatatgttgaatcacccttgcattcctagaataagtgccacttaatcataatgtataatccttttaacatgctgctggattcaggtattttcgttgaggatttttgagtctatattcataaggggtattggtctgtaattttttcttcttgtgatatctttgtctggctttggtatcaaggcactactggcccataaaatgagttaattcttatttaaatatttggtagaagtctggcttggtggtgcatgcctgtagtcccagactttggagaccgagactacaggatcacttgagcccatgagttcgagtccactctgggcaatatagcgagaccctgctctttaaaaaaattgtagaagtcatgagtgaagccatctagttccaggttgtttcctctgacagttttctgattactgttttatcaatgtctttacttgttgaaattagatctaggtcaatttagtctgttgaaatgttctgttttcttgagttagttttggtagtttgtgtgattttaggaatttgaccatttcatctagattacctaatttattggttgttcatattattctcatatcctttttatttctgtaagtttagtagtaacatctttgctttggccagacacggtggctcacacctgtaatcccagcactttgggaggctaaggcaggtgg

SEQ ID NO: 19645 - DNA, 1033 bp, Homo sapiens
ttttttgtttgtttttttttgagacagggtcatccaggttggaatgcagtggtacaatcatggttcactacagcctcaacctccctggctcaagcaatcctcccacctcaacctcctcccaagtagctgggacaacaggcatatgacaccacacgcagctaattttcacattttttgtagagatggggtctccctagtttgcttaggctggtcttgaactcctaggctcaagttgttttcccacctaggcctcccaaagtgctgggattacagacctcaccacttactgagccactgcacccagccactttttctctttttatggtttatttttttctgttttttttttttttaacattttctatttcacttatcacagttctgctagcatatttttgtaagtttagtggccatttgtaaccttattctttgaattgcctatttatggaacctattttttgttattgttttttgtagaatgctttatgtattgtggcatatgttaacagcaccaggacctctgaacagtgttgaataataaaggtttcttcttgactgtaatgtaaatgtatttcaccattaaataggatagtatggttaagaaagtttcttcatctttctagtttactaggagtaggtaattgtgatgtataagtttcctacaaaaatctagtggtatatccatacaataggatactgcttagcaataaaaatgctcacaacaggcctggcatggtggctcatgcctgtaatcacagcacttagggaggctgaggcgggcagatcacttgagcccaggagtttgagaccagcctggccaacatggtgaaaccccatctctactaaaaatacaaatgtgtaggtaagcctgattcgtcctataatgtcaaatttcttgctggtatttctcagttgtattatcatttcatttattgttataattacatatgtgtgtgtgtttgtgtgtgtctatcgagggaggatatagtagatagtataatctctaccagttcagtgtaaagaagcaattttc

SEQ ID NO: 19646 - DNA, 1024 bp, Homo sapiens
aattttacttcaaactatgttcttgatctactgtgtgaacttattttatcttaaatttatattaaatctttataataatatattttaatgcttttataacttttccatgtagcttgtaatggaatattgtttaggatctgcttcggatttactagaaggtaagttccctttgattattttttaaaaagtattcacagaataaaatgataatttagacattatttaaatgatattaataccaaataatgtaaaactttccagaaagagcagaactcttagtcttgttcaaattctcagcatggtatatgctgtccttattaaatattatatgttatacagtagcttaaaatagtcatgttttctcattgtgactttacaagtatttttctgaattctctgtcattctgctcctcttgttcaaaccaaagataagtgagaataaagagagaactctgttactattgtttttacatcaccaaataattatttaatatcgttagctaagagaagaattggctatgaactgtactttaacaactgacacaactgcatacaagttataaagtttaataatctttatcatcttggaaaataaatctcttcttgctaagtatcagtttttaaaaattgccccatgtattagatatgtatttttttaacaaaaatgttctgtgtattaattattttgaaataaattttaagttcacaaaaagccattacaagaagtggaaatagcagcaattacacatggtgctcttcagggattagcctacttacattctcatactatgattcataggtaagtgctttggaaattatatattgataagtaaatggcttgttgcatataccaactttagaatttattaactctaaagtttttattggttaaagccaaataaaataatataagctcatatttttttagatttttcatgtcctaaaatgaacatagttgtatactttatctcactaggataatttttatctttgcctatatgtgctgctggaccttgtaaaaata

SEQ ID NO: 19647 - DNA, 1080 bp, Homo sapiens
tatgacataagtgatatagggagtcaaggtttatttgttttttcctatgtaaagaaccacttgtttcagcaggatttgctaaaaacactatcctctgaattaacttgactttcttggtagaaaaatcaattgaacatatgtggatctctttctagtttttattctatttccttgatctacttagcctatcttaaagccagtatcacattgtcttgattactatagtgctgcatatcctccaaatattttttttcctcaagattgttttggatattctaggttcttttatatccccatataaattttagaaccagtcaatttctttaaaagacttgttggaaatttccttggaatctgctaacattgggatattttacactaattccctacttagttaatatagaattgtctaaaatgcttttcgaagaagaatgttttattttcttcttttccttacattatttgtatgtctaggttacgaggcaaatgcaagaacatgagcaggactctgagcttagagaacaaatgtctggctataagcgaatgaggcgacaacatcaaaagcaactgatgactctggaaaacaagctaaaggctgagatggatgaacatcgcctcagattagacaaagatcttgaaactcagcgtaacaattttgctgcagaaatggagaaacttatcaagaaacaccaggctgccatggagaaagaggtggcttattcagtattattactttgcttattttaggttttgaatgtctcagaattaaccaacatggcagtttgatgttagcgtatctgttcccgtgaaccaagcaaattggggaaaaggagaagcatttatgtgacttatataaaggtttctgtaaattgatattacaagaaagggtggcacctgtgtgttttatctctcactaattttgtgtgtgggtcatttaaaacaaatcagtcttaaaactgttcattggagtagtccactttatagtttttgtaatagccaacaaaattttgagtctgaaaaattgatgtgttttaatatcaagtactaggtctgggaactaataagacatgggaccatttc

SEQ ID NO: 19648 - DNA, 1027 bp, Homo sapiens
caaaaaaaaaaaaaaaaaaaaggtaaacatggccaagccaataaaaaaatcttattcagccatttaaatgatgtctgcaaaaccagtattaatatggaaaaatgtttatggtgtgttgaacaaaattttaaaagacaaatcctacttgaagtaatgttagtagtggctatgttaatgtgataggttgatttttttctctgtttcttttttaaaatatggttttattcatttcataatggaaaaatgcatacaattatttagtatttaaaagagtaaaagaacaataggatggtacatctatagtgcttcaagatgttacttggtttttatggctaatattttgcctttcaagcaaagtatgtgactacaaggcaggctggggtcaattagcaatcactaagaccctgtacctctctacaaaaactttgtaaaatcctaaaagctgtgatttctgcactttatgcttgccggttgtacatacatataagaaggagacatctgaaaataaatagaaatggaactggagtgaatgttagttgattctagatgaaaaatcattctgtttgaagattgttgtaagtctccaagtgaaccaaaaattgttcatttagtttgagacaaaatgagcctcacatgtacatgaagtcttgtttcaatgtttctcatccttcatttacattaaatttttagataacaacacaactataaatgttaaattatatgtgaaatatatatatatgaaaagtagtagcatttccagagtataaatgacctttttttaatcatctcatttaattttctctcaagatttcacttagtattaacatcatggttagtagtgtttttaagtaagaattaaaatttgggggtgggtgcagtggcttacactgtaatcccagcacttcggaaggccgagtggggcggatcacttggtgctcaggagtttgagaccagccttggcaacatgatgaaaccccgtctctacaaaaaaaaaatacaaaaattagttggatatagtggtgtgcgc

SEQ ID NO: 19649 - DNA, 1009 bp, Homo sapiens
agcttaacggtagtctttagatcataagaaatatataaattagtatgcaccttatctgcctgttgtgggtttcttaaacttgcacttcctacccacccaaagatagatatcctttaaagaaaataaaggcagagaattaaaactggggagccatttactatgtcaccatcactgttaactgtttcccagcaatctaaactttttgaagtttcagaggtgtattttttttttgtatatatgtctgtgtgattgtattgttttgtttctaaatatacaaggaattctttaaatagagaaaaaggttaatcctcactgaaacaccaggatgcccactggatatactaatctgaacatctgtaggtagtttgtcatgaaaaagtggagagaagatgagacttttgaatgaatgaaaaagggtatcttgatacccagaattccccccaaagtacgggtaattcaacctgcacagttttctttcactcaaagtgttcagcacttgtgagtgaaaaatcatgtaattatctgtaaatatgtagctaacaaattgacctagtttctgtatttttttgtttttgtactaaagtttataggtctgtgccagctagagagaagttgctgtcattaccagttgtggtcctagcatctaaccctgaaaccatcctaggtgacatttttagaattaatacttaaatgttaaacagggggaaatgaagcttaatcatggtcaggtttgagatcttttgcagtgaaataattttatttaatataaatgatcacatgtcctcaatcatgaatgaggtagggagcctctctcccccagtggccatgtttacaaaagtgtgttttgtctataaagtgcaagtgttttaatgtttatgtaaattatgcaggtgataacatggtttggaactgtttattgggctctttaactgaattttcaaatgaaatgaactatgcttattgctggcacattgatcccatttctggaacatttttcctatttccagag

SEQ ID NO: 19650 - DNA, 1251 bp, Homo sapiens
cacatggtcatggactgaattatgtgactttaaaggatgtaactgcccaacatttgcagattctgggtggtctatgtgaccatttgtctcgtatccaaaaaccccggggctattggaacccttccaacactttttcctttgtcatagacaagtttatatataacttaccaagatgttggctgtcctggtgtattgccagacagctctcttttggttcccattccaaatgtgctgctgtccttctttgcatttcacaatatcaaagaaaccaccacccttcttcctaacagcattttatgccttttattccacattaaatgggaattgtgcctacttaggagtgcccctccaattaattacatgtgtccaagaataatccaagctagagacacaaggtgggaaaacatttcaaaaaaaaaaagtcctcttaaggccagtaatttatctgaaaaggtattttatcacaccttgacaccttatatatgagcctattaggagctgcaggtggtttcatagggtaaaatccaagaaaagagaaggatgtgtggggtttctattagaagataattttgttctcattttaccttttcttttatgatccttctctgctagaacaggttaattctccaaatttgttttgttttgttttgttattttttagggaactcttttgcaaaagcaatggtcggatgtaaataacatttaaagtatagtgcacataacttccccggactgttccaatctgataatttgtaaatgctttagagtttttttaattaacacttgtgttgctaaattctatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagta

SEQ ID NO: 19651 - DNA, 1066 bp, Homo sapiens
gctggagtgcagtggcactcactgcaacctctgcctccaggttcaagcaattcttatgccacagcctcccgagcagctgggattacaggcgtgtgccacctagcttagctaattttgtatttttagtagagacgaggtttcaccatgttgcccacgctggtcttgagctcctgacctcaagtgatctgcctgcctcagcctcccaagtgctgggattacaggtgtgagccaccatgcctggcctgaaatacctaacttaaattggccaggcatggtggctcacacctgtaatcccagtactttaggaggctgaggcgggtggaacacctgaggtcaggagttcaagaccagcttggccaacatggtgaaaccctgtctctactaaaaatacaaaaattagctgggcgtggtggcacacccctgtaatcccagctacttgggaggctgaggcaggagaattgcttgagcccaggaggcagaggttgcagtgagccgagaccatgccactgcactccagcctggcgacagagcgagactgtctcaaaaaaaaaaaaaaattctctgtaatagctccaggccaagagttgttgcctcacgccacctatcagattcctttcctcaaacagccctttcatgaagtcattcctctgttcacaaactgtcaatggctccttatttcccaccttatcgtggccatattctccggcctggcttttcaggccttacttaagtaagcttcgtctgacctctccacatccttggttcctctccagttgtgtcgggctgtttgccacacaaatgagtgccagcctcgcccttaccacagcccctttgctcctgtttattctcctccacacctggcctatcctgactcggagagtgcagctccctgccctcctgccatactcccccagccatcttcccagtcccagctggcatcagctccccctgagacactgcccgatggcatcagcctttattcctcccctcctcctctgaatctatctctgataatttaacaactaatcactaagttttattagtttgctgttttatttgcattagt

SEQ ID NO: 19652 - DNA, 1032 bp, Homo sapiens
aaccgcagctttgtcttcaggggccaaggtcaggcaggcaggaagtggggcagggtggggacgatgggaggcagccccaggccacccctgatccccctgtgctgttccgtgtctggcagacacaagcgccgtggtcatggagattgaccacgaccgccgggtggtgtacacagagactctggcactggctgggcaggaccgggagctgctgctggctgctgctcagcccactgaggaacaggtgctgagccggcttaccgcgcccgtcgtcaccactcagcttgacaccaagaatatctcctttgagaggtgggtggacatggccttggtcacccttgagccagcccggtggggtgcctgcctcacctggaccactctgcttccccaggaacaagactggcatcctgggctggcgcagtgaaaagacggagatggtgaatgggtatgaagctaaggtgaggctgcagctcccagctgccagcccagctgcactcttgcctacagcaagctgtacaggggattctgacctcccttccccagccctggaggtacagaagcaatgcagcgtggtcaagcacttatatttgggttcaaggcacttctctggtgttttatatggatgtatggatgtatacacagggcacgtgcacacgcacacacacacacacatttattcctcacagcaaccctttctggtaggtgctgttctgttagtattcccattttacgcatgtttattgagtcctttccttggcatcccatttactcttcacaacaaccccaggaagtagggatgatcggtccattttatgatgaggaaatagaggcttagagtggttctgtgacctgtacaaggtcacacagctgttaagtggcagagttggggttcagatcctggctggcctgaccctagagccaggcctttatccctaaaaatgactgcctggctgggcatggtggctcatgcctgtaatcccagcgctttgggaggccgaggtgagcggatcacctgaggtcagttcgagaccagcc

SEQ ID NO: 19653 - DNA, 1074 bp, Homo sapiens
tataggaaaaaatgttgcagatacggttgtaacaggattgggccagattgtggagtaccttaaatttttcgtataaaatttcaactttatattttcaagtagtttttgagtaattcggtgatatcatcacacttttgggaagataactcttgaattgtaaaacaaagaaagggagaaatgagagatgagtttaaaaatgcttgttagaaggcttttttagtagttcaggtgagagatctcaacctaggttgaggtcattgggaattaatggggaaaaatgtgagcgataccacagaaataagtaggacctggcagccacattgaatatatgggaaagagatggagtcctgatgcaagatcttttttttttttttttggtcatcattttccctcattaaaaaaatatataattcacacactgtatactttacccttttaaagtgtacaattcactgtgtgtgtgcgtgtgtgtgtgtgtttttttttttttttgagacggagtctctgtcactcaggctggagtgcggtggcgtgatctcggctcactgcaactgcaacctccacctcccgggttcaagcaattctcctgcctcagcctcctgagtagctgggattacaggcacctgccaccatacccagctaatttttgtatttttagtagagacggagtttcaccatgttgatcaggctggtctcgaacccctgaccttgtgatccacctcgcccggcctcccaaagtgctgggattacaggcgtgagccgccgcgcccggccaattcactggtttttaagagttgtgccggcatcaccactgtttagaacattttcctcacccagaaagaaactgtgtacccattaccatcactccccattctccccacccctaaaccctggcaaccactaatttactttctgtttctatgggtttccctattctgcacatttcatataaatagaatcatgcaataggctttcttttgtgtctgacttctttcacttagcatgatgttctcaagattgtaacgtgtcagtactctttatttctttttttattactgaataatattccattgt

SEQ ID NO: 19654 - DNA, 1024 bp, Homo sapiens
cagttcctcctttcttttttgagacagagtctagctctgtcatccaggctggagtgcagtggcggcatctcgggtcactgcagcctccacctcccaagttaaagcagttcttgtgcctcagcctcccaagtagctgggatcacaggcgttcgccaccaggcccagctaatttttgtattttttgtagagatggggttttgccatgttggccaggctggtcttgaactcctggcctcaagggatctgcctgcctcagcctcccaaagtgctgtgattgcaggcgtgagccaccatgcgtggcctagtagatcctctttttcaaattgtcagaataagttagaaataattatcattttgttcaaggtgggagagatggttgggggggtggtgaaagtttttacaccatatgagtaagaaagcatattctgatgctgctatcaattcataagtgagtggttttgctgtcataattttccggtctcactgtcaccatgttcattcttttctgttggattattttaattgtttcataactagtttccttattatctgtcttctcaaattatttatgatattgtcagattgatcttcctaaagcacagttataatcactgatcctcagtcctgaacgtaattatatttaaaatctaaagtgctaatcttgactttgaaaaccttctctatgctttgcccctagaatgcttactagcattttctcctaactgttcctccataaaaagtacactgtcgtgcttgcagtttttcacagctctgcttttctttacactggaagtcttctccccatttttttaatgtccaaattatagccatccttcaaaacccagcgcaaaagctacttctttcaagataccttctttgattttcctcactggaaagaatctcttcctttttcttacactctttacctttcttattgcacttagcttttaaaagcttgcattataagttgtttacatacatgtcttgtcactgtactagataaagtatgagctctatgagttag

SEQ ID NO: 19655 - DNA, 1065 bp, Homo sapiens
catgcatttattaatgcattcaacagatatttattgatcacttgccctgtgccagtgaaacataacaaaagccactgcctttatggcacttatattctcaaggtggtggtggtggggggtgataagtaattaacataacagataagtaagttacatgtgaatttagaagattacagagctgtgaaaaagtagagcaggataaggaaaattaaacaggtatttagggaaattactcagtctatgtctttttctctctactaagattaaacttttgtcagtgtttcagttatagcttttctgtttcttactgtttctaatttattagctctattggtgttattttagtcttcaatatattttctttagctctacagtttctctgtcttttattgtcctctcatctgaatagtaacttttaaaatttaattagtaatcttattttgaagagtttgacagggaagagagagaggaagagatggaaatgatagttcaaagatacacaggtatacctcactgatattgtgggtatggttccagaccactgcaataaagtaaatatctcagtaaagcaagtcatgtaagttttttgtttcctagtgtatataaaagttatgtttatgctatgctgtagtttttaaagtgtgtaatagcattatagctaaaaaaatgcctataccataattttaaaatactttatgctaaaaaatgctaatgatcatgtgagcctttagccagcaataatctttttgctggtggagggttttgtctcaatgttaatggctgctgactgatcaggtgatgtttgctgaaggctgggtggccgtagcaatttcttaagacaaaaatgaagtttgctgcattgatcgactcttcctttaatgaattatttctcggtaacatgtgatgctgtttgatagcatttacccacagtagaactttaaaaattggagtcagtcctctcaaatcctgctgctgttttatcaactaagtttatgtaataatctaaattctttgttgtcatttcaacaatgctcacgtcgtcaccatgagtagattctatataaa

SEQ ID NO: 19656 - DNA, 1151 bp, Homo sapiens
tacaaaaaattagccgggcatggtggcgggcgcctgtagtcccagctactccggaggctgaggcaggagaatggcatgaaccagggaggcagagcttgcagtgagctgagatcataccactgcactccagcctgggcgacagagcgagactgtctcaaaaaaaaaaaaaagaaaagaaaagaaaccagtgcagtggctcatgcctataatcccagcactttgggagactgaagtaggcgaatcacctgaggtcaggagttcaagaccagcctggccaacatggtgaaaccccgtctctactaaaaaataaaaaagttagccagttgtggtggcgtgcgcctgtaatcccagctactcagaagactgaggcaggagaatcatatgagcccaggaggtggaggttgcagtgagccaagatcatgccactgcactccagcttgggcgacagagcgagactgtctcaaaaagaaaagaaaccattttctttgctcatccagtagaagaaatttgtcatcaattcaagttttatcatgagattgtcatcaattcaagttttatcatgagcagttcagtcacatcttcagactccatttgtaattctagttctcttgccatttctaccccatctgtagccacttcatctactgaagtcttgaagccctcaaagtcattcatgagagttggaatcagcttcttccaaactcatgttaatgatgtttggcctccacccatgaatcacaagtgttcttaatggcttctagactgttgaatttcttccagaaggttttcagtttacttgcccacatctgtcagaggaatcactgtctgtggaagctgtagagtttatgaaatgtatttttgttttttcgagacaaggtctcgctttgtcactctggctggagtgcagtggtgcgatcttggttcactgcaacctctgtcgcctgggctcaaacgatcctcccacctcagtcagcctcctgagtagcatgggccacaggcactcaccaccacacccagctattttttttttttttttttttttggtagagacaggggtctcaccatgttgcccagtatggtctcaaactcctgagctcaagcaatctacctgccttggcttcccaaagtgctggggttacaggtatgagcca

SEQ ID NO: 19657 - DNA, 1017 bp, Homo sapiens
gtccataattacatttttgagttattgttttatttggtttgtgtacaatctcattgcactctttttactcaacctgtttgacaatttctaattggaagataatgtaagctttacttccaaatttatgaagttaaataacaaaattagctttctgtttctccaaaatcatacacatctgcttccatatactgacaggctttgatattacccattccaactttaccataaaagtcattaaaaagaagtttttcctttattttcatgttgtgtttcagtgtatgttgtcagacagaaagcaataatccctcatctcactcctgaatttatcaaaagctggaaataaaatagatcaaatcactttctgaaacaaaattactttattagtttagtaataatttgaggttactttaaagataagaagcagcatttggaaggagattcatttcctgcctttgggctttatctgcaagaagtacatctttagtgtcaagagattgtgtatttataactgaactctaataaaatctgtactggggaccctgcacacctgacttggtcattgtggttatatattaggtgccaaactattgcttgtctcttgaaaaaaaaatacattgccaagtgtttttcattaaaatttgccctgtgtagaaaaggttataagacctttgactgttcattataagtgtgctagttgttaccaacatagttaatgatgttccttttgaaaataagtttgtgtttctaactgaaacaaacttacggagtttttcttttattggttaattaagcaataattggaaaacatgtcattaattctagtatatatgttttcactaaagcttattaaatatttgcatttccgatagcacagtagggtgactagtcaataataatttgtatattttaaaataaagaatgtaattgaattgtttgcaactaagtataaaagcttgaggggatggataacccattctccatgatgtgcttatttcacatggcatgcctgtatcaaaa

SEQ ID NO: 19658 - DNA, 1063 bp, Homo sapiens
agtggcgcaatcttggctcactgccacctctgcctcccgagtagctgggatttagaggcgtgcagcaccatgcccagctaatttttgtatttttagtagagatggagttttgccctgttggccaggctggcctcaagcagtctgcccacctgggcctcacaaggtgttgggattacaggcgcaagccaccacacctgagcctaatcagatttactgtaatagtttgtttaaaccatctgcttcatctcttctagtccttatacctctttttcctgttttactttattagacaagttttcagtagtatgttgaaaaatgtccttagtgggcattctgacctgtctatcctaagtgatatcctaagcttctgaagtttttccattaagtttgatttttgttattggcttttggtatatagactttttctttttcttttcttttctttttttttttttgagacggaattttgctcttattgcccaggatggaatgcaatggtgcgatctcggctcactgcagcctccacctcctgggttcaagtgattatgctgcctcagcctcccaagtagctgggattacaggcctccgccaccatgccccagctaatttttgtatttttagtagacacggggtttcaccatgttggctaggctggtcttgaactcctgacctcaggagatctgcccaccttggcctcctaaagtgctgggattacaggtgtgagccactgcactcggccagacttttgtttgtttggttggttggttttgtttgttttgttttgttttgtttgagatggagtctcgctctgttgcccaggctggagcgcagtggccaatctcggctcactgcaagccccgcctcccaggttcacgccattctcctgcctcagcctcctgagtagctgggactacaggcgcccgccaccacgcccggctaattttttatatttttagtagagacggggtttcaccatgttagccatgatggtctcaatctcctgatgtcgtgatctgcccgcctcagcctcctaaagtgctgggattacaggtgtgagccagtg

SEQ ID NO: 19659 - DNA, 2003 bp, Homo sapiens
atggcgcaacctcagctccctgcaacctctgcttcccgggttcaagcaattctcctgtcccagcctcccgagtagctgggattgcaggcatgtgctaccatgcccagctaattttttgtatttttggtagagttggggtttccccatgttggccaggctcatcttgcgaactcctgacctcaagtaatcagcccgcctcagcctcccaaagtgttaggattacaggcgtgagtcactgtgcctagcctgacaattttttataaatcacaaataggtactaaatgccttcctgaatttattgagctagttaagtcatttttctcctgtggttcattaatatggtttattagattgatacatttttaaatgttaaaccattcttgaatttctggcttaaatccttttgagcaggatgtattatttttaatatgctagtaaactcaattcactaaaacttgatttagggttttcaaacatctatgtctataagtgggaaaggctttgtttattgtctaaaaatgtctgtaggattttaatttatggaggtgacaaatgacatattgagactaatgccctttaaaagaagattattgttatgtacatttactgacaggagaagacatgccatttcattcagggctacatagggaagaaccagtttggatcaggaaaagcctggttcagagtctttattgtatttttcatgggaaaggaagggaaacagtttaggattggctagtttgaatcttgtcagttgcctctgggctgtagcggtgatcaccagtttttttgtatctggccctgggcaatgaaggcagaggactattgcttcctggcttgtaggggccagaggagatggttctaagtttgggctgtggattggctgatttacagtttttggaatatgtatctgttctgcccaggttttcagatttaattgttcacgatagtgttttttaaatctttcatctactgttacttgcatctctttacttttcttgattaatcttgccaaaagtttgtctatcttataaaatcttttgaaataactagcctttgattttgttcatctatattttgttgatttattctctaatttctgcccatatgtttattgcttccctgggttattttgtcaatcttcctaagtttctttttgagtactattttagctgtatctcacaagttttggcatgtagtgttttcagtgttatacatttataaatattttgtaatttcctttatgatttgtttaacctgaagacttacaggtatagcttttagttttgacatacaggtttggttttctcaaggatatttttattgccgtttctattcttttatttaatttttacttaaaaaaatagagatggggtcttgctgtgttgtccgggcttgtcttgaactcttggtctcgagtgatcctccaaccttggcctcccagagtgttgggattacaggtttgagctactgcacctggctgctgtttttattcttatgttttattgtgttatgaccaaagaacataagattatctgatgtttatttttattcttgatctatttgttatcatagaggagtaagattgccatctaaaatggttgctgtccttatatttctgagagttgatgctttttatttattcatttatttaaacaactttattgagataaagttcacatagcaaagccaggtgcagtggcctgtaatcccagccctttgggaggctgaggcaggaggattgcttgagcccaggagttcaagactagcgggggaaacatggtgagaccctgtctctgcaaaaaattttaaaaattagttaggcatgcttgtggcacatgcctgtggtcctagccacacaggaggctgaggcaggagcatcacttgagcccaggaggtcaaggctgcagtgagccatggtcaagccactatactccagcctgagtgacagagcaagaccctgtctcaaaaaaaaaaaaaaaaaaaataccaaaagctctgtg

SEQ ID NO: 19660 - DNA, 1041 bp, Homo sapiens
gctctgtcacccaggctggagttcaatggcgcgatctcggttcactgcaatctccgccttctggattcaagcgattctcctgcctcagcctctggagtagctgggattataggtgcccgccaccatgcccggctaatttttgtatttttagtagagatggggttttgctgtgttggccatgctggtcttgaactcctgaccttaggtgatctgctcacctcggcctcccaaaatgctgggattacaggtgtgagccaccacacttggctgtttccacatctttatgagcatttgtgactcttttattttagtcatcctgttgggtacgaagtggtatttcaatgtggttttgatttgcatttccccagtggctaatgatgttgagcaccttttcatgtgctttttggccatttgtatatcttctttgaaataaatttgtatttcttctttgaaaaaagtgttcaactcctttgtccattttttagtttgtctttttattgttgaattgtaggaattctttatgggctgcaagttccataacagatacatgattgcaaatacagttgattcttgaacgataggggggttagagctaccaacacccgtgcagctgaaaacttttgactaccccaaaacttaaccaccagtagcctattgttgaccagaagcctcgttgataaacagctaacacactttttatatgtattatatactgtattcttacagttaagctagagaaaagaaaatgttattaggaaaatcataaggaagatatataataaaatatatttcctatttattaagtagaagtggatcatcataaaggtcttcctgttcatcatcatcttcacattgagctagccgaggagaaggagggattggtcttactgtttctgagtgccagagacagaagaggtggaggaggtgaaaggtgaggcaggcacattgggtgtaacttttacttaaaatctacatataggtgtgcccatgcagttcaaacttgtattgttcaagagtcagctgtatttttttcccattctg

SEQ ID NO: 19661 - DNA, 1420 bp, Homo sapiens
tttttcagatttgggaatatttgtattatacttaacagctgaacattcctaatccgaaaatccaaaatgcttctttgagcatactgttgacactggaaaagttttagatttgggattgttggattagggatattcagcctgtacttcctttattttcaaagagggcttttatgaggcagacctgagattttatgtgcttaaaacatctttagttttgatgatagtttttctggatatatactttttagttcaaagtgctttccatcagcactttaaagttactccatctgggtaatgttaattaagatttactacctttttttttctttttaatttttgtgagtatgaagtaaatgtatatatttatggaatatgtgagatattttggtacgggcatgtggtgcataatatggattacttgttcttaaatcccaagttgctgatgaggtatttgatgacattccgattgtacccctttataggtgacctactcttccttgttggaaactcttagaattttctttttgtctttcatttccttaaatttcattataatgtatctagttgttgtatatgcaggcgtgtgtgttttatttatcctctgtcctcttttgcattcaaaacctgttcaatatgatatttttctccaattctagaaaattaccagtcattcaaatatttctttgaatctgtttagtttatatgtcttcctctgggtcttctgttacataaatatctttcatatcactatacctttttttgctttgtttttaagagatggggtctcactatattgcccaggctgaaatgcagtggcatttcatgatcatagtgcactatgcctcaaactgctgggctcaagtgatcctcttgcctcagcctcctggctgtagctaggactacagacgtacaccatcgtgtggcttttttctttttttaagcattttaccctttccatgtgtgttctaggagtttctagcctaatattctaacttattaaaacattttttcagctatatccattcattcatttacccatctcttaattttattttatttatttatttattttttgagatggagtctcagtctgtcacccaggctggagtgcagtggcacgatcttggctcactgcaccctccacctcccaggttcaagcagttctcgtgcctcagcctccctagtagctgggattacaggcacctaccaccaaacccggctaatttttatacttttagtagagacagggtttcaccatgttgcccaggctggtctcaaactgctaacctcaagcgatctgcccgcctcggcctcccaaagtgctgggattacaggcgtgagccaccacgcccggcccatctcttaatatttttattttgactatattttccatgtacattatttcaaatagtttctgttg

SEQ ID NO: 19662 - DNA, 1660 bp, Homo sapiens
tgcccaggctggaatgcagtggcacgacctcaactctttgcaacctctgcctgctgggttcaagtgactctcctgcctcagcctcccaagtagctgggactacaggcatgcaccaccatgtctggctaatgttttttgtatttttagtagagatggcgtttcaccatgttggccaggctggtctcagactcctgacctcaagtgatctgctcgccttggcctcccaaagtgctgggattatatgtgtaagccatcgtgcccggccaaggtatgttttttctgtgcctagtttgttgaacatttttatcatgaagggatgttgagttttattgaatgctttttctgccccaattgagatgatcatatggtttttgtcttttattatgttgatgtgatatatcatatttattgatttgcatatggtaaattatctttacaactcagggataaatcccacttgattgtggtatattgtccttttgatgtactgttggatttggtttggtagtattttgttgaagacttttgcatctgtgttcaactatggcctgtagtttttttgttttgttttgttttgttttttaatgttgtgcctttgtctggttttggtttcagggcttcacagaatgagttaggaagaattcccttctcttttattttttggaatagtttgaggagaattggtattctttgtaagtttggtagactttggcagtgaagccatcagattctgagcttttcttttttaggagactttttattactgattcaatctcattactcgttgtttgttcaggttttctgtttcttcctgattcaatcttggtaggttttatgtgtccaagaatttgtccatgtcctttaggttttccagtttgttggtgtatagttgtttgtagtagtatctgatgatcttttgtatttctgtagtgtcagttgtaatgtctcctttttcatttctgcttttgtttgagttcttggttggtctagaaacataattttgtaaaatggttttcttgttaaacacttgaaccatcattcttgatcatctggtgtgtagaagacactgtactggatactactggtagtaagtagaaggctgcataagacagatctgtgctctcaaggagatttgttatacattatgaaaatgaatttataggtaattcaagttaaaactaaaatatcttcacttctgagagaagctaaaatttcagaagctgctaaggggctttgttaggattaggggcttttctcattgcgtaaccaggaataaaagacagccttactttgagaagaccataaacgggtgaatggataaacaatttgtgccatgtttatacaatggaaacactacttggcaagaaagaacagacttgatacatgatgtgaattaatctcaaactaattatgctgaaagaagtagataacccccccatacaaagtatatatgtttctgggttttggctattacaactaaactggctataaacatttgtatacaattctttatgtgtacataggctttcatttctcttaggtaaatacctgtgcatggaatggctgggtcgcttagggtatctgtttaaatagtcatttttctaattattgtaaatgtcacttctttcttatactaggtttctatatatgcttgtgttca

SEQ ID NO: 19663 - DNA, 1027 bp, Homo sapiens
tgagtaataccatttttaaaatatttaccaacatgatagatgataaaagttaatatttttattttcacctctttagttattgctaagattgaacatttttaatatagttaagagtcatgtatattttctcttttctaaattttctcttcatagccatgtctttttttttttttttgagatggagtcttgctctgtcacccaggctggagtgcagtggcgcagtctcagctcactacaacctcctccatctcccaggttcaggtgattctcctgcctcagcctcccaagtagctgggactacaggcgcgtgccaccatgcccggctaattttttatttttttacttttagtagagatggggtttcgctgttttagccaggattgtcttgatctcccaacctcatgatccacccgccttggcctcccaaagtgctgggattacaggcgtgagccactgcgcccagccagccatgtctatttttttctgttgtagttagtgtttgtcttaggtctgagcttatattacataatgaaaatgttagggtactcatcacagcccttaaactttgtacttacaagagttgtgagaatgtggacaaatagagattgctgagttgtaagacttttaataaatgatctgttgctaagtttaaaaaagtaaaaaagaacaggaagttctcagcacgacagaaaattttagctgtgagccatttgaaagaaggattggttcttgaactgtttttgtttagctaagagccattttggataattgggtaggtgcaacttttatttaagaaagaagctcatatgtcccattgtgctttattagttatggaataattatttctacaaaaagaaaaaattcagaaccctttactaaatttttgtgttaaaataaatttattattgaaggaaggtaatttaataatataaataatggtctagtacctatacttttttcaatgtcattagactatattttgtttcctggtgaaggagtaccaataatacagacctaattccctttt

SEQ ID NO: 19664 - DNA, 1104 bp, Homo sapiens
cactatcagttctagaaaacccatttctagttacgctatagctcccatggctaattaaggattcaaatgtatgcatcctccattttcctgtttatggacatactgaatataaaaccttaaagaatcaacacaaaagaaaacatatacagccttttaaatattcagcagaatagatttttctaattcagtggatggaaatatattaatgtcacttcaaataaataccaaccttacattttattaagcacactgataaatatactataaagaggaatattgtttgcatgcttttctggtgaataatccaagaaaaaaaaaagtacagctactgtgttctcataacttagttttgatttgtttaaatataagcatttcttcagccatatatttttaaacaggaacatgataataacaaaaatggtagctaacctttgtgaggtaggtactaatatatagaggaggaaactgaaacaggaagaaattaacatacctagaataacaagctagcaagagagagaacagttgtagactgtttctgagtctacacttgtgaacgttattttgtaagttctcctcatgctgtacagtataggaacactgaagttagagattaataatctttgcagttattatataagttttgttttattcacagggcacttatgaaatctattttttctcttgctgagttcaataagatcaacccttccctgatttatggcaagaggatctgcttttgtgatatttaccttcttgagtatcctttctttttatgaaaaccagactaaattaaaagttctcttaaaatttgtgttagtatttgaaaaaattttatacaagtttatgggatacctgtgagattttgttatatgaatgcaatgcttagtgatcaagtcagtcagcaattagtgtctgttacccaagtacaatacgtttttgttaagggtagtcaccctggccaggtgcagtggctcatgcctataatcctagcactttgggaggccgaggtaggcagatcacttgaggccaggagttcgagaccagcctagccatcatggcagaaccccatctctactaaaaatacaaaaaaaattagccacgcat

SEQ ID NO: 19665 - DNA, 1255 bp, Homo sapiens
gtaccctaaaacttaaagtataataataataataatagtaataataataataataaataaaataaaataagtatctgctcttttatgaggaaattgtttttaattgtagtagttatttttcagtctgatctgaatctagatgagttttttatgttatatagaagatcattttatatatttttatatagggttactattacagaaaaaagtaaaagttttactgctactcttttaagctttttgtatttgtttaaacaggtttttggcatttaatcgtcatccttagtggtaattgttaaagtacctttatttagaaaattgagaatcaaatgaccttcaaaagatcatcagtttttcctgactttttcaggttaggttcagagttatccactgatgctgttgaattctagggatataagtttgtgaatagaatatgtaaaactattgcactccttccattatgttaccttcctgtgtaagtagtaacagcttgttttttcaacggtcatacttcattcttctaaacagctatgaacatagaaacaaaatcttttgaggtgtctcaaaatagatatagtctacattggaaaggcctttctcagtctgcttattctatattttataaaagtctggaaaggtatagccttgtgtttttctttcccaagttttctttttaaaagttattttatttctctgagaatcttccataacaaccaagttacatagtttagattgaagcatccagtttgaaaggcagcaggtaaactctgacagattaaaggtgacagactgaaggaggagataggaaaaaataaaagcaagtaaaagaggaaaacatccagcatttggagatgtaatcttctcagtcagtcctgaagacatcattaactcagtggtcaagaaaaatatttttcattcatactaatcagaaatacagacatgaaaatacattggaaatattaactattactttcagttttggtatttaaaattgatattctagtgaatgaaagtttcatattacatgtaacagaaatttggattaaatcagtaatacatgtaatacacaactagtatacttagcatagcacctagctcaataaatgttagcagctattactgtttttgttatcaacatctttcccccagttagtcagtttaccatcacctaaaatgtctttagttctttgcatacttatttaattttttaaatatgtattatatgacctttgtgtattaaattgatttgtctgtg

SEQ ID NO: 19666 - DNA, 1055 bp, Homo sapiens
ttatttcctgaagtttagggaaaaaaccctgaaaatgttagtttaatttgtattattatctttttacttttaactataagtaaggcaccattgccaaccagaaaacaggttgagcatcccaaatctgaaaatcaaaaatcctaaatgttctaaaatctaaaacttttttgagcactaatgtgaagctcaaatgaaatgctcattggagcatcagatatcagatcttcagatttggggtgctgaaccagtaagtattttaaaaatctgaaatacaaaacacttctggtcccatgtattttagataggggacgctcgtactggaaaagaaattttaaatttgtttaaaaagtgacaatatatttctgttttacagacctctgtgagtgaaagccttcagagggaagctgctaagaagcaggccatgaaacaggtaaggtagaagactgggataagtgcattcagtgaagcattccggctcatttttaagcatcagttttggtatctaggtgctgagactaaaacagaatagatttaaggaaaaacacaatgaagaattagctccttattgctgtgctatagattaaaccagttctgcttgtagatgactcattagtctaataatggattgtttggcctgttgttattattaaattcttgctagtgagcttacttgcagggaaaaaaaaaaccttttcacaaccaaaatggtttcacaaacttataattatttgaaactcatctgcccagaaagaagaatatcagagatagatacaaatatatagatatatagatatatagattttttttttttttgagattgagtcttgctctgttgcccaggctggagtgccgtggtgcactctcggctcactgcagtctccatctcctgggttcaggcaattctcctgcttcagcctcccgagtagctgggactaaaggcgcatgccaccatgcccagctaatttttatatttttagtagagacggggtttcaccgtgttggtcaggctggtctggaacccgtgacctcaggtgatccgccaacctcagcctcct

SEQ ID NO: 19667 - DNA, 1034 bp, Homo sapiens
ataattctatgagatagatgcttttataatccttattttatagttaaggaaatgaaggcaagaagaatttatgtgacttgcatgagaccacatagttaataaatggtagggctgtgttcaaaactagacagtgaaacctcagaacctaggcttttaaccactgtgtttcacaccctcccggacgaattggcacagaaggatatatttagtcattttaagataatgtcagagtttcacagtgaaatataatgtgtaactcagcagcctcagaatgatttaatatacacataaaacataaaaaacagtgattatttaacataaatactggagtgctttgagtcagaattttggagataccattaagttcaacttcctcactatataaatgggagacttagttctggagagttgggtaacttatccaaggtaatacaggtatcttgttttccaggattattttaacatttttgtgctgcctttttttcttcacttaaagcatgaatcccaaatctgattttattcttaactctgtcttgttcaagccactttatctgtttagtgggactttttgtagtttgcttggaaattaggaatgctgctacaactcttacacctttcacctgctttctgctgattttttctcgcacctatattacatacttttccctttgttccccacttgattgattcagctcatcgaatgtctttatccatacgaattgaaattatttttcattttactatgaagaatactagcttgattgcatttactaaatcttagagaaaatgctttttaaaatggggtactttaaactatttttttcttctatgtggacctcaagtttacagaactgatgatggcaacattattgtcatattccgtttcattgggaaaactttcagtatgtcatcagtaaataaaacatttgctgtaggtctctgatagatatttgttgctaatctaaggaaattattttcttagttggagggttttgttgtttgtttatttgtttaaatggtgaactacatacaaa

SEQ ID NO: 19668 - DNA, 2279 bp, Homo sapiens
acattagccaatctagcaattgaggaaaaaatcaaagtgtgtagactctgtacctcaggaatttacaaccgggggcaaaaggctaagatttgtaaaacaggaagtaaaaacgcccatgcctggcatggtggctcacgcatgtaattccagcactttggggggcgctgaggtgggtggatcatttgagcccaggagttcaagaccagcctgagcaacatggtgaaactctgtctctacaaaacatataaaaattagccaggcatggtggcacacgcctgtagtcccagctacttgggtggctgaagtgagaggatcacttgaagcctgggaggcagaggttgcagtgagccaagatcacaccactggcactccagccagtgcgacagagcgagaccccatcgctttaaaaaaaaaaaaaatctagtgtaaatattgcagaatagaatgttcctcagagtttagaagaaagatcattgggggttagaggcctcagaaatgggctcatagaagaagtagggctggccctgaaacactgggtaagattttgatcgcttgaaagaggagaaaaaaacatcatttgagatggaaggaacatgataaaggcagagactttatgtttaacaactctaaaaatgataatgaaagtttaatatataatacaggcctctcaaaaccaaggttaggtgtttccatcgtaccttttgaccttttgatgggtataattatatacaaatgaataaatgataataatagttgatgtttattgaatacttattctctatcaggctctgttttaagtttagtcatttaattataacagcttagaatgtaaatatagtcattattctttctcttctagatgaggaaattaaggtaccaaaagattacaaacaaacttgcccggagtaattagtaagtgtagagccagcattcatacccaggcagcctggctccagagtttatttgtatttcctatctaaaaatgtgattgtaatttttatgatatattttcaatttatgaaccattctcaaaaagcatagactttgttgtatctattggctggctcatatttttgaaacatgtttaatttttttttaagaccaaactggaaatccagaaggcccttgcagaagatgctactgtgtatgaatatgacagtatttatgatgaaatgcagaaaaaaaaggaggaaaataatcccaaattgcttttggggaaagacagaaaggtttgtaagctgaaataacaaactttctttgaccttgacctacattttgtgtcttaatcttattttaacatgagaatgatctgagaaaaagcttttaggtatgtgaggtgtgaagagtccctaattccagatattacaaatttgattgtagaactcaagcagcactacatattatcctaataggccaggtgaattatctaacaattttgctttttgctttgaaacctttgcaaatagttttttgaaaacttttccttggaattctaatgtaccaaatttgtactgttcctgccctgtgtatgtttatttgtgttttattaccctctcattttttcatttcttcctagctggtaactgaatcatctgcctgcacctatcatgattttattttcagtgagaaaaaaatttgggaggggtaaaaactgaaataagttcagattttctttctatcaactcttgttctttcacaagcacaggctgatttttaagggcatttgcatctgacagttatctactagtagagtgatggtataaaattatattaagctactattttaaatagtcatatttctactaaatgtgaaaaactagcaggaacttttctgatttttttttaattaagataataccagaaaaaagaaaaaaattatatttagtttgatgttttattaaagttaaatcgcattataaacaatttctatctctgctacacctaaatttttatggaaaacagtttcaatattaatcttgctagtaagtttatattgaatgtagggaagacaatcttatttgggccaatcatttctatcttaatgaattcattataaaaattataatattaacaattactatttttttactcttttcctaaatcttttttatttccttagcccaagtatattcacaacttgctaaaagcagttgagatcagaaaaaaggaacaggaaaaaagaatggaaaagaaaatacagagagaacgagaaatggaaaagggggagtttgatgataaagaagcatttgtgacatctgcatataagaaaaaactgcaag

SEQ ID NO: 19669 - DNA, 1072 bp, Homo sapiens
ggcatgaacaggaagataaaccaagggcgagggaccaaagagaaagaagtgacagagtatggaaaagggagaaagatagggagaaatattcccaaagagaacaagaaagagatagacaacaaaatgatcagaaccgacccagtgagaaaggagagaaggaagagaaaagcaaagcaaaggaagagcatatgaaagtaaggaaggaaagatatgaaaataatgataaatacagagatagagaaaaacgagaggtaggtgttcagtcttcagaaagaaatcaagacagaaaggaaagcagcccaaattctagggcaaaggataaatttcttgaccaagaaagatccaacaaaatgagaaacatggcaaaggacaaagaaagaaaccaagagaaaccctctaattctgaatcatcactgggagcaaaacacagactcacagaggaagggcaagagaagggtaaagaacaagagagaccacctgaggcagtgagcaagtttgcaaagcggaacaatgaagaaactgtaatgtcagctagagacaggtacttggccaggcagatggcgcgggttaatgcaaagacctatattgagaaagaagatgattgatggctaccccaagagaaagatttaaggaagcacagaaaactgtaattcctggaacctgctgcgtaaaaccataaaggagtgtgttaccagtagtttggagggcatttttaaatttattttcaaaattttaagttaaaagtcagtcttacagcttggatgtttggatgtggatgtttggctgaatttatatatagtgtgtactcatcaataccacattctttgttgtattcaagaaccgttaagagtgtgctaattccctgtaggtacataatgaggaaaatttgctccactacaaccattaaaaaataattttggccagatacggtagctcgtgcctgtaataccaacattttgggaggccaaggcagaaggatattgaggctaggcattcaagaccagcctaggcaggataataagaccttgtctctatttaaaaaacaaaaagcctagcatggtagtccatgcct

SEQ ID NO: 19670 - DNA, 1022 bp, Homo sapiens
aagctggaactacaggtgcccgccaccacacccggctaatttttgcatttttagtagagacgggggtttcaccatgttggctaggctagtctcgaactcctgacctcaggtgacccatccacctcggcgtgccaaagtgctgggattacaggtgtgacccactgtgcccggccaagaaacctgtttaacttgccttagtccagcagtctccaaaaattacctgactacataaactttttctccagcagtaatacctgtgacagcccctggaacacactttgggaaatgttaacatggtcaaatgagcacatttgaaagaggaggaaaccgaggcccagataagatgagtacctgccagagccgactagggccttttccatggtcctcaccgacaggggtgtatcacactgcttccgggtaacccgctgctccccatctggtggcccctcgtgaagacgccctacctacaattagtcttacctctattgctaacagacctgagctctgttagtgacacacttttgggtggcattcccttgtggccaactgggggaatttgtgagaaagatggccaggatctgaggtgtagcctgtgactaaagaatgacatttattaacctaacacagttcccacctccaaccttggcctctggatttgaagcaacagagctcatggatcatcacaactgccaagacagatgaccggaaggaatgcgttcaatgactctgggtaggagagtgtgcgggaagcagcacgggacccaaggctctttagggggagtgcggtcatgagagggctggtttggctgtaggaaattagtaactacggagctcagagttctgttcacccagaatacagttttcctgtttcaaaaaagaaatgaacgcagttgttctcagaaagggctgatatttggccgggtgcagtggctcatgccggcaatcccagcactttgggaagctgaggcaggaggattgagctcaggagtttgagaccagcctgggcaacatagtgagatctt

SEQ ID NO: 19671 - DNA, 1035 bp, Homo sapiens
ggatgaaatagtagtatctgcctcatataattgctgtaaagattaaatgctaatacacataaagctcttagaacaggtctggtgtatagtaaacacacaaagctgctattattattgttactggtattaactgatatattcatactttttataactgctcatcctattaattaaatgtattttttcactatatattctttttcaatgtatattccttttaatcttccttcttagcctccactatagttcagatgccttctccaatttcaaacaatttaatgaaaagaaaagaaaatttatacatccagagatggctgatttaatttcttcagtcttttggagggtagaattattttccttctgagagtaaacttattttttctatgttacaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggtaaaagtagatgactggaatgttggggtatagaaacaggattaaataagggagaaatttggatgcatgtgaatgataatctatacagtattagatgtcatttatctctttttattacttaagattataaattatctttaaagattattagattataatctattaaaacatattctagctctgcttcccctgccccttacccccagctctctgctccatagggcttccttttcctatcttggaacacttacttatacaaactgaaataattagccaaatttgtactctcaggttcttacaatgtcatgtgatcatatttgctagtgagcctttaccactatatgaaccatagacatcagtttaatttaaacatcacccagactaatacagcaattgaatacaccagcagttacaccttgttgagaaaattagaaatctggctttgaggagagggaattttaaaagcaccttactagtgtcgagttcagacatatgactta

SEQ ID NO: 19672 - DNA, 1130 bp, Homo sapiens
taaatttctcccaaagttagcttggccgatgcccaggaatgaccaaggacagcttggaggttagaagtaaggtggagtctggctgggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaattccagctacttgggaggctgagatgggagaatcgcttgaacccgggagatggtggttgcagtgagctgagattgcgccactgcactccagcctgggtgactgagtgagactccatctcaaaaaaaaaaaaaaaggcggagtcaaccatgtcagatttcttttactgttataattttgcaaagacagtttcataatcataggtgattgataatagcgaagcctgatgtgttcacatttgccttgagttaaggtatctaaagtagtacgtgttggaataaaatataagtgaacatggcttatattcaaatcctttatcatatcatacaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggtatggcaactttatattctactaatcagttcttgttgagagcatttggaaatcctggtggaattttatctgtttgtagtgttatgctttcttaaaatgagtatcctgttactgctcttatggcagacaacagtaaaggtcttttctcattactttttcagccagtgtcctggctgtttctttcctccttctttctctctttttttcctcctcttctcttctccttttacccccatctcttctctccacccctttctcctctcttttctcacctactacttctctttcccttctcttacctcctctcccctttcttctctgtcttgtcttttttctcctctcctctccttctcccccgcctgtccccctactctgttcttcctcctcctc

SEQ ID NO: 19673 - DNA, 1027 bp, Homo sapiens
cgcagctggagcttgtgaattaagctgataaaagacagattaaaagaaaaaagcatacaaattttatttgatgtttgtatgtggcacaggcaacaggcagtgggggagttcataggaaagacgtgaaaccctcaaaaaagcagtgttaaggacttagtgctcttataacaaagggtaataccttgtggaaaagtgactacacaaaggaaggggtttagacttctaggggtaaaaaattgtgggaaagtgactaggaaatatgcgggggaaactaatgaaagatgagggttattttactaaggtttgtttgtgtcaactcatcttggtgttgactatcccatctctgatggtaccaggaaggtgcctttctcacgggaaatttatgccctaattttaggcagaaagagggagggtagatagcctttcctgcatctgctgtttctcagttgccttcagctctaaataattaacatgctaaagagttatattctggggcagaatgttctgattcctttccctgccatctttataatttagaaggatcttgaaagaagataggggaaagcaatattctttttcataaaatttcaaaaattttgatactaatttttttattgaggtgaagtttacataattccagtggcgtttagtgcattcatagtgttttgcaaccaccccctctatcttgttccaaaacatttttatctccgcaaaaggataccccacacccatttaacagtgactcccctttcccttctcccctcaacctctggtaaccaccaatctttgttctgtctctagggatttacctattctggatatttcatagaaatggaatcctataacatgtgacctttcgtgtctggcttctttcatttagcatagtgttttcaaggttcactcatgttgtggcatatatcagtacttcattcctttctatggttgaataatagtacattgtatatacatatgtatatatcaatatcacatttgctttatccatttacgtactgatggacatttgggt

SEQ ID NO: 19674 - DNA, 1035 bp, Homo sapiens
tttgctatagtccatatgtgtgctctccaacttcagctgaaccctcagtcctacatggcaacatttcctgtttagctacttgactccctggctcagttcccactatggtgattcagagcctttatcctctatctgagcctcctgttccagctctatccctcttattcatagtagatcactttgcattgaactcaagtagaactttgagtaatctgatgtgagttcactaagattctgtcttctcaattgtttctcatgtgtgtcttaacaatattctcctccatttcttgatcccactgcattctgcctcctcgaatcttgtgtcttcatatcttattttataaatgaggaaggtgataattaaactccccagtcttcactcacagccttttttctcttggtcaataagcagctcctctaaaaatattgtcttctgctaaccttagtaagcccccatgaagctaccattcaaagtttctttatttttactcttcaaaacttctcaaaagtagatagtcttgggagacatctgagcagccaaagacaatgatggctatgtgataacctatctcccagggtttttctttaaacaatataaaacgacttaaaaactaccaaattttacacaaaaccacactgttggcatcacaaaagatcctgaaactgcaaaataactgtaaattttttaaaaatcaagaagtctcagcatgatctatcatgcacctaccccaccttcgccccaccacaaggctttgtggtgaggtaaaacagaccaagaaaacttacggagaagacagaagtgggtgccagtgaagggcagctgtgaaggtaatttggaatgaccaccatacatcacatatgcactaaatccaaaaatactaaaagagtaactgggcagattagagctctggaatacagggaagagatttcaaaatgcacacaacttaaaggatctggtgtgatttaatgggataagtacaatttaaaaggagaggatggttacagggagatcttccaaactcatagcttctggag

SEQ ID NO: 19675 - DNA, 1069 bp, Homo sapiens
agactccatcttaaaaaaaatcatgaaaaaaaatccattcatattttgtaatatacccatgtctattctttattaatgtattaaaaataataaattactcaacgttaaaattttgtctctttaggaaactgcaccacatttatcccaaggattcttacgttctctgcacacctgccttcccagggtttgggtactccagctgcaggagtgtggttctgatctgtctcctttatcataggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaagtaagtgtcactttctattgtctttttttttttttcaagacagtaaaatcagcattagccatgttgaatagttgtaatttatatagaaatatttgggaacagaatgtacagagagttggagtttacttattttgcaacatgtatttgcttggagatcttttttttttaattatgctttaagttttagggtacatgtgcacaacgtgcaggtttgttacatatgtatacatgtgccatgttggtgtgctgcacccattaactcgtcatttacattaggtatatctcctaatgctatccctcccccctacccctaccccacaacagaccccagggtgtgatgttccccttcctgtgtccaagtgttctcattgttcagttcccacctatgagtgagaacatgcagtgtttggttttttgtccttgcgatagtttgctgagaatgatggtttccagcttcatccatgtccctacaaaggacatgaactcataattttttatggt

SEQ ID NO: 19676 - DNA, 1037 bp, Homo sapiens
aagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtt

SEQ ID NO: 19677 - DNA, 1035 bp, Homo sapiens
tatgcagtgagccaaggtcatgccactgcactccagcctgggtgacagaacgagactccatctcaaaaaaaaaaagaaaaaaaaaggtaagtcattttgctattatgaaaagaagttcataagcctaataaagctttggaacataaaaagcaaaatccctttcaaaagaataatggcttctttcttataacattaactggtaagttgataatgctggtcataaaccatatttttagttcctttgtgatttgtattatcttcttgtttttctctgaattgcagaattttagttattgctatacaaatagtttcaggaaggatagaacaacatttgttttctagccatctttggagtaaagctgcgaagttgcatctaccattactatttcccttcttgccccctctgaagtttataagtgactaatctgctttgctgggcaagtccttggtttccttcttttaagacttttattttcctttttttgagacatagttttgttcttgttacccaggctggagtacgatggcgcaatcttggctcaccgcaacctctgcctcctgcgttcaagcgattctcctgcctcagccttccgagtagctgggattacaggcgtgcgccaccacacctggctaattttctatttttagtagagatagggtttctccatgttgatcaggctggtctcaaactcccgacctcaggtgatccgcccaccttggcctcccaaagtggtgggattacaggcgtgcaccaccgtgcccagccaacacttttctttatgggggtaacaagatcagtatatgatcattttcatagtttgttttctttagaatggtgctgtgatttttgtgtctactttttatgtctaattatttgttgttataattttgttaaagatctcaggaaacaggctcgacagctggaaaatgaacttgacctgaaactagtttccttcagcaaactatgtacaagttacagtcatagcagtacccgagatggaagacgcgacaggtataggtactaccagattctgt

SEQ ID NO: 19678 - DNA, 1076 bp, Homo sapiens
cctcagcctcccaagtagctggaactacaggcgcatgccaccacgcccagctaattttttgtatttttagtagagacggggtttcacggtgttagccaggatggtcttgatctcctgacctcgtgatccacccgccttggcctcccaaagtgctgggattacaggcgtgagccactgtaccctgccgttctcatttctcttgagtaaatacttggagttgtattgttgagttgtatggtaaggatgtgttccaatttataagaaagtgtcaaacttttccaaagtggttataccatttttgcattcctgtcagtggtgtgtgggagttcaaattgctttaagcccttgccaacacgcctttctattgtaaccattttagtagaagtgtaatggtttttattgtggttttgatttgtatttctctaaggactggtgatgttaagccttccttcaagtgcttattaaccattcacgtatcttcttttttattattcacaactcacaggttattgtgacatttgtatatcttctttagtaagggggtctgttcaagtctttttgccttttgttgtgggcttttttctattgtgttataagggttctttgtgtactctggatgtaagtcctttgtcagataaaggttttgcaagtattttctctgagcctgtgacttccttttcttttcatctggtgactttcaaaagagccgaggtttttaattttgatgaaatctggttgatcagttttttctttctgattcatgtattttggtcctatttaagaaatcttggctatcctaaggttacagatttttttcttttgttttctttcaggagttttagttttagcttttttgtttgtttgtttgtttttaaacctgcagccaacatcatacagttttagctttaacattaggtttataatccactttggcttcacttttgtgtgtggtgtaagttaagggtcaggattcatttttttttaaacacatgtatattccattgtttcagtaccatttgttgaaaagactcttttcctctgtttaatcttttcaaagatgttgacatctttctaga

SEQ ID NO: 19679 - DNA, 1052 bp, Homo sapiens
gttttgggtctgatttggtttggaacctgcctgtgctgtttattagatcttagatttctgttctttagataattaacttcttggaactttcattttcttatctgtttaaaaatatagtattgatgataatacttatctgtaagactgttaaggataatgtgaggaaaatgcctgatctaatactaggtaatctgtaaatggtagctatattattaataccaatcctttcttttttagctttttatttggatatcatttcagatttcagaaaaatttcagtagtgaaaagaagtcctatataccctttacccaacttctacaaagtttaacatacattgatgctctttactcctaaatatttcagtgttcgtttcctaaatatctgtttcttttgtatggcttcatggattctttattcagtggattggaatattttccatcattaatcatcttaatacattttagtcttttataacagtaagccatgattgtgtcttgaatttttgtttaaattgtatgtgctgagccttccacctgaagaaagttttcacagaatttccttatgttgactgaagtttcttccttgtaactttttccttttcatcagcacatgagatctgatcacattttgccaggaattctttacttaaagtttcccaatcatcctttttcttttttcctttatttccctttctttctgcctgctcttctagggccaggctgccttaattaagctttcacttcagaactggcctatttaagggctggtaatatgagtataaaaacttggggtacctcatagggcaaaaaagaaattaaaaggaacaattgagaaccattgaattgttactattattttgctagttagaaaacatgttattaggtcttttatttcagtattttcccttgtttcaaaatatgataggcattacaagaaaagtttcactgagtataaagctagttatgatttcttatgaagaatataaagtttgtgtcaaatagtatttttgcatattccatatggaaaaatttaccttttccttttagagata

SEQ ID NO: 19680 - DNA, 1389 bp, Homo sapiens
ttaaaaattatccaccaatttcttctacattttagaaagcttttaaattcatgttagaactccacactatacattattcttacctaaacatgataaattatatgcctttgttgtttttcccatttagagataagtcagtggcagatgcttggaagggggaaggaaggagacagccacccgtgcagatgagctatagctactgatggagtttgtaactctatgcacaggctgaattctaggatacattctccacttgtttgttgtaacctctactttaaaatgtttcagttttctgttttaaattaggattattaatacttcccagaaacccactagggaaccagaaaagcctggcactctgagtcatttcattcagcgaacctctgaaaagacaagccttctaggcaaaaagctttcctccccaactgccaaagggggaggaacctagaattttcaaaagctgagtatcttgtagtcctagataatttgagttcacttttagtttgatatgtctttgcctaaggaaaagactctcctgatgtgtgctgttattctccagtccactgtgaattttgttcttgccttgtcaccctaagtataaaaccacatgtctaaaatcacattttagatagggctataaaatttacagagtgctgttatatacattatctcattttactaaactatgaactcaattgccagccagaaaagctgatcagtgaatttaagagtttgtatttagtgaaacttttgaaactttgaaatagaagtgtgagtcagatagctgatgatttaaaacactaaagcctttctcaattgttcattagaatttaccaccactcttctttgtgacctcttctctactgctctgtaagcatctctcccataagttctctctctctttttttttttttttttttttttttttttaagacagagtctcaccctgttaccatccaggctggagtacagtggcacgatctcagctcactgcaacctccagcctctcaggttcatgcagtcctcccgcctcagccttctgagtagctgggactacagacacgtgccaccatgcccggctaatttttgtatgttttgtagagatggggtttcaccatgttgcccaggcgagtctcaaactcctaggctcaagcagtccttcagccttggcctcccaaagtgctgggattataggtgtgagccaccctgcccagcccaacactaagttcccttaaggcaaagtagtatactggaacctagcatagcgcctcatacaaataagtcacatgggaattttacaattactccaaaagaatgtgttcaaaaaaaaaaaaaatcaaaaaaaatgggtgtgggtcagggctaaagtttagtccactttcctcctgt

SEQ ID NO: 19681 - DNA, 1027 bp, Homo sapiens
aaaatgaggaaagggagggaaatgggtggtggtggcgatgggagctggctatgcctgtgcctccctgccagagttcctccattcctggccacgctggctcccaccctgacctgaagcctggcagtaagccctcagtgcttgggaactgtcatcgtccttttcttctccctctctctctattactattcttatttgtgttacacacaagactgggagatgtgtattggttaggggccttgagccgcagcgcgttcccggtttgggcaactgcatctgctaaagattcccttggtgtgagtttcttccccatgcctttcatcactgtttctagacaccactgatctctatttttgtgattcctacgacttttcgccagagaggcttcttccaaatatgaccttaataaagatttcccaaagatcgttttcctgctgtaaacagcctgatccagaggatcaacctgaggaagcggcgggactcgctcatcctagggggtgttattgggatctgtaccatcctgttgctgctgtatgcgttccattgatgggacatcttcagggactcttgacagccaccgctttcacaccctggtctggaataaggaaacatcggagggagaagttgactgtcttgataattagcctgaccagcaggatgaatgcaagactgacagtgatggactctgtgacatggtcaggttgagctgaagccacagtttctctgtgctgtgttttctaacacatttttctgtttttaattaaaaaaaaaaaaaaaaggttttcagttgcttttgtctccctaggaggcaggtaaaccaatcaaaaacagagttttctgtgtttccatgatagtgttgaagcctaatgacaagccaggtcttacagctgggctcttcagaaaaccaggtttctacatccaaagactgcttttcttttagctgccagattggattgtgaataaaaataattcttccctctccctctccctctccccacggtctccctctttccacggtctccctctgatg

SEQ ID NO: 19682 - DNA, 1074 bp, Homo sapiens
tgagaggccaggcaggtggatcacttgaggccacaagtttgagaccaacctggccaacatggcaaaacctcgtctctactaaaaatacaaaaattagtcagtcgtggtggcgggtgtctgtaatcccacctactcgggaggccgaggcaggagaatcgcttgaacccgggagggaggcagaggttgcagtgagccaagattgcaccactgcattccagcctgggccacaaagtgagactgagacaaaaaaaaaaaaaaaaaaaaaaaaaaagctgcctaacaacgcccaaatccagcagcttaggacaatcagcattaattttggcttcgcaggctacagggcagtttttctgctcctggctgggctcacccaccagcgtctatgggtccaagagtcacactgtatttattcaggctgggtcttttcgtatatttgggcccggctggctataggctggtctaggacaacaggattcttccctcatcctccagcaggctagctcgggcttggtcacctgacaggggcagggtttccagacgtcgaccagaaagatgcaccacctcttcaggcctagattgggaagtgacttcacttctgctgcaatccattgattggccaaaggagatcacgagaccaacccagattcaaggggtgtggaagtaggctccacctcccagtgggaggagctacctaggcaaagagtatagatggtgggcggtagaattgggtccgtgaagccaacttgaccagccccatgattcctttggggcttttgataatcattccctgcccctccctgggtaccccaaggcattctatggtcctcgaccctagctttggcccctgtagaagttctttttttttgagacggagtctcgctttgtcacccaggctggagtgcagtggcgcgatctcggctcactgcaagctcctcctcccgggttcacgccattctcctgcctcagtctcccgaacacctgggactacaggcgcccgccaccaagcccggctaattttttgtatttttagtagagacggggtttcactgcgttagccaggatggtctcgatctc

SEQ ID NO: 19683 - DNA, 1030 bp, Homo sapiens
tggtctttctgggccacctcctccctcctcgttgctcctccagtgtgctaagtgtgatcctaccccggggcgtttgcactgctgttctgccatctaggacccttccccagatatttgcgaggctttttctcccccaccctcttgaaatatcacctccccagtaaggtttactcccaggcaccttctgcagagtctcagcttcccacacccctcctgatgttcagtacagcagacggcttttcacataggctgtaatttcctgatgttctgcgcttgtttgtttactgtctgtgtctgtgaggaggatccaagtgcgcgaggatgttgtgatttgctttgctttgggaatcccaggtgtcagcagtcatcactggcccacagtgtgcgttcaagaagtcttacctgacccaggtgtggtgactcacacctgtaaacccagaatgttgggaagccgaggtgggaagattgctcgaggacaagaatttgagatcagcctgggcaacatagcaagactcgtttctaaaaaatttttttaatagttgggcatcgtgaatatgcacctgtagtctcagctgctcaggaggctgaggtggaaggatcgcttgagcccagaagtttgaggctgcagtgagctatgattgcacgagtgcactccagcctgggcgacaaagcaggatcctgactcttaaaaaaaaaaaaaaaaaaaaaaggcccctgccttcactgtctcctgttccaaaatttggggggagataaaaattcaataaatagatgcccaggccaaaaatagccttgcccccccgccaaaaaaaaaaaaaaaagcctcagaatagtcagtgcccctccctcagaggctaaaaataccctgcaggtcacaaatgatcaggtcaggaagccaggtggattctccttcctgtccttgaggaggtgaggggtccggggctggctttctcagacaggatttcccagatgatttccattactcctgactttggcactgcatcattctctgtgggaggctgtcctttgt

SEQ ID NO: 19684 - DNA, 1029 bp, Homo sapiens
cctgtctcaaaaaaatatatacataaataaaatagagtagaggttggctgactttcctgtagaaagcccgatggtaaatcctgcaagctttgcgggccgcagacgggttctgtggcctgttctcttttctcttctcttcagtcctttaaaaatgtaaacaccattcttagctcaccagctgtacaaaagcaggctggggcctggccatggttggccgaccctgccccagaacgccccctagtggcttctgggagtgaaggctgggcagaggggcggccccatttggggagcagttgtgtgcttaaagtacaaggcgagtcccgcgcagtctgttcccggcacctccctgctctcacctcctcccactctcctcaccagctcacgacccgcttcctcgatgcagctgccaccgttattcaaacatacaggcacagtccagccccagggcctttgcacgggctgtgaccctgcctaggacgctcttctaactctcctgaactgatcacctgcgtgctcctccctcaaattcacagaggtttgctaaaatgtcatcttctccaggggagatgacctttcttgatcatcctgttgaaaattgcaacagccgggcacagtggctcatgcctgtaatcccagcactttggaaggccgaggtgggtggatcacctgagatcaggagttcgagaccagcctgaccaacatggtgaaaccctgtctctactaaaaatacaaaaattagctgggcgtggtggtgggtgcctgtagtcccagctaatcaggaggctgagtcaggagaatcgcttgaacctgggaggcagaggttgcagtgagccaagatcatgccattgcactccagcctggatgacagagcaagactctgtctcaaataaataaataaataaaagaaaataaaattgcaacagccgggcatagtagctcatgcctgtaatcccagcactttgggaggatgaggtgggaggattgcttgagttcgagaccagcctgggaaacataacgaggcccccattt

SEQ ID NO: 19685 - DNA, 1164 bp, Homo sapiens
gttttggttttcagcagggaaatggtaatgggggctctgatgagaaattccaggctggacataagagatttgaaagtgctggctcaatgatggtactgagagcccaggacagcctgagatgggacaggctgggatgacagctggatgtgacagagcaggggttcccatgctggagggcccgcctcagagaatgtgtgtttctggccagcacagtggctcacgcctgtaatcccagcactttgggaagccgaggcaggcggatcacgaggtcaggagatcgagaccagcctggccaacatggtgaaaccctgtctctaataaaaacacaaaaaaattagccaggcgtggtggcgagcgcctgtaatcccagctactctggaggctgaggcaggagaatcgcttgaacccgggaggcgcaggttgtagggagacgaaatcgcgccactggcactccagcctgggcgacagagggaggctccgtctcaaaaaaaaaaaaaaaaaaaaaaaaaagcaaggctcgcaaaacaccggattccttctcagctttctgagctgaaaaggtatagatcctcaagaagagaagagtgtatgtaagtacttctcaaccagtttacctctctgaccgctcttacggtgtttgggggcaaaaaactaaggatctagactctctaaaccgctcgctgggtccttctctccccacaatgcaccggggccagcaggaaggccgctccgacccctaattttcccgcgaattcagttcaaagaggcggccgggcccgcgatcggcagcgcgcaccggccaaccaagccgcgcctccgcgagaagcgcctccgcgtgactgacgggggaatccgcgggccaacgggctgggcggcccggcggtgcgcgctcccgccggccaatcagagcgccgggcgggggaagtgggcggagcgaggcctgggtagggtgagcggcctccgaagcggagcggggctctgaggagacactttttcttcctccctccttccctcctctcctcctgccttcccttcccctttcctcccctctctcctccttctcccctcggtcagccggagcctgctggggcgagcggttggtattgcaggcgcttactctccggggccgcccggcgagtagctggccggggaaggaggcaggaa

SEQ ID NO: 19686 - DNA, 1361 bp, Homo sapiens
tttctactcggcttacaggacattttcttgggtcaatttctgtttctaaggtctgtctggtaggtgaaactgacttatttggaaaggagagcaaggtgtctggaaataaacaatagaatttattaaaaacatcgtgactatgaataatcctgattgttctttaaggaatgttatatcctgattggtttccttttttgcttttgtgtgttataatttgggtgatctttaatagctaagtaatcttacagaaacttgaataaacttggctctaccgcccagtgtccttatttacagtttcactgtggcatatattaagggcatggtatcagctgtgcttagaaagaccgtattatgttgtttaatacccttccttcattctctctcattagtgcttcatgaaattctaattggaacttaatagaaggagtttcagtttttatcgaaacgaatattgaccttgcttcagagagattcacattattcacatatttcttaatatactttgaaatatctagagaggctttaattggaaataggatggagaactgaagggcagtggtgacaataatgatacttgtttgtaccccttctaaagtatctcatctccctttagttaatttaagataaaactaaccaattgaagatttaggtggaaattttaaaagttctttctgaatgttaagagaagacacattctccaagaaagttttaactatttgcgttctgatgagtcgacctcagggaagtcaagtgtcattaagagctagatctggtcataaaacaacttgaagttgtttactggaaagtttaaatacttgaatgtaattattcacagttatttctatttggtttattctgatactgctgtataatgacaacgtgatactaataggtcattaatgtaactaatataatagtatatgtatttttcatccacttaagtcctgtataacaaattacattttaactaatttgaaatttaattcaactcattttaagcgttagacggttttgtgaatctgtcaattgtgtaaaaaatgtattgaggtaatatttatattgaacaaaatagataaaactttaaattataattaggaatatttattgagaattttttctgcagtttgtgtccgagatttatttcaacattgactgacttttgagtgcagtggatcccacctgtaatcctagctactctggaggctgaggcaggaggatctgttgagcccacgagtttgagaccagcctgggcaacatatcaagaccccttttcaaaaaaagaaaaaaaaaatcttgactgactttcatcatacctgtattaggaatgtctggatctgtattaggatgtcatcatatctgta

SEQ ID NO: 19687 - DNA, 1033 bp, Homo sapiens
tatcagtttacattaagtgatatactttaggaaagaggaaaaattacagtgatcattttcctagtgatcaccttgatataaggagttagaaggaatcttagaggtcagtttggtccaaactcacacacaagtcagaaattaatttctgtagcattcctggcagagaatacttaagctgtggcttgaatacctccagtgtagttgtatttattattctttatctttattaccagtttcttccattttgagtgaaacctctgacttctgccgttggtcttaactctaccacctcatttaaagagggatactcacatttatagtatatgtgctaggtactgtggcagggacttcacaatatcacgtatcttgtaagttattctcaaatatgagaggggttctctttttttccatctttttcttctcatttaaatctgtcaggcaacatattcataacttttatttcatatttgaaatatgtttctcacatagtttcagaaacttgaacatttggacagaatctacttattgtacattagcaaatatatacctagaacgaatccctaaatgttctgactagtctgatatctgtctactctagatagtatgcttctatttattttttgatatgtaaactttattttttgatatttttgatagaaaattgaatattctaaggagaaacagcagcttgggtggtgtttgttcattcattaactacctttagagagaatgcagaactaaaaatattagattcttaaaaaaatagagttggaaaatttgtcacagtgcatttttcttttccttctagttttaaatcacagcttacgaatttagataggatacacacttaatgatgcatcatttatgcatctcattgttttcccattgttctgttaactggtaaaagacttcctttttttcagtttggcttccttctactttaagtttggctttggaattaagtgatttttttacttggattgtaaaatgatattttttattttatatcctgcaatcttgtggggttgaagta

SEQ ID NO: 19688 - DNA, 1047 bp, Homo sapiens
tatttttattttttgagacaaggtctcgctttgtcaccgaggctggagtgtagtggcataatgataggtcactgatggattgaactcgtggactaaagggatcctcctgcctcagcctcctgagtagctgggactacaggcatgtactgtcacaccacactaattttttgaatttttgtagagtcagggtctcaccatgttgcccaggccagttttgaactcctatcctcaagtgatcctcctacctcgacatcttgaagtgctgagattacaggaatgagcccccatgcccagcctgaatttttatttatttatttatttatttatttatttatttatttgagactgagtctcgccctgtcgccaggctggagtgcagtggcgcgaactcggctcactgcaacctctaactccttggttcaagcaattctcctgcctcagcctccggagtagctggggattataggcacgtggtaccacgcccagctaatctttgtatttttagtagagaaggggtttcaccatgttggccaggatggtctcggtctcctgaccttgtgatccacctgcctcagcctcccaaagtgctgggattacaggtgtgagccaccgtgcccggctcatttttatttttagtaggttgataagtcaatgtgccttttttgactatttatttatttatttatttatttttgagacggggtcttgctttattgcccaggcaagaatgcagtggtgccatctcggctcactgcaacctccgcctccagggttcaagctgttctcctgcctcagcctcctgagtagttgggattacaggcacacaccaccacgcctggttaatttttgtatttttagtagagtcagggtttcaccatgttggtcaggctggtctcgaactcctgacctcgtgtcctgcccatctcggcctcccaaagtgctgggattacaggcgtgacccaccgtgcccagccgactttttgtttttgatgcaacctaagcttttgaattagtaaccttccttttctaaacctccccgtttttaag

SEQ ID NO: 19689 - DNA, 1077 bp, Homo sapiens
gggagtgcattgatacgttcatagcttactgcatcctcgaacttccaggctccgttgtcttactttattttttattttactttttagagatgaggatttgccctgtcgctgaggcggcagtacagtggtgtgatcatggctcaactacagccatgagctcctgggctcaagtaaccctcctgccttagcctcctgagtagctgggactacaggcacatgctaccatgtcccacttattttattttattaaaaaaagtttttttaggagacagggtctcacttcatcacccaggctggattgcaattgtgcgatcatgactcactttacccttgacctcctggcctcaaatgatcctcctgcctcagcctaccgaatagcctaggaccacaggcgcaagataccatgcctggatgattttgtaaaattttgtagccgggcacggtgactcatgcctgtagtcccagcactttggaggccgaggtgggcggatcacgaggtcaggagattgagaacagcctgaccaacatggtaaaaaccccatctctactaaaaatacgaaaattagctgggcagagtgtcgtgcacctgtaatcccagctattcaggaggctgaggcaggagaatcgcttaaacctgggagatggaggttgcagggaggagagatcgcgccattgcactccagcgtgggcaacagagcgagactacatctcagaaaaactttagtagagatccattatcttgtcatgttgcccaagatggtctcaaacttctggcctcaaacagtcctcctgtctcagcctctccaagcattgagattacaagtgtgaaccattaacacccagcctgttgttttaaaagttgtatattattattattattatttttttttttttgagacggagtctcgctctgtcacccaggctggagtgcagtggtgcgatctcggcccactgcaagctctgccttcccaggttcaccccattcttctgcctcagcctcctgagtagctaggactataggcgcctgccaccacgcccggataattttttgtattttttagtagagatggggtttca

SEQ ID NO: 19690 - DNA, 1127 bp, Homo sapiens
catggtgactcacgcctgtatcccagcactttgggaggtcgaggcaggcggttcacttgaggtgaagagttcgagagcagcttgaccaacatgggaaaaccccatctctactaaaaatgcaaaaaattaggccaggtgcggtggctcatgcctgtaatcccagcactttgggaggtcaaggcaggcggatcatgaagtcaagagattgagactatcctggccaacatggtgaaaccccgtctctagtaaaaatacaaaaattagctgggcgtggtggcacgtgcctgtatttctagctactcgggaggctgaggcaggagaattgcttaaacctgggaggcggaggttgcagtgagccgagattacaccgctgcactccagcctggctacagagtgaaactctgtctcaaaaataaataaataaataaataaaaaattagctgggcatggtggcgtgcacctgtaatttcatctactcgggaggctgaggcaggagaattgcttgaacccaggaggcggaggttgcagtgagtagataccgcaccactgcactccagcctgggtgacagagggagactccgtctcaaaataaataaataaataaaatctgtagactacatcttaggttggttgtgtgtctttcccaccattaataagatctgatgttttccctttcttttttttaatacactttgccttgactataagctttgaagttgttttcaaattgtcatcttttcagtcttgagtttttgttcttttttcagaacctggctatacatttctttttgcatacttactcttgaaggtgcctcatcagttgccatttgagcatatctgattcttaaaaatttgaatattcaagaacaaattgtaaaaatattccttgtataatttttttggttttgtagtaattcctttgttttcttcacagtacttctgcagagtgatccatttgtaattaatagacacacacacatcatccaccattcagctttatcttctcattagaaagtgcgtctaacccctatattttgagatcctggatttcagaatattggacttgatgtagacacgagtttctcagctttacatatcataggatcaaatgtatataacaaaagttg

SEQ ID NO: 19691 - DNA, 1048 bp, Homo sapiens
tttgttcttactttttgtgagttgtgagggattttttgttgtttattttttgttaggtgtatagacaaacttttggatgtcatatttaacagggaaagcatagagtcatgggcctgaataacaattgagtacaaatatttataaattagttgaagtaactttgatttcaatgttatattttaaagtctaggttattttactacagagcattaaaatgataaaatatttccttttttttttttagcttgtcagctcatttgcagcttacatttttggtttcttccacaaaaatggtatgtacttaaaagtaaataaagtggcattttaatagcaagatacctttgtgaatgtaaaaaaaaagtggggcttctgagtgtaaatttataaaattaagtttaatggaaaagatgttgattctgatgtttttgagctttaaggtatgaaggctaatgatgaaatttgtttttggtgggtgggtggtgggggaggcagactcttgctctgtcgtccaggctgtagtgcaatgttgtgatcttggctcactgcagcctccgtctcccgggttcaagcaattctcctgcctcagcctcctgagtagctggtattacaggcacgcgccccatgcctggctaattttttgtatttttagtagagacagggtctcaccatgctggccaggctggtcttgaactcctgacctcgtgatctacccgccttggcctcccaagggggcgtgagccaccacgcctggctaatgatgaacattttaacaaattgtcttagaacttcaataggtaaagaatctcctcagtagaaccttttatgcataaacattttgaattactgataatgtatcatgtttttaaaaaacacagtaaaacaactgaaataaccactattaccaatggcatatattaatattttaaatattattcaaaggaaattatatagtatattactcccgtaaaagctcaaagcatgctggaaagaattagagttgttttaaaaatggaaaaatacggccaggtgcagtggctcatgcctgtaa

SEQ ID NO: 19692 - DNA, 1049 bp, Homo sapiens
tctactgaaaataacaaaattagctgggaatggtgtttcatccccgtaatcccagctactctggagattgaatcatgagaagtgcttgaacctgggaggtgcaggctgcagtgagccgagatcgtgccactgcattccagcctggacaaccgagtgagactgactcaagaaaaaaaaaaaaaattacccgggcttggtggcgtgtgcctgtagtcccagctactcgggaggctgaggcagggagaactgctttaacccaggaggcggaggttgcagtgagtcaagaacattccattgcactctagcctgggcaacagagcaagactctatctctcaaaaaaaaaaaaaaaaaaaaagtaaagaaagaaaaaatgtgttgcccaatgccttagaacaaaaatttttttttgtatgttcatggattcatctattataatagttctggatgttattgaagctatttgatgaattatttattaaatattcagttatgaactgttaatacctttgggactttaaaaaaaagttatggaggactactctagaaccttaatttgtaaagcctttgttagttaatttacatagagaatatagactatggtattcaaaattaacacccctaaattttttgtaagccaagatattcttctagatagtaaataatatcttgatttttgttatcccatttaaactgtagagaaattctggggaaagcgtctaaaaatagctctgtctctacgttttataatgtttaatgttttttgaaatccattttttatccttttggccacaagtcttggtcagatcaagaactttttagtttagttgtctctatgcattcataatgaaacatgtataatagtaactgatttaattcaaatgttatcttaataatttttctagtagattttaggagaagaaaaaaattgaagatgcttattttgaatgtggttgtctcctgcaacttttttttttggagatggagtttcgctcttgttgcccaggctggagtgcaatggtgtgatctcggctcactgcaacctctgccc

SEQ ID NO: 19693 - DNA, 1022 bp, Homo sapiens
tgaggaaaaaagaatgagtgaacttttgagaagtcttattatgggaaatctctgtttgaagttccctgacttgttagcaaaatgaataccgtgttcatatatttttaaaatatattttaaaatactgattttctatttagataagccatcaccaaactcagaaaatgaacaaaattctgttaccctggaagtcctgcttgtgaaagtttgccacaaaaaaagaaaggtaatgtcaacaaaatgatattggtagattaaatggaataatttgcttaattggacatctttatgcatatatattgtattttaaagctgagttttaaattttgaaagcttaagaaatgtgttgatggcctaattataaaactgataacctcttttgccaactcgcatatctgtgtagtttttctagtcttttaataagtgtctgtacaaaacttttctcataggagtctggaaatggagaagctgtgttttagcatctggcataaattcagttgcttttctaccatttcaatctgttagcgtatttcttagctatttgtacccattgacattttagataagagctaagagagagttttttccacaagattatcctttgtaacactgctctcaggcaaagaaattttgttgtcagcgttattagccattcacttattagtacattgcttcaaatttttataaggtgaagttatttcaccatagaaacaagtgttaagatgtttcctggtcaaccgatcaaagccaacatatgtacctttagttgcctcaagtcctcgagtgtttcaagaggagtaggaactggtctgggtccagggtcccagtgctgatattcttccaagaccataggccataagggcctcagtcacagggagggagtagactaaggcaccatggaggcagcagtggaactttatttttgaaagtttatgtaaaggccggttgccgtagctcacacctataatcccagcactttgggaggcagaagtgggcagattgcttgaacccaggagttaagc

SEQ ID NO: 19694 - DNA, 1076 bp, Homo sapiens
gtcatgttaaaatagaacatttaagagatttgataaaagtacatgagtttaacattttagcctggtttttttgttgttgctaaaaagccttaccagagagatttagcatgcttttaattctaaatttctaatatacaactgtttcagatcactgttagctaaatattagatgtactgtatcataatttcattatgttggagaaaacctcaattgctttaatatttggaatataggtatttcaaatgtttatttttgcttcacagttttcagaactatggttagaattttaacattccatttggtgatcatggcctatctcctgtgtttcctatagctgtgattagaatttttattataattcttattgcttatatacaaataaatataaattaataatctttacctttgcaggatgtatgttgtccaataaggcaagttcccacaggtaaaaagcaggtgcctttgaatcctgacctcaatcaaacaaaacctggaaatttcccgtcccttgcagtttccagtaatgaatttgaacctagtaacagccacatggtgaagtcttactcgttgctatttagagtgactcgtccaagaagaagagagtttaatggaatgattaatggagaaaccatgaaaatattggtaatttttttttttactagattttatcactggagattaagatggtcattgaaaatgattgtaccagtgttccttcatgatagtcatggtgctgagtcttaaagcaaacagtgaattcacctccacctcaacattttgttgtgcaaattttcaaacataaaggacaatgagaagtattttatagtgaacacttatctacttacctcttagattcaacaatgaatattttattatacttgttgcatatttatccccctacccatccctcttttcttccaacaattgtgaattcatctttgaggtattcattcaacaaacacataggtgctggggatgatttaatttaatcgaagatgattaaagcattcagtcctgtcctccaaagtctcacaacctagtgtagggaaatagacatgaaatatatcattgctgc

SEQ ID NO: 19695 - DNA, 1028 bp, Homo sapiens
gtctcctgggttcaagcgattcacctgcctcagcctcctgaatagctgggattacaggcacccgctaccatgcccagctaatttttgtgtttttagagagatgaggtttcaccatgttggccaggctggtctggagctcctgacctcacatcatccacctgcctaagcctcccaaagtgctgggattacaggtgagccaccgtgcccggccagtgtctttttaaagtcagaaattttattgtggatcgaagatttaaatggaaaacaatagaaccataaatgtactagaaaatagtggtcatgtctgtgggggaaacaattagaatgaggcgcattggacttcatcgatgctgttaattgttctattttaggcagcatggggtatgttctgttttcttttttaatcactgtacctgacacatatgtttacacatttcttgtaagaaaaagataatgcttttattttaaagaaaaagtgccaagaagaaactgggagaatttccccacagcagcttattttgaaaatactcatccgggcatggtggctcacgcctgtaatcccagcactttgggaggctgaggcgggcggatcacgaggtcaagagatcgagaccgtcctggccaacatggtgaatccccatctctactaaaaatacaaaaattagctgggtgtggtggtgcgtgcctgtagtcccagctactcgggaggctgaggcaggagaatcgcttgaacccaggaggcggaggttacagtgagttgagatcgtgccactgcagtccagcctggtgacagcgagactctgtctcaaaaaaaaaaaaaaaaaattcaaaactataggaaagttgaaagaatactaaagtcatttaatatccacatacccttcatctagattgtatctgttgttaacattttgccacatttgatttatttatgagtatatattttatttttgtgctgaacaatttgaaagtttgctttattcctcatttataaactctcttgcatgtatctcctaagaacgaagaca

SEQ ID NO: 19696 - DNA, 1007 bp, Homo sapiens
tttgtatttttagtagagacggggtttcaccgtgttagccaggatggtctccatctcctgacctcgtaatctgccggcctcggcctcccaaagtgctgggattacatgcgtgagccactgtgcctggccatttatttttacagcgaactacatttgccactgtactccagctcgctgtagcctcaagctcctgaactcaagtgatcctcccaccttagcctcctgagtagctggctaatgcctgactatgcctggctaattaaaaaaaatttattttggtagagatgggggtctcatcatgttgcccaggttggtcttcaactcctggcttcaagcaatcctcccaccttggcctcccaaagtactgggattacaggtgtgagccagcagtcccggccaaacttgctaattttaatttgtgtctttttgctttactaaatagtaaccatgagtgttctgagcttttctgagttctgtgagtcctggcaaataattgaaagtgaaagtgatcttaagcacccctgaacacatttaccacgcatggcccacttgcattcatctggtattggagggaaacaaatttctagagtttcagttgctacttttcagttgttccatggtgctttccaggagttccagtcgatgatatggggtttcgcctgtcatcacatctgtcaggctttgcgccttcttcatcctgcacagacactgagatcatgcaggtcttgtatctgtttgtagttcgtcttcactagcttgtattttgggatttgagggggtaagtggtcacctagtcttactgtagatattatccaggggattttgcttttgttatctatctagttgctctatttctttgttttgtttgtgtttatttattaagagatggggtctaccaatgttgcctaggctcactgcaacctcgaattcccaggctcaagcaattctcccacctcagtctcctgagtagctttggaactactggtgggcaccacaacacctggcta

SEQ ID NO: 19697 - DNA, 1032 bp, Homo sapiens
ggacttaaagattactgaagaggggataaaagtcaacactgcttacaaatacctgaacatggagagcacagtcaacacattcatgtggacagcacatgaacggatgtattaatacattacacagcttcttctatctgacctattcctcttgttctaaagagttacatggacttggatcctttaagatgattttaaaaataatattacattaagttttcctggtctaataaccaactttgagaagtacagtggaagggtatagaacttcctatatcttctatacttttaatgccaatttgatttttattgtgatgtgatatttaacagtatgctaaaaataaaattgactgaattgtatgattttgtccacaacattgaagtctctttttgctaaaatattacaaaatgaatccagtaaacactttccaatggcctaagttagagatgaattcaactttttttttaaagcaattacaactacgctgggctgaggacagctacgttagaccctgaaaaccaaagccaagcacccaaacatctaaaacactaacactttccatccaggatagaaaaatgagcatccaaagtaaagagaaccacaagactgatcaagtaaccagtcaaaaaccacttctctattatttgaacttatagttactcgaagcttgaagtgtccaccttcattattactggtggttcctagagtcacggcttcaatgtcaaacgtgacagtggacccagaagtaactgcgggtaactgatttgtcatttcttttccattgacaaaaactgcacctaaaatgttaaggtaaagagtcatttacatgtgagcaataactaagagatctgaaatagtttctagattactggtaacacagctcatttcctaattcagattttaaaaaatctggaatgccaactggacatagattttagagttctgtccagggttgtactcttccagcagagactatgagtttcccatatcagtgtcatcaaaagaaacttgacagtgttacaaaattacctcct

SEQ ID NO: 19698 - DNA, 1079 bp, Homo sapiens
ctaaaattttttttttttttgaaacggagtcttgctgtgtcgcccaggctggagtgcagtggcgtgatctcggctcactgcaagctccgcctcccgggttcacgccattctcctgcctcagcctcccgagtagctgggaccacagacacccaccaccatgtccggctaatttttttatttatagtagagatggggtttcaccatgttagccaggatgttctcaatctcctgacctcgtgatccgcccgcctcagcctcccaaagtgctgggattacaagtgtgagccaccgtgcctggccaggcctctaaatttttaagatttactttttaattttgtgtgtgtgtttgagacacagtttcgctcttgttgcccaggctggagtgcaatggcatgatctcagctcactgcaacctctgcctcttgggttcaagcaattctcctgcctcagcctcccaagtagctgggattgcaggcatatgtgccaccatgcccggctgattttgtatttttagtagagatggggtttctccatgttgctcaggttggtctcgaactcccgacctcaggtgatccacctgcctcggcctaccaaagtgctggggttacaggtgtgaaccactatgcccagcctaagattgacttttgagagatactctacttacctctacttaccaagaggaaaagagatataaacatattaaataacaagcattttatatacatttcccagttaatctacgtaataaccctgtgaatacagatgagaaaactacagctacaggaaataaagaagccttcccacagtaacactgcctataaatgacggaataaactcaggatgttttgaattcaaagcttatgtatgctctatgcacttcactctgcttcctgaggcaggtgagatgttttaatatctacttgcctgaatgttaatgtctgcccacagaaataagtcggagctctggagtagagaacacccgatgattcagaatcgttccgaagtgctatatttcttcgactgctcagactgtacccctcaaaaccagctgtccactctttttcaaagcaaagatattg

SEQ ID NO: 19699 - DNA, 1011 bp, Homo sapiens
cagccaggcggagtggctcacacctgtaatcccagcactttgggaggccaaggtgggcagatcacctgaggtcggaggttgcatcgctgcactccagcctgggcgacacagcaaggcttcatttaaaaaaaaaaggccaggcacggcggctcacacctataatcccagcactttgggtggccgaggcgagtgggtcacctgaggtcaggagttcaagaacagcctggccaacatggtgaaacctcgtctctacaaaaaatacaaaaattaggcaggtgtgatggcaggtgcctataatcccagctactcaggaggccgaagcaggagaatggcttgaacccgggggaagcggcaggcgggggagggcatggaggttgcagtaagccgagatcacgccacttcactccagcctcggtgaaagagcaaaactctgtctcaaaaaataaataaataaaataaaaataaaactggaagagctacctcagtgttccatgtgacttcattttaactgtaaagtaaaagagatttttgtttgagaagaaaagaatgtatttaaaagtagtcaacgaaaaaatctgaaaggcctccaaatcgcaaacccataatgtggaagtcatttctagaattctgaattacataccttacaccatcgtacaatgatgcctccaggtttctctattagttcttctatctgtactggtgggcgagatgctactgttccatgcttaaaaatgtggtctttcactatgttaagaattgagtcatccaactgagcagataaacaaggcacatcaaccagtaaaggtacttctggtaagctgaggaaacaaagctcatgtgttatgagacctctaactgagagttaaaaaatacaagaaatattttagagcagtcacatgcttgaaagatcctgaagcccccagtaattaattctcatggcagtaggggatttgcaagatgttacacaaagattctcttttcaaataaatataagtaagacagaaaattggt

SEQ ID NO: 19700 - DNA, 1035 bp, Homo sapiens
tcacgtttttcacctaaaggaggcttcctttttttaatcctattatgtaaactattagatccatgtttaaaatttatattttgtattatattgcttgaaataagtgcctttttctcttttaaattgccagccatgcaaaaagcgaaagaaagatgatgacacatctacctgcaaaacaattacaaaatatttatcaccactagggaagactagagacagggtttttgctccaccaaaacctagtaatattctggattattttagaaagacttcacccacaaatgagaagacacaattagggaaagagtgcaagataaagtcacctgaatcagtacctgttgacagcaacaaagactgtacgacacctttggaaatgttctcaaatgtagagtttaagaagaaaagaaagagggttaatttatctcatcaactaaataatattaaaactgaaaatgaagctccaattgaaattagtagcgacgatagcaaagaagactatagtttaaataatgattttgtggaaagtagtacttctgttttacgttacaagaaacaagtagaggtacttgcagaaaacattcaagatacaaaaagtcaaccaaatactatgacctccctgcaaaattctaaaaaagtaaatcctaaacaagggaccacaaaaaatgacttcaaaaagttgagaaaaaggaaatgcagagatgtagtagatctatctgaaagcttacccttggcagaggaactaaatttgcttaaaaaagatggtaaagatactaaacagatggagaatactacaagccatgcaaactctagagataacgtaactgaagcagcccagttaaatgatagtataataactgtctcatatgaggaatttttaaaaagtcacaaggaaaataaagtggaagagataccagactctacaatgtcaatttgtgttccttctgaaactgtcgacgaaatagtcaaaagtggttatataagtgaatcagaaaactccgaaatttcccagcaggtacgctttaagacagttactgt

SEQ ID NO: 19701 - DNA, 1084 bp, Homo sapiens
aactaagatttaggatctcgccagtgctcacaaggttagtaagtggcagaggttgggtttgaatccaggtctaacttgaaagtttagactttagaccaggttgctaactgcctcttaaaaggtttttgtttgtttgtttgtttgttttgacagagtcttgctttgttgcccaggctggagtgcagtgatgagatctcagctcactgcaacctctgtctcctgggttcaagcaattctcttgcctcagcctcctgagtagctgggattgctggtctcgaactcctgacctcaagtgatccacctgccttggcctcccaaagtgctggaattacaggcgtgagccaccacgcctggccctcctaaaagttttaacctgagtatcaaggttgatttgaaaagaaaggaaagtttgttaatatttgtttgttttaaacaactggaagggaagtctaggtgatttttattaattctatttgttggagggtaggattttgttccctttatagtcatgtggtttttggtatgtttgtgttaattatgtagttgtcaacttttcatgtttacgtatttgacattcagtaaatggatagtgtataaataaggtttattaagatatttgtctatttttctttagggtgttgtttgtggcatttgaaaccaccctcttgtcctctcttaactaaatttaaagaactgaacactaaagtaatagatctctcaaaatgtggtattgctcttggtgaattttcaacattgaattcaaagttgaaaagcggtaactctgctgctgtggtaagtattaaatagttcatccattgtagagtgtttcccttacatcttgcagaggaaaaacatttttggatatctactcttatagcctcgagtgttgtcctagagtttaattttttttttttttgagacagagtctccctctgttgcccaggctggagtgcagtggtgcaatcttggctcactgcaacctctgcttcccgagttcaagcaattctgcctcagcctcccgagtagctgggactacaggcacacaccaccatgcccggctaatttttgtatttttagtagagac

SEQ ID NO: 19702 - DNA, 1030 bp, Homo sapiens
ttgtagtacacatttcttttaaatacccatagagctttaaaaacattttaagaattaatgattgccagttctcaaagaatgttagattacatagcacatttagatactttataagtaggtcatataatctaatagatataattagttcaaagggagaaaaataaattaattcttcataagctttatatttagtgactaaagctattttttttttttttttgagttggagtctcaccctgttgcccaggctggagtacagtggcacgatctcggctcactgcaacctctgcctcccgggttcaagcgatcctcctgcctcagctccccctagtagctggaattacaggcacacgccaccatgcccagcaaatttttgtatttttagtagacacggggttttgccatgttggctaggctggtctcaaactcctaacttcagatgatccacctgtctcttggcctcccaaagtgctgggaatataggcgtgagccaccacgcccggcctaaagctaatcttacgttgatactgatttatgatggacagaaagtggttggtagtattgtaattaacatgaatagatgatgttggtctgttattgtgcattttattctttattgcagttcatgaggacaaggaaggaatttactgaagaagtaagaaatcttttgcttgaggaaattaggtggtcaaatcctgaattttcattgaaaaaatattttcccttactcctaaaaaaacaaattgagcaccaagtactttcttccgagtgtcatagtaaacaaggttagtgataattattatcatttatgttaacataccagttttgggtttttatattatttattattttatttttatttctgagacggagttttgctcttgtcgccctggctggagtgcagtggcacaaacctggctcactgcaacctctgcttcctgggttcaagtgattctcctgcctcagcctcctgagtagctgggattacaggcacccaccatgacgccctgctaatttttgtatttttagt

SEQ ID NO: 19703 - DNA, 1034 bp, Homo sapiens
ctagagtgcagtggcgcgatctccgctcattgcaagctccgcctcccgggttcacaccattctcctgcctcagcctcccgagtagctgggactacaggcccccgccaccacgcccggctaattttttgtacttttagtagagacggggtttcaccgtgttagccaggatggtatcgatctcctgacctcgtgatccgcccacctcagcctcccaaagtgctgggattacaggcgtgaaccaccgcgcctggctaacactttaatattttaataagattatggtggttatttttttttagggggaagggtttggtgtgaagaattttaaatgtaatgttgttttaaaagtacctctggcattttgtaaatataaatatttctgcaaatacctactgtgacattgtaacaataatgtaaatgactaataattcatatatgtttatgtcaaggaatgaataccttaattttttttttttttgctttagattctggaactgaagacatgctttggacagaaaagtatcaacctcagactgccagtgaacttataggaaatgagttagctataaaaaagttacataggttggtaaaatgtgtaaggaattgagaaatagtttacaaacttagttttactgtttttgtttcgaaattgtagttacaaagtaatatatctcatgataaaatcttcaaaaaactggtagaagtttaagtgaaaagtagccctcttttcttacatttctacttctcagagataatcattgaaaattttttgtaaaagcttccagaaaaatatttttatgcatatgttagttccttcctttctaacaaatgggatcacattactactaattcaggtccccagtccttcatcttcaattctcacatccaaaaaattctgaataatgaaagtttattgactttattacatgaaatttgttacacctttacacttagtagaatttacaaatttttttttttttttttttttttttttttcaagacagagtctcactctgttgcctaggctggagtgt

SEQ ID NO: 19704 - DNA, 1072 bp, Homo sapiens
aaaaatattaagtgatggcccagtgcagtggctcacacctgtaatcccagcactttgggaagctgaggcgggcagatcacttgaggctgggagttcgagaccagcctggccaacatggtgaaaccccatctctactaaaaatacaaaaattagctgggtgtggtgatgcacgcctgtaatcctggctactggagaggctgaggcatgagaatcgcctgaacccgggaggtgaggattgcagcgagccgaggtcgtgccagtgcactccagcctgggcaacagagtaagactctgtcccaaaacaaagcaaaaaaacaaaccaaaccaacttaaatgattatgggtgtactgcctagaccccattaggggtattatgtaatatgcagtatatgtaccaaataaccttttaagtatctgaaaaattaattctaaaacaatctggtccaaaggatttcatataaggatttacggacccataattacagttaatagcgtgaacttggtactactgttctaagtacttgtattgttccttctttcttttttttttttttacttgtactgttcttaattcattttatccttagaatggtactgtgagcagtgggtacagtggctcaagcctgtaatcccagtgctttcgtaagctgaggcagaaggactgcttgtggccaggagtttgagagcagcctgggtgaaatagggagaccccatctctacaaaaaataaaaaaaatagctgggaatgatggcgcccacttggattctgagccactcaggagcctgaggtgggagggtcacatgagtccaaggattcgaggctgcagtgagctatgatcgcacccctacactccagtgacaaagcaagactgtctcaaaaaaagaaaaatactatgagcataaatactgttgtcctcatctcatagatgaagaaaccaaggcctagagaggctgagttatttgtccaaagtcacacagctagaaagtgatggaactgggatttaaactcaggcattctagctctagactagaacttaatctttctgttgtacattgtatattaggcatctttc

SEQ ID NO: 19705 - DNA, 1044 bp, Homo sapiens
ctgtaatcccagctacttgggagactgaggcaggagaattgcttgaacttgggaggtggaggttacagtgagctgagattgtgccactgcactccagcctgggcgacagtgtgagactccgtctcagaaaaaataaataaataaaaccagtctttggactggtattcatacatgatcaagcagtccttggtctatatcaaaataagaaaaataaggacaaaggccaggcacggtggctcatgcctgtaatcccagcactttgggaggctgaggtgggcggatcacgaggtcaggagattgagaccatcctggccaatatgttgaaatcccgtctctactaaaaatacaaaaattagctgggcatggtggcgtgtgcttgtaatcccagctactcgggaggctgaggcaggagaattacttgaacccggaaggcagaggttgcagtgagctgagattgtgtcactgcactccagcctggtgacagagtgagactccatctcaaaagaaacaaaaaaaaaaaaaaaaagaggaaaaaatggtgttttttataaattgatatctgttcaactatttatttatttatttatttatttatttatttatttatttgagatggagtcttggtctgtcgcccaggcagcagtgcagtggagcgatctcagctcactgcaacctccacctcccaggttcaagtgattctcctgcctcagcctcccgagtagctgggattacaggcacctgccaccatccccagctaatttttgtatttttagtagagacacggtttcaccatgttggccaggctggtctcaaacttctgaccttgtgatctgcctgccttggccccccaaagtgctgagattacaggcgtgagccactgtgccctgccaaatatttttatattttaagatattgcatctcttacctgtggtgttgaaatgttctatatttttgaaatgatggtcatgtctgtgacagcttttttaacctcgagattttcagtaagcttattgaacacctctaatatacaagggctatgataag

SEQ ID NO: 19706 - DNA, 1034 bp, Homo sapiens
tagcatcccaaagtgctgggattacagatatgagccaccacgcccagcttgtttcagtttttgtttgtttgagacagtctcactctttcatccaggctggaatgcagtggcgcaatcttggctcactgcaacctccgcctcctgggttcaagtgatgctcctgcctcagcctcccgtgtagctgagattacaggtgtgtgccaccacacccagctaatttttgtatttttagtagagttgggatttcgccatgttggtctcgaaaccctgacctcaggtgatccacttgcctcggcctcccaaagtgctgggattacaggcatgagccaccgcgcccgtcctgtttcagttttgataatggatttcagtttgagcttattctgtggacatatccaatgtcttagcaaaagttgattttacctaaaatattaatattgtatttatgcaggaataaaaaattcttttgaacagaaacaaattactcagactaaatctacaaatgcaactaattcaaatgtcaaagacgttggagctgaagaacccagcagaaaaaatgcaacatctcttattctttttgaggaggtaggcttatagaagtatacatttgtgagagctcatgataaagacttactttaaagaatactgtatgttttcttataaagaattgtaaaatagctaaggaggtcaggaatacgtgtatctatttgaaattaaagcaaattaaactgtccactctagaataatttttcaggaagatgattaatgtaattcacggctgctaattattgttaaatgattgtataaattattctgatccatatctgtctagttataggtggctgcgtttgtttttaacatttgatagttgataattttaaaattcattatagtgtatgacataaactttcaacatgagctgaattcacacttcataaattcataaattttgtctctaacagacatagaatatttactatgtatacataactgatattagtaagtgtattaatatattaatattctaataaactgta

SEQ ID NO: 19707 - DNA, 1023 bp, Homo sapiens
aacattggcgaaatcctgtctctacaaaaagcacaaaaattagctggatgtaaaaagaaaaaaaattaactgggtgcagtggcatgtgcctgtagtcccagctacttgggaggctaaggcaagaggattgcttgagcctgggaggcagaggttgcaggaagccaagattgtgccacagcactccagcttgggcaacagagtgagactctggaagaaaaagaaaaaaaaaacaatttgtctagacaattcttcattcttccttttctgcagtcttttggattaaccaagtatattatttcatttcaccttcactgttggctttcagctatatgctaatatggtctccactacccaaatgaagctattgagcttttaaaatgtggctagtctacagttaataaaagatcacattttgtatgataataattgtatgaaatgtccagaataggcacatttatagagacagaaagtggattcatagctgcctaaggctagaggagctaggtagaaatagggagtgactgctgattggtctggggtttcttttggggatgatgaaaatgctctgtaattagatagtggtaatgggtgcaaaactctataaatatactaaaaccattgaattttacatgttaagtgggtgaattgtatagtatatgaattatatctaaatacggcttattatctatttttaaaatgtggctagaccccatctctactttgtgctaaagtgtaatataaacaccagattttttttttttttttttgagatacggtctcactctatctcctaggctggagtgtagtggctcagtctcagctcactgcaacctctacctcctgggctcaagcagtcctcccctctcagcctcctgagtagctaggaccataggcatgtgccaccacgcccagctaattaaaaaaatttttttgtagagatgaggtctcactatattgcccagactggtcctgaattcctgagctcaagtaatactcctgcctcagcctcccgaagtgctggta

SEQ ID NO: 19708 - DNA, 1172 bp, Homo sapiens
tgtattttcgagtcgatctcttctctatgtgggtaatagacaagctagtataattgaatacctgccaacccttcgaaacatctgtaagactgagaagctaaaagaacaaggaaaaagtaaaagaaggtaaaggctttattaaaaacaacattttagatagctttttcaagattaatacatattttcataagatgaaaatgttaatattaaattgtatttttctttgtaattttgacagattcctgcactattttgaaggaattcatcttgacattccaaaagagactgtgaatactttggcagctgacttcccttaatgttccatactaacaatgctttgtatagattatcatgtggtccttaagatacatttttatattatgtggatcttcatggaaaagtatatttctcgatgtacattttaaacaaacaatttgtatatttttttattggcgggtaaatatttaaaatatttgagttacaaattttatatatgattgtaattttttttctgaattttttgtattatctgatttagctttgttggagtattttttgtatgtgagtgaactgtttctggaaggtagagttcattaagatgaactccctatttcaagtgtttatattatatattagcttaatattcagatacattatcttggctgctaacattagtgtcactaaagttggtatacaatctcccactgctaaatttgactggctttacaaaaacaaaaacattatctggtgaattatatttttaacctaaaagttaaggatcctcatattgtacagttttttttgtgtgctttttttttttttttttgagacggaatcttgctctgtcacccaggctggagtgcagtggcctggtatcggctcagtgcaacttttgcctcccgggttcaagcgattatcctgcctcagcctcctgaatagctgggattacaggcatgtgccaccttgcccagctaatttttgtatttttagaagagacagggttttaccatgttggttaggctggtctcttaactcctgacctcaagtgatccatctgcctcggcctcccaaagtgctgggatcacaggcgtgagccacctcacctggcctatattgtacagttttgaacagtatagatgcatacctgtttacaaatgtgtatgaagatagat

SEQ ID NO: 19709 - DNA, 1049 bp, Homo sapiens
tcggcctcccaaagtgctgggataacaggtgtgagccacagtgcccggcccaaacttaatacgggtacactttattgtttctaaactacacctcaataaatgttgattaagtgaaaattaacaatgagatacaattccatacccatcatattggcaaaaattttgtaatctggtagtgtcaagtgttggtgagtatatggggaaaggggaactattctatttcattgatggaagtaaatattggtacaatcactgttgagccattcagcagaataatttggcagtctctagtaagtgaagatgtatataactgtgatccagcaattccatttctaagcatacgctgtgacctacagatgcactcacatatgtgtaccagatgcacaaactgactgcaacattacttatgatagcaaaaaatcaggaacaatctcaatatatatatcggaacaatctattaacagaaaatagattgataacttttggtatagtcatttacaagagcaaactagactggtgtatctcagcatgggtagacctcaaaaatataatgttgaaagcaaaaagaacctcattaaaatgggcaaaagatgtgtacagacacttctcaaagaagacatacacgtggccaacaagcaaatgaaaaaatgctcaacatcactaatcagagaaatgtaagtcaaaaccacaatgagataccatctataccagtcagaatgactgttatcaaaaagtaaaaaagtaacagatactggtgaggttgtggagaaaagggaatgtttacacacttgtggcaggaatgtaaattagttcagccacggtagaaagcagtttggagatttctcaaagaacttaaaacagaactaacatttgacccagcaatcccattactgggtatatacccaaagcaatagaaataattctactataggccggatgcagtggctcacgcctgtaatcccagcactttggaaggcagaggccggcggatcacctgaggtcgggagttcgagatcagcctgaccaacatggagaaaccctgtctctac

SEQ ID NO: 19710 - DNA, 1025 bp, Homo sapiens
aatcttgtttcactacatattttattaattcaaggccttaaaaatgatagctttattctattacacaggtttttatgtatgcctatacaccataatgacatttatttatttatttgagatggagtttcgctcttggctggagtgcaatggggcgatctcagctcactgcaacctgtgcctcctgggttctagcgattctcctgcctcagcctcccgagttgctggtactacaggtgcatggcgccacgcccggctaattttttgtattttcagtagagatggggtttcaccgtgttagccaggatggcctctatctcctgatctcgtgatccgccagcctcggcctcccaaaatgctgggattacaggcgtgagccaccacacccagccaagaaattttttaaatgcaaagttctctagccactttgtatttaccactagatgtctcactaacttcaggaaacctgatagcttttggccacattagagtaacttggttctcaattaaatttttgtagaataatatgatcaggttaagttgaaacctattttttaaattaagatattgaacttgtatttttgtttattgtgttatttaacagaaaggaaacataaaaggctgtgactttcctacttaattaaggatctggaagccacattttgtatggaaaaaggttttcttttatttttttatttcagtagattttgagggaacagatggtgtttgattacgtgaataagtactttagtggtgatttctgagattttggtggacccatcacccaagcagtgtacacagtacccagtgtgtagtcttttatccctcactacccctaccctttcccacagtccctatagtccagtgtatcattcttatgcctttgcatcctcatagcttagctcccccatgtgactgagaacatacaatgttaggtttttcattcttgagttacttcacttagaataatagtctccgattttatccaggttgctgtgaatgctattatttctttttatggctgaata

SEQ ID NO: 19711 - DNA, 1029 bp, Homo sapiens
gccctctaacaaataattgtaagtaggtatatatactttttggaaaatggagaaaagaacactagaggactaactttaaaaactatattcccctctagtgtctttatatacataaatatgtatataaaatgtatatatttatgtctttaattccagtgaagattaaatttctactttgctttctttcacttaccataatcgtttttagtatttataatctttgtaattaatgatatatatatatatatatatatatatatatatttttttttttttttttttttttttttttgagacggagtttcactcttgttgcccaggctggagtacaatggtgcgatcttggctcactgcaacctccacctcccaggttccagagattctcctgcctcagcctctcaagtagatgggattagaggcatgcgccccgacgcctggctaatttttttttgtatttttagtagagacaaggtttctccatgttggtcaggctggtctccaactcccgaactcaggtgatttgcccacctcagcctcccaaagtgctgggattacaggtgtaagccaccatgtccagccatatttaatgatttttaaaggatgaagtatatagatatatcacaacttaataattaaaaattttttttgctattataacattgaaacttgcaaacatttttgtacactttgcttttttcttttttagaatcattgctgtatgaaaaaaaaatctcccaagttgagataattgattcaaggagtacaaacttttttccttgtttaaaactgtgatgtcccagctacattgggaggctgaggtgggaggatcatttgagcacgggaaatctactgtattggcatcgttatcacttggatgtgtactttttctatgtatttttttaaaaaatgagattatactgaatttttaaaaactggtttaaatttatcataaacatctttgtttttttggcccataaatacatttctatagcattgttcctttttttttcctactttgcattaaggctt

SEQ ID NO: 19712 - DNA, 1024 bp, Homo sapiens
ccacaggaaagagtgacttgcgtttgctaagtgtccagtccgtactctccgttcccatttctctgcctctttctcccattatcggcttctaacagaaaataagaagagcaagcttccctttggtcccatcaaagataacatgtagacattcattcatgcgttcattcctttaactagcatttattgggttcctactatgttcccagcattgttattggtactggtgaccctagtataaaagacacaatccctgctgtcaagaggtcacagttctggaaggaacccagcggtactggcagcagcgctagtggggaatgggagcacatagaagaggcatttgactcagctttggaaagaattggaaaaggctttaaagtagagtaaaagtttgccagaaagaataatcattattacagcttttttaaagcgtcttctacatgccaagcactgtgctaaaatctccctatatatattgttttattttaatcctcacaactctaagaggtcactactgtaattattccaacttcacaaatgaagaaagtgagatttagcaaggtcgccttggtggggcatggctgctcacacctataatcccaggatttgggaagccgaggcaggaggatcacttgagtttaggggtttgaggccagcttgggcaacatagtgagtcctctgtctctacaaaaagaaaaaaaaatagctggatatggtagcatgcacttgtggacctagctacttgggaggctgaggtgggaggatggcttgagcccgggaggttgaggctgcagtgagctgtgatcatgccattacactctagtctgggtgacagagcgagaccctgtctcaaataaataaataaataggctgggcacgtgactcaggcctgtaatcccagcactttgggaggccaaggcaggtgtatcgcttgaggtcaggcattcaagaccatcctgaccaaaatggtgaaaccccatctctactaaaaatacaaaaattagctgggcatggtggcacatgcctg

SEQ ID NO: 19713 - DNA, 1012 bp, Homo sapiens
tgcttttctggaattgatttgactccaagggtctttgtgttaaaataatttcctatatcaaatagggttcttggttgtgcctgactctgactaacttaaggggggtagggagtggaacttattggaaagatacagagcgagaaagagtctttttaaaaaaatgctgtaataatagggacgagaaccagggtagctctggggaaggaagtcacagaagttaaaggttggttcttcaggatgtcattatcaggatgtttcagctctgactcctttctgcccttattcacacacccagctagagttcgagttacccgccataccatggcacacagagaacaagacatcatgcctgacaattcccctaaagcttcaagcaaaaagtaaggggcaatctctaaagcaaaatcaaggtaatgctacatggagaaagggaaatagatctggcactctgacagcatttgtttttgcttgaccaggttctactgaggcaggtaatacaagctgggcatgtgaataagggcagaaaaaagcaggagctgatataacctgagagcagtctttctccaagaatgttcaactaaattatttcttttctttcttcttcttcttctttttttttttgtttttgagacagagtcttgctctgtcacccaggctggattgtaatggcatgatcttagctcactgcaacctctgcctcccaggttcaagcaattctcctgcctcagcctctcaagtagctgggattacaggcatgtgccaccacatccacctaagttttgtattttagtagtgacggggttttactatgttggccaggctagtctcgaactcctggcctgaagtgatccacccatctcagcctcccaaagtgctggaattataggcatgagccaccaagccaggcccaggctaaattatttcaatttaatgtactggaggtttgaaaattaatacttaaaaagaaacttgtctaatgtttcagagtttcagtttggaacgataaaaacgt

SEQ ID NO: 19714 - DNA, 1067 bp, Homo sapiens
cacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaa

SEQ ID NO: 19715 - DNA, 1069 bp, Homo sapiens
aacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagta

SEQ ID NO: 19716 - DNA, 1049 bp, Homo sapiens
ttctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgacc

SEQ ID NO: 19717 - DNA, 1035 bp, Homo sapiens
gagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcc

SEQ ID NO: 19718 - DNA, 1910 bp, Homo sapiens
ggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtggg

SEQ ID NO: 19719 - DNA, 1048 bp, Homo sapiens
tgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatgga

SEQ ID NO: 19720 - DNA, 1067 bp, Homo sapiens
tcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttt

SEQ ID NO: 19721 - DNA, 1019 bp, Homo sapiens
agtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcc

SEQ ID NO: 19722 - DNA, 1031 bp, Homo sapiens
caaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcag

SEQ ID NO: 19723 - DNA, 1029 bp, Homo sapiens
aagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtac

SEQ ID NO: 19724 - DNA, 1029 bp, Homo sapiens
ctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaat

SEQ ID NO: 19725 - DNA, 1050 bp, Homo sapiens
gtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctc

SEQ ID NO: 19726 - DNA, 1032 bp, Homo sapiens
ataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgc

SEQ ID NO: 19727 - DNA, 1027 bp, Homo sapiens
gttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttactt

SEQ ID NO: 19728 - DNA, 1035 bp, Homo sapiens
ttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttataggcagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttat

SEQ ID NO: 19729 - DNA, 1061 bp, Homo sapiens
gcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgatgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcc

SEQ ID NO: 19730 - DNA, 1081 bp, Homo sapiens
cctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacact

SEQ ID NO: 19731 - DNA, 1029 bp, Homo sapiens
tgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagt

SEQ ID NO: 19732 - DNA, 1072 bp, Homo sapiens
ataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctc

SEQ ID NO: 19733 - DNA, 1001 bp, Homo sapiens
ttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaat

SEQ ID NO: 19734 - DNA, 1025 bp, Homo sapiens
ctgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaacaaaaaaaaacactaattaccagtttttttgtttttgtttttttgggacagggtctcactctgtcgcccaggctgaagtgcagtgacgcagtcacagctcactacagcctcagcctccctgggctcaagtgatccttcca

SEQ ID NO: 19735 - DNA, 1106 bp, Homo sapiens
ttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattcagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctgg

SEQ ID NO: 19736 - DNA, 1048 bp, Homo sapiens
tatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacacgtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacccctaataaatcattaggctacttg

SEQ ID NO: 19737 - DNA, 1040 bp, Homo sapiens
tctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagc

SEQ ID NO: 19738 - DNA, 1035 bp, Homo sapiens
aaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttaga

SEQ ID NO: 19739 - DNA, 1007 bp, Homo sapiens
aattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggacta

SEQ ID NO: 19740 - DNA, 1046 bp, Homo sapiens
tctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattacta

SEQ ID NO: 19741 - DNA, 1034 bp, Homo sapiens
atacatatattacatacacacatatatatgtaatgtatgtgtatatatatatataaagtgtgtgtgtgtgtgtgtgtgtgtgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacag

SEQ ID NO: 19742 - DNA, 1575 bp, Homo sapiens
ccaggactatattagccccaagacctcacacatatgcacacagcttagggtggggctgcctctgaatggggcactgcactctgcttatattaagtttctggccaccgaaacctccagggatctgttttagaaacctctgccaagccagggattctccacccttcggggagggtcagtgatttttttcttttaaaagcatactctgagattactacagaagcggtggatatgcattgcagaaaactggaaatagggacaagcaaaataaaaagtattgtgtcctatctctcaggcagcgcctcaatgacacttctgtcagacctttccagagctgtttccatgcttatatgtcaattttctccagaaaatgagatcatactgtgcatactgttttgtaacctgattttttttgccggtaaatgatcatgacttttctgcttcaataaattttcatctggtttaatatgcagacctttttcagatttccctatttgaccccaaaatgtccatttttgctgtttcctctccaggactgtgcagtgtatgtggttgttgtcaccttttagtctctcttactgtacacaattcctttttcttttcttttcttttcttttttcttttaacaatcctggcttgtggaagcattcgggcctgttgtctgtcagtaatttctggaatctaagcctgtttcttggcccttattcccatttaatttcgtcttgttcatttcatcacattgtatctgtcaagaaagagaatctagcatcctacctctatcactctcagctgtgctgctgcctgcgggctggagaagcagtgcttggtgtgtctgaatccacaaggctggttaaacattgcagggcaggaccatggacagggccccgaggcacttgtaggggtggttttcggcttatgctgtattgaccgagacccgtggaaatatattttgcatctctactcactacccatcttatcccctgatgcattaaaaaatcggagtgttgttttccagcggtggggtggcggggggcggggggggggggctcccttacgaaatgcagtgtactctgactgtttctattttatttgttttaaaatcaggcagtgacattgatttcccagccacttgtgctctgggatggataatgatcattcattagatatgtagttcagtgaacttagagctgattgtccacagtttaccacctacccccagaataccagggataccaggatcaaatgctttgcaaaaaccaaaatatactaggtcataaagtatgaaataaatatccatgaggccataatgaaatatatatatgtataaattattgaacagatgataataaataaataggaaaatctctcgtatagaagaaatctgaataacgtatgttgataattgccccattgaggaagtgaagcataacgtcccaccgtgtaagcatgagatgtgcgtagtggcttccttataaagggtagagtttggaaagtggggggaacagcaactgtatagtggagaaacccaacaaacactgtctcagaaggtgatcaaggacaacatcgatagtgacagat

SEQ ID NO: 19743 - DNA, 1026 bp, Homo sapiens
ccagttcctccaaggatgcaggtggagccaccttgtagtggtggcagattatatgaggggaccctgatgtggttcaaggggacaaccttggattgggcttagattccagctttatggctcgccagctgtgtggccttggcaaagtagagcgacctctctgagcctcgggattttcctcccaccacatatgaatcgtggctccacagttgtcatggctgtgtgcaaggcaacattccctgtttctcttgctgggtatcatctaaggtctgccccgttccatctgggttaagagggaaaatgagggctgggagtgggtcactggccttcccaagggagcagagggaaactggtgttccaagggcttcttgactcagtttataatccttggacattactcttcttccctcgtccttctccccctttgcctgagttttcattttcacatgtgtttccttttagcaattttctttcaaatctctcctctccctttctgtaaagtcttcccacatgtagcctctttgaagctccctggggtgggaaaggggaggagggctctgcctgatggcctggatggcacagacctcagaagcccagtgtgctgtggtccctgcaagcttcagctcaagtccaagttctggtaccatcagcgttgctaactgccattcctgtggctgcagggtcagcctgagtccactccagtgcacagtgttgtccatggggtgctggatgtcgcatcgctgagagcatttggtattctctgtaccctccttgctgcgttaaaatcagacctggttcaaatcccagccctgcgacctttcacgaattacttaacctccttgaacctgtgtattctcatctaaatagtggctgatgcacagaaatacctggcacacaataggtgcttagcagatgcgtgctttccttgttctcaaatgtttaagacccctttgtggacaggcacgatggttcatgcctgtaatcccagcactttgggaggccaacgcgggcggatcacctgaggtcaag

SEQ ID NO: 19744 - DNA, 1093 bp, Homo sapiens
tatataagggtgaacaaaatggatgaaggccctgcctttatggagcttagtgttaggggagaaagacataatcatttaataaatatgaaataagtgctgggaaagaaaagcataagaaaactgtgagtgtataaaacaggagaaccagctttcatttgaggtgttagatttgggaataatgacgatcagggaaggcatctctgaagaaataagctgagatttgaaagaagtgtacagaagtaaaatggggtgggaggatgaacaaataggtggttctagttaaagggaatattacatataaagcatttgatgccagagtagctgtgtagaaagagcaagtctccttgagagtggtatgagaagaagctggagcagatggccagggccagacagtgcattgtcttcaaggtaatttaaggatgttggtcttaagaaagtcgtttgttcgttctttttgttgttgttgttctctaagaggtggggtcttgttctgtcacccacacgggagtgcagtgataggttcatagcttactgcatcctcgaacttccaggctctgttgtcttactttattttttattttactttttagagatgaggatttgccctgtcgctgaggtggcagtacagtggtgtgatcatggctcaactacagccatgaactcctgggctcaagtaaccctcctgccttagcctcctgagtagctgggactacaggcacatgctaccatgtcccacttattttattttattaaaaaaaggtttttttaggagacagggtctcacttcatcagccaggctggattgcaattgtgcgatcatgactcactttacccttgacctcctggcctcaaatgatcctcctgcctcagcctaccgaatagcctaggaccacaggcgcaagataccatgcctggatgattttgtaaaattttgtagccggggcacggtgactcatgcctgtagtcccagcacttttggaggccgaggcgggcggatcacgaggtcaggagattgagaacagcctgaccaacatggtaaaaaccccatctctactaaaaatataaaaattagctgggcagagtgtcgtgcacc

SEQ ID NO: 19745 - DNA, 1049 bp, Homo sapiens
tggaaatgttttcattctgaagcagaatataattatttatattgattatttcattgcctttgtttctttttattcttacggatgaaaaaacaaatttgcaaacactgaatttttgtctgttttatagaaaacaataattaaggaactattcggatagatagctcagttaaacttacttatttggcgaatattttctgagtgtctactctttgccagacactgttctagacattaagaaggcaacaaaatccctgccttcaccatggagcttaacttttagtggaggaaacagaccaccacccaaaaaatcaactaatgtcacttagtgatgagtgttgtgaagaaaaatagagaataaatggttactgttttagagagatatcctctgggaggaggtagtatttgagaagagacttaaatggactgggccctacgtaaatcttggggttatgtgtttattaaaaattaaggaagaggagctggtcatggtggtatgtacctgtagttccagctacataggaggctaaggtgggaggattgtttgagcccaggagttcaaggcagcaatgagctatgatcatgccactgtactctggcctgagtgacaaagtgagatcccatcttttttttttttttttttttttagaatagtgtctcactctatcacccaggcaggagtgcagtggcgcaatctctgctcactgcaacccctctgccacctgggtttgagcaagtctcctgcttcagcctctggagtagctgggactacaggtgcgtgccaccacgcccagctaattttttgtattttcagtagagacgggtttcaccgtgttagccagaatggtgtcggtctcctcatctcgtgatccgcctgccttggcctcccaaagtgctgggattacaggcgtgagccaccatgcctaggcgagaccccatcttttttaaaaaaagaaagaaggccgggcgcagtggctcacgcctgtaatcccagctctttgggaggctgcagtgggtggatcacgaggtcaggagttcgagaccagcctggc

SEQ ID NO: 19746 - DNA, 1042 bp, Homo sapiens
gcctcagcctccggagccgctgggaccacaggcacccgccaccacacccagctgattttttgcatttttagtagagacggggtttcacagtgttagccaggatggtcttgatctcctgatcttgcgatccacccacctcggcctcccaaagtgctagaattacaggcgtaattacctggcccaaatattttatgcttttaagactgcttatgtaattgaagaacagaaattatatctgctgttctaatggtacctgtttaagcttaagttagattaaatctcttgaaatttttaaaatggtaagctcattcagatgattgaatttcagtttctctatagttttactgcttctttaatcatcttttattttactggaattggatatagtcttattataatggttatcactgttgcatttgacaaaaatgctttgtattgctattcatattctgtttttattaaataggtttattgctgacaatcaaatgaatcatgcctgtatgctgtttgtagaaaattatggacagaaaataattaagaagaatttatgtcgaaacttcatgcttcatctagtcagcatgcatgactttaatcttattagcataatgtcaatagataaagctgttaccaagctccgtgaaatgcagcaaaaattagaaaagggggaatctgcttcccctgcaaacgaagaaataactgaagaacaaaatgggacagcaaatggatttagtgaaattaactcaaaagagaaagctttggaaacagatagtgtctcaggggtttcaaaacagagcaaaaaacaaaaactctgaaaagctctaaccccatgttatggacaaacactgaaattacattttagggaattcatcctctaagaattatgtttttgtttttaatcatatgttccaaacaggcactgttagatgaagtaaatgatttcaacaaggatatttgtatcagggttctacttcacttcattatgcagcattacatgtatatcacttttattgatgtcattaaaacattctgtactttaagcatg

SEQ ID NO: 19747 - DNA, 1028 bp, Homo sapiens
gaggttgcagtgagccaagatggagccattgctgtccaccgcctgggtgacagagcaagactccatctccaaaaaaaaaaaaaaaaaaaacaacttgaattatagatgaacaacttgtattatggaggacactagaaatagtgtttcctacagagtcagggcttcctaccaacattgtcatttctagggtttttgacctgaaaagttctgtggcatattttttctttcctatccatttcttgtgtgttttttttttctatttcttccctgctttctctcctctactttatcttctagagacctaggtagttcccaaaggaatagtgctttatggagtctaatggtgatttattatgtaaaagcagaaaattattttttttacctaaaagttccataccaaaaaatgaatatagactttttatgcagtttcacacattgaaaatgcaggtaattttaatttcattgcatttttcagaattctcaatcgcaatcctctgactactgtcgaagatccatatctctttgaactgccggcattaaaatatctgtaagtactatagtactctcatgagtcatgagatgatttatgctttttaaatttgtcatcaaagataaagtattttgcatttaggctaaaaagtcataatttaaattttaactgagttattgaaaaaagttattggcaaagaaaaggattaagaaaggatgtataatggtcaagacagccagcgggggaagagattagtgttgaagaagccgtatagatttggaacatgtagacacatggaggaatattacttaaccaagaaagcaaagagaaataggtgttcattattctaaaaagaaagaaaagagtaaatcaagatgggtgaatgcaatatgaaatgagaagtaagataatggtaaaaaaaaaagtgtaagttctcttaaatatcattaatttgatgacgtagatcaacttaaatttctttaataagatctctctggaattttacggcaaataaactattgaagtggcttgttttata

SEQ ID NO: 19748 - DNA, 1103 bp, Homo sapiens
ctgcaattataggcatgaggcatcatgcctggccttctttgtagatataggtatagatatatatccgtctatatctatatatatcttcaccaggtgtgatggcacactcctgtagtccccgctactggggaggctgaggcgggggtatcgcttgaacccaggaggtagaggttgcagtgagccaagatgacaccactgcactccagcctgggtgacagagcaagaacctgcctaaaaatatatatatatatatatatatatatatatatatatatatatatgtatgtatttttatatatatttctatatatatattctatatatatatttctatatatattttatatatttatatatattatatatatatatatatttctgcaaggccctattgtgagtttgttacacaacttactgcaacttaaattgtgccaccaccaccccccacaatatggcaagctaaatagaaactcagttatgctaaggctggttgagggcattatgcaagattagcatggaaagggcccttcatttggcactctgctccgttcatttttgtcaggtcactttcttatcttcaccgggctgtcagatctgttttactgctctagcctcactttcctcagcctcctacagcatcttccctgtaagctacatcccttcctctctggatgaagtcctcttcattgaccaactttctcacttagttctctaagatagtgaggatctgtctgctttcttcttgaccattagtggataggaaaaaaatgctctgattttctgtaaccatttgtcaccaaggccataaagacattgaactaatttccttattggagttcattattggaagtcttgaggagtttacacatttatctacaaagtaagtaggccagctcatttgtcttggctcatgtgtaatctttaaagcatattgaaaaattactattctcaagtaaggataatgtatatctcaggtcacttacagtctcaaagttttgtcagtatactttaaaacaatcctgcgaacagatctagattgaaggagactaaagaatcatgaactcgaggtggccccggggcaggcgcagagctggcaagcacgt

SEQ ID NO: 19749 - DNA, 1042 bp, Homo sapiens
gaggagagtgggagccttgtgctctctctgcatatgaggcaggacagcacagggtatggagcagtctgcagagaggccagttcatcagctcatcagggaagcacttgtcttccaccttgggctttgactgagcactgggcaattggcccctggggatcaacggaataatcctaagcagagttactctatgtcacactatggaatgttccaagtaggtggccatgtcttttcctcctttcgttgttgccatttcataggtttaggtttgggtgtatgtttctcctctctgaatggcactcgaatgtttgctgactcttactctgtgtgactggggcatatagctatggactgagtatgaaagatgatcaaagatatttcatgatcaaagcagtctcttcttttctgacagctgaagaagcatctgtagggaatccagaaggagcgttcatgaagatgttacaagcccggaagcagcacatgagcactcagctgactattgagtcggaggcgccctcagacagcagtggcatcaacttgtcaggctttgggggtgagcagctagacaccaatgacgagagtgatgttagcagtgcactaagttacatcttgccttatctctcactgggaaatctaggtgcagaatcaatattgttaccgttcactgaacagctattttcaaatgtacaagatggagataggctcctgagtattttgaaaaacaatagaaagagcccctcacagtccagccttctaggtaacaaatttaaaaaccaaatatttgaaaaaaaaattagaaactgtgcaaccacaggaaaacagcctggcagattcaaagtgtaggcaaaaacctgcagagagtgaacagagtcctcatgggcccaaggagcatccaggaaaggcacttcaaaaaggtgggaaagcacagcactaggaaagaacaggatgcccaggcatttgtggacaatgctgccaaaggaaaaaggcttgagggtccagccccaagggagctggaacagcctcacatagtgcaggggcctgagaa

SEQ ID NO: 19750 - DNA, 1042 bp, Homo sapiens
gagtggccatcagctgcagcagggaggcgcaagcggtggcagcaggagtggctgctggagcagcagtggtggtggtgggacccctgtgccctgcatccctgaggcagctgagtgcatcactcctacctcacatggctgggcaggacctgcttccaggcctggagcctccactatggcctcaacctctccccacaccgtgtctcaggagcccatgagcacccggctgaaggcgcagctgggactcgtggggccagcctcaagatcatcgggtttgtttgtgcggggttggccggggctgccacgccacctgtacctctcctgctcctgctgcagggaaaatgtggagaggaggcatgtagtccccagagcccacacctgggagccccctggagcctgatatccccagagccaccatgatggggccgggccgagttacccgttggcaggggagcagtgtgatcaggcatggaggggtggacagagaggagccccgaggtggagctgggccctgagcggtgccgcgctccatggagctggcaggagctggaagctggcaagagccccacctcccagtcgcagctgcagctgcccagccgtggctgtggacccaggcatctctgcagtctaaggggcccaggaagcctgtgggcttggagatgtctgctcctgctgcctggcctctccctgctcctggtgcccgttctgatctcagagcgaggttggggccaagcctgggtgctgttgcagcctgaccgggtgtgcgcatgcttgggacagtggtgacatgccaggcccctgccactttggcctcctctagacttcaggcactggcgagcatgggagggaggctgagatggggactgagggcagcttggtgtaggcctgcaggtaccctttggcatggccttggcagcttgaatgccagcaggaggcagacaggctcctgggcagaagggggcagatgccccgtgaagccccaccttcaggctgggagggcctgaagcccgggggctgggttgctgatcccgcagaccagtgtggg

SEQ ID NO: 19751 - DNA, 1796 bp, Homo sapiens
acaggtgtgagccacagtgcccacccctgaattttactcttgttggagatcattatagcatagatggaatatttaagaaattttataataagcaccgaagagtggcagtgaaacagaacaaaaatgaccttactgtaaagagtcatttgctttttgtttttgattagtggggagaaaaggtgtggtagaaagaaaatagatttgagaatcatatctgagtttaaattttgatttgataacttcttagatgtgtaccatgggcagctgacttaatctttctagcccgtctccttatctgcagaatgtaaacaatgcatgtagagggcctgcccccacacattagtcactcactaatactagcttccatagaatcttttttttttttttttttttttttttttttgagacaaggtttcacttttgtcacccaggctggaatgcagcggcgtgatctcggctcactgtaacctctgctttccaggctcaagcgattctcctgccttagcctccccagtagctgggactacaggcacacgtcactgcacctggctaagcttccacagaatcttaatcaccatttttagtctgcagaatcagaagatacttatttgtctatactttcttttttttttttttttttttttttttttgagactgagtcttgctctgtcgcccaggctggagtgcagtggcgcaatctctgctcactgcgagctccgcctcccgggttcatgccattctcctgcctcagcctccctagtagctgggactacaggcacccgccaccacacctggctaatttgttttgtatttttagtataggcagggtttcactatgttggccatgctggtctcgaactcctgaccttgtgatccgcccacctcggcctcccaaagtgctgggattacaagcgtgagccaccgcgcccagccttgtctatactttctacttttaaaactggcctgaaaagttatgcttaaccagtacttttaaacttaggaagtccagggaaggaagtaataagctatcatgacttaatatatcaatattatgatacttatatttttcattatctttttcttttacaagttgcatgatatctcagaatcggaatttctaactgaagctgaaatcatttgtgatgttgtatgcctggtatatgatgtcagcaatcccaaatcctttgaatactgtgccaggatttttaaggtttgttgctcctacagactatgactgaatgtaacttcatatggactttttatggaattgcagtgtggtgtttcctaaccacaaaaatgcaacaaaatcatgtgtattttaaaaatacatacatctttaccctattcctgaaggttctggttttgttctaaagtggtagagtctcagacatacatatttctgaaagttttcgacatgtgattgtgaggtgcattcctgattgagaacttttacattaatgcaagctcttcccagctgttaaaagttacatatgtctgccttctctctgatgaaaaaaaagagtagtacatatggattatatattgccaaatataccaagaataacagccagaggaaagggataaatctgaagcttagaaagtctatcagtcacttagggattatcaataagattcaataggagtaaaaagctatatgtacaaaggtgtttattctagcattgtttttaacaggaaaaaactggaaataatcaagatggctaacaatggacgatgatttactgaagtaagataaaataatctagtggaatgttaggcaatatttaaattaaaaaata

SEQ ID NO: 19752 - DNA, 1022 bp, Homo sapiens
tatgtggctaaagcaggaagatcacttgagctcaggagttcgaggctacggtgagctaggattgcaccactgcactatccagcctgggtgacagagcaagacgctgtctctgaaaagtaaaataataaaataaaaggagatagccagcaataggagaatagaatataatccagctatttagaatgtttccataattgatgaagaagtccataccttataacacgtgtgaaaaatatatagaaatatacacacattgtgtttgcagctgtgtaaaaaatacatagaaaaagtctaaaaggggctgggcacagtggctcactcctgtaatcccagcactttgggaggctgaggcagacagatcacttgaggtcaggagtttgagaccagcctggtcaacatggtgaaaccccatctctactaaaaataccaaaaattagctgggcatggtggtgcacgcctgtaatcccagctactcgggagactgaggcacaagagtgactggaagctgggaggtggaggttgcagtgagctgagattgcgagactctgtctcaaaaaaaaaaaaaaaaaagtctaaaaggaaatacctgaccttttaatttgttgccttgggtaacataaatgattttttttcttactttgccttattttctaatgagtgtatattagcttttttatatttgaaaataaagtaaactttagaaagaaaaactatgcagtaagatactataagttattctaagatgatattttctataagtcattttgaaagaattatgcttttgaattgtggaagaattatttctgcttaagtttagaaatgagccagaagcggccaggcgtggtggctcacgcctgtaatctcagcactttcggaagccgaggtgggtggatcacctgagatcaggagatcgagaccatcgtggccaacacggtaaaaccctgtctctactaaaaatacaaaaattagctgggtgtggtggcatgtacctgtagtcccagctacttggaaggctgaggcag

SEQ ID NO: 19753 - DNA, 1029 bp, Homo sapiens
tggtatagggttttcatactaatcatgttttaaataataattatattttctgactgcaggcacgtgacacaagctgacctcaagagctccacgttttggcttcgagcaagttttggtgctactgtttttgcagttttgggctttgctatgtacaaagcattattgaaacagcgatgatataaaaagaaatactgtccctaccaaaaacaaatacttttatgtacattctgaatgctttaagttctgctagaattattgagatatttatacatgcagagttactttattaatatttgtaattcatgcataagagtattttaatgatagttataactgcagtattggctagcatatggaaagaaaacagctaacagccaaactaaaatggctaaattccagaggccaaaagggaatattttgtaaatatatgtacatattcaggcaagatatggtctcccaagctgagttctagaaatgatgtttctagacatttctaagtggtattgttagtgctcacttggctcactcttctaggtttaagttagcccagagattgtatttactcatggatcactttatttatttcacatttactcagaatgatcctttgggttctataaggacataaggtacaatttgccattgtctctccatttttaaaaacatacaagtcagtgtcagcttaccaacatgacattttttcagtcagttgtggtaggccagccttgaagccatcgcacagtctagaaacttgtgtagctgagtgtgcagctcacctttaagggtgaagttaggtaaaagcaattagcagaggcgttatctatgtgattatgttgcttccttgtcagtatgttgaattttatagccctttcaatgaaataaaaaaaaaatttgtatattaccaatgtttttagtttaaataaagagtcacccttactactgttgaatttcatcccaagtgtaaatcattctataatggctgtgtctgttatagtatattacagtaactgcatgtgtcaccaagtgttc

SEQ ID NO: 19754 - DNA, 1001 bp, Homo sapiens
atgaccctccaagaggtttttccacttgtaggaccacagaacccttatttcaggtaccatcaggtacctggtattccacagaacacacattgggaaacccttaaaaatcagctgggtgtggtggctcacacctgtaatcccagcactttgggaggctgaggcaggcagatcacttgaggtcaggagtttgagactagcctggccaacatggtgaaacctcgtctctactaaaaataccaaaaattagccgggtgtggtggtgggtgctgtagtcccagctactcgggaggctgaggcaggaaaattgcttgaacctgggaggtggagcttgcagtgagccaagatcgcaccactgcattccagcctggcgatagagtgagactccatctcaaaaaaataaaaataaactcaggggctatgtttcattcaaccgaacaagacagagaaaaacaagggagggcaagatgggaccagccagcacagtggaggaatcctgaactatttctgtcttgaccgcgaactcactctctgacctggactagtttattttgttccttttgccctatgcacctgtttccccataaaacgagtgggatgcctgggccacagttgatccttagtgaatatgtgttaggtggacacataagaggattggatgagggtctctcaaactctctttagccacagcactctagtgatgggagagagtgcaggctctcgcccctctgcctggatatgaatccatctgcacctattaccagccattcacacttgggcaacccagctcttggtgccttggtttcctctcctgtaaaatggagctcacaatagtgtgtacctcttagggttgctgtgagatttaaataggggggaccactctcaaagtgaccaagttaggacactttgagagtaaaggagctactgtaaatcacactcaaggctgggcagggtggctcacgcctataatcccagcactttacgaggccaaagtgggaggattg

SEQ ID NO: 19755 - DNA, 1050 bp, Homo sapiens
ccttccccaggcacagcttgggttttggctctgggtgcctctctgcaaacccatctaaccaagggctgcctgcctcttcccaagctagcgtgtctgagggtgctacctcctgctcatcttttgattctcactcagacttcacctactccaggaagccttccttgacctctgacctccctgggactggattgggctccctcttgtgtgctcccacagcaaccatcactctgaactgtgattgctggttactaatctgtcttgagcaccaccgtatccctccctgtgcctggtaatgagcctgacacttagtagttgctcagtaaattgtgatggatggatgatgagtgagtagatgaaggaaggtatagtgaacacaaatacgggctctggagccttactgagtgtgaacttgatggattcctaaagctctcggtgtctcagtttcctaatccaatagaatggggatgttaatagtccttatctaacgggaagactggtgatcatcaaatgagccaaaagacgtgaagggctgagaataataacccctgacacctaacaagaccttggtgaatgttgcttcttattaacaattataggagaaagggaaatgcggggtcaggcctggtgcaaggaacatgctggctgggaagtgggtggggagctccgctgggccccagctctgaccctctccccactccatttcctgcacagatgagcaacaagcgttccaacagcttccgccaagccatcctgcagggcaaccgcaggctaagcagcaaggccctgctggaggagaaggggctgagcctctcgcagcgacttatccgccatgtggcctatgagaccctgccccgggaaattgaccgcaagtggtactatgacagctacacctgctgccccccaccctggttcatgatcacagtcacgctgctggaggcaaggacaagggtggggagggggttgctctgccttggggagtggcgggtatggggagaggagccaagaggatgacacacagatcatgggggaagagggacatttcttttccat

SEQ ID NO: 19756 - DNA, 1028 bp, Homo sapiens
gcgtgccccaccacgcctggctaatttttttttggtatttttagtaaagaccgggtttcaccatgttggccaggctggtcttcaactcctgatctcaggtgatccacccgcctcagcctcccacagtgctgggattacaggtgtgagccactgcgcacagcccaaactgatcctttaaaattcaaatttaattcagctccacacatactttgtgttttggggcaaattattccagctctcttaagtctcttttatctcatctctattaacaagttgacaataatggctcctaccccagaggctgagacaaataatgttaaaactcactacaatgcttggcacacggtaggtgctccatggatgtctgctattattttttgcttttaatagtaacataatttacattactagttattattatatgctaagctctgttttaagtgcagccaagatgaagtttaactgccttgcccaaagtcaggcagctaagcagtggcactggtggactatgaacccaagcactggacttttaaccacctctcacttgcatgatcctccagttgccctcttagaaccactgtgccttctcagagacttcagctgaaatccaacttctgagaatgcttctagggttcgccagaacccgcctttgctagcctccctaggattatctcttgtgaccagcaccttcactgacagctccagtcttttttttttttttttgagacggagtctcactctgtcacccaggctggaatgcaatggcgagatctcggctcactgcaaccttcacctcccaggtccaagtgattctcctgcctcattctcccgagtagctgaggttacaggcgcctgccactacgcctggctaatttttgtatttttagtagagacagggtttcaccatgtcggccaggctggtctcgaactcctgacctcaagtgatccgcctgcctcggccttggcccatagtgttgggattactggcgtgagcaaccgcgcccggctatcagctccagtcttaccac

SEQ ID NO: 19757 - DNA, 1020 bp, Homo sapiens
tgtgacactttgtagttgtgacaagaagcagagaaactctgtaaatgatttatttgtcaaagcatcaaaactaaaatgaatatgaggtgcttgtgcccatcacttttacttaaatattgttggatgtgagaggtatacaatacactttcccactgtattttgaaaatcacagttagattttgattttgtcatacattttcacagattgcatcatcagagaaaatacacccagtcattttgcggtgaaaacatgtaagcatctcattcataatgtaattcaggaggtataatcatactgtcatttttttatgtgtgtgtttaatggtatctattcagttgacttcagaaattttctaaccttcctcactaaaacttgcaagctaattaacacaggtctcttaaagaaggaaaataaaacatcttttaggaaacggtaatagacccatataaacatacttcaaatgtgcagtgattttctccaaactattgaaagtaatgggacctgttaataagggttagtatttaagaaagactatattctatgaaattacatgctttattattataggatgtaatggaattttctaatctattaatagaagttaatcttctgataaaaattttaaatcaagaactgaatttacccacaaaaatttaaaaaatttgaaagaaaattgaccaatttatcattttttaagtgaattggacactgatatttgaaggtgagctcttttaggggaaaaaataagtgggttgtgtttttaagtcatggtttagtggtaggtagttattgtaaataggccatctggttttacttttgagtgtctttaattttggtggtagtatttcctttctctaaaaaaaaaaagtgtgtgtgtgtgtgtgtgtgtgtgtatatgtatgtatttgacacagggtctcttactctgtcgcccagactacagtgcagtggcgcagtcacagcttactgcagccttgacctcctgggctcaagtgatcctcccacctcagccctctgag

SEQ ID NO: 19758 - DNA, 1618 bp, Homo sapiens
tggggcaaatgcctaagttccttggatttagtcgagtcattgagcagttaattgttaataactttgtagtatagaagcgtttttttccacactaaatttttcagtgactcaatttccccaaacatttcttctctgcaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacaggtaaggtgaaaatcctgaaaaggagtgcacttatatttaaagataaagtacagttgtttacagaagtctttgaaattttcataggtcaatttttttgtttataatatttttaatattatttattaaatatactaaaaggtggcttatccacttccatgtttacacactgatttcctctacccataaaaggttgaacggagccaaagttagtatgttactttttcatagctgtgaaccctatttattcttagtttttttttttttttttttaagctaatgaaagtttagtatctggagcgtttagaagttttcctttactgactaaactgaatggaaggacaccaaagtcaaagattagcattcttaagacggtagcaaatcatttgtcaggctctgcctctagtacggaacagtgatgagctacaatgccgcacttgtgctaaaatggcgtaatttaatggcttttgacctaggcacactggtatttcttactggtcttttttcaaagcttttaaaagtcttttttccagagcataagtgaaagatgcttctgttctatatggtatacacatgatggttaacacctttgctttttttcctagtttcattgagaagcagattcagatttaatttattcagaatttagatcgggatgtatgtttattcattttcttttttagattatcccttagatttttttaaattgcttttttctgtttgtgggtgctaaattaaaagcattttctttaagtgccttttgttaagcacattaacctagcttttatggtgggtggaaattttatgtattgagagatgtaaaacttttggcaaaaatcttttgtagagaatcattgatacagaattggattgaagtgtcagtatttgtacatcgttattctcagtttcaggtatcattcttgaaataatgcaaaacagtagttttagaaaagaaactagttaactaggttttattgatttagaattaaaattttgaggctcatactttaattttgtttattgtaaatgcattaactgcctgccttttaaaataagtgacatttgattgcattaaattttgcatttacaaatatgcaatctactaaaaagtctaccacatggcttattttgacccatttgtttggagacttttcattgtttcctttcttttatgctacagatggggacacctgtcacaagctcaagtacagcttcatccaattcagaaagtctgtctgcatcttctaaagctctgtttcctagcacagcacaagtacgcaggaagttgcagtttaaaattgttaaaatggctttataacttaacc

SEQ ID NO: 19759 - DNA, 2176 bp, Homo sapiens
ttttattgtgtcaccatttacactgttcatgttatagttagtaacgagtttaaactcatattctgtagttttttttttagctgtttgatagattaataactaattaatagaacattaaaaatagaacacatgctattctaagatactgtatttcagcaatctggaataaatacaaagcattgtaaatttaatttttggtgaggaggtagaagacatctaacaagttaaatatgcagtcttatttccactgctgtgttgtgggtgtgactttaacctagcatcttttgatatttttatgggttatcttgaattttgtggaatgtttatcacattaactttgtattaatttcatttaaagtttggtcctttatttaatgttgatgccttgttttaagttaaactgttgtagatatagttaatttaaggttttgaagtttcgttgatgaagtattgtattttacaggctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggtaagttgcttttagttttctacgagcagcatttgatttaaagccattatagcagttcgtccctttaaaataagtgttcatttgtactcagatggtctgtgatctggtttaatgctcactaagtggtttttgccattctgattcttaagaaatcataaaatacttaaagtggacagatattgcatgttttggtcttagatggtttctctccccttcctccagactgtttctaaaagaagacagtaagtcaggttcttaactctcttaaaaatcattttagttaaacataagtttgcatatgttaattgaataaacgttaagtgtgaagtagaatctgcagatcccttaagtcccatataaatgaatgaattttgatacaaagttaatgtttagaatgttgataatggccaggtgtggtggctcacgcctataattccagcactttgggaggccaagacaggcagatcacttgatcaggagttcaagaccagcctggccaacatggtgaaacctcatccatacaaaaattagcagtgtgtagtggcgggcacctgtaatcccagctactcgggaggctgaggcgggatcatcagttgaacttgggaggcggaggttgcgttgagccaagattgcaccactgcactccagcctgggcaacagagcaagactccatctcaaaaaaaaaaaaagaaaaaaatggaatgttggccgggcgcgcagtggctcacaccggtaatcccagcactttgggaggccgaggcgggtggatcacctgagggtcgggagttcgagaccagcctgaccattgtggagaaaccccatctctcctaaaaatacagaattagccgggcgtggcggtgcatgcctgtaatcccagctactccggaggctgaggcaggagaatttcttgaacccgggaggcggaggttgtggtgagctgagaccaggccattgcactccagcctggacaatgagtgaaaccccgtctcaaaaaaaaaaagaatgttaataacaatacttcattagatagtttcttgttgaagcaatttgtaattcccggaaagttgttagccatgcttcaagtttacaaataggtgaagttttaaggtatctagagtttaagtagttggattggtttgtctggcaaaagtaaatagttgggatgtaagggtaaatttttgaaaattactcttaacgttgtaagattttagatgcatgcctttatgcttggtgagcctctgcattcgagtatttagccctgcgcttatttttattcccaggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtattcctctttttatgtttttcatattta

SEQ ID NO: 19760 - DNA, 2578 bp, Homo sapiens
cgatctcctgactttgcgatccccctgcctcggcctcccaaagtgctgggattacaggcgtgggccaccgcgcttggccaaaatctgcattcttaatcacaaacttacgcattgaatgttaaggctaaaaggtcatctggaaatgcttaattttaaaatattttcaagcctcaccacattagagcaaatgttaatgtagagccctgtaaaggtgggaaggtggtgtctatgtgtgtgcttgtgtatgtgggggtatagaccatatagttgatataacaacagaatttgggtgttacagacctttcagcatggatggattactaattttcaggtatcgaaactgaaatttgatacctgatcctgtggtaaagtatgttaaactatggttttggagtgattattttgaggttcattttcagcctcactgaacagtgttttacgcacatgtgaaaagtatccacatttgtttccaactaaaatttgcttttatttggtgagaaaagttgtgtgcgtgtgtttgttgtagggaataattagggaattggaagagaggccaaaaacaaacctgaattacttttgtttcttgtgtttgagccacgattctatccagatagcagtttactctgagcagtaacaatgaacaagcagtatagcatttagcaaacctggaattgtttgtatatggttttcattcttggaagcataaagaaaaaatatgcattaaatgaattgtaaattttgacttgttaaataacatgtttttcactataactaataggattttaatatttaaagaattttgttgcttccatgacaaaatatcccattggactattttataacctcagtaatcaacatttaagagtccttaattggagatctgttttctctattacctaccatcctgcaatatgctgaaatctttctaagttgcttatcttaattctaatggtgataattgaaaaaagtgtgctggaaatacaggctcttatctggttgagtactgggggtgggaaggatttagtaatgtcataatctgttgaaggtaatatctatagataactaagatagttcctttttttttgtagttctgtgactcagacaaataagattttgagaattatgtagtttttaggtgtctgtaacatccactagtaaaacttggcaaatgaaagaaaattgtgaagtcaccactttaactgagtcaaaattttgtttgaataagctgatgaaaatagacatgtaccctagaagtagatactctaaaattatacagacatgaatgtcttttttaaaaggttgtcattattgacctaatattgagtaatctttctgcgttattccaaattgaaatttgtttgctcttcattgtaacttttatgtaaaagtcctttaaaaggggattcaattataaggctatttgactatagggcagatttttataagtaaacattcccccaattccacttatgctaactgtctcatgacagtaaagtttactcctttttagaaaccctttctcagtattttaatttctgtcattgaatcatttaaataataaccttttgtttttatagcaaagaaatcatctgacttttctgtgtgatgtttcttggcaaaataagcacttgatgtatggtcatgtacataatggatattcattaattttgtgattagtgctgagttttctaaactactatcttaagctcttaggcaccctattatggatctaattcaaaccaatatgtaggaaatggagaaagtaggacttcagtttgcgcttcccaataactttaaatatatccaccttttccaagtgtttaagccctaaaacatctatctttatttttttacctggcatttttgttagaaaatagattacgttttaaagtaacattaaaaaaattcttcagtaagataattgcttttaataagtatatttttcttgctcttggctctatacatttttgcataatattttagtcttgaaaagcttttcattttcttaactctggaaaataatagtttggaactaaattagtttgagaaatctgaatcatctctctttaaatctgttcagttagtctcatgtattctcaggggaaaatgtctttattttactaagcggaagtagtagtcatattgaggcagaaatttgtagcccaaacaaggtaggtcttcgctgaaactaatttgaactattcctatttgaagcaaattgaacactattataaatctagactggctaattagatggaaactttgatggttaggttctttaagaggcatacaatccgttatgagaatgtttatgtttatgttttaatttttatcaaaataacctcagaggaggtacatgtgagtaaactgtcttaatggttgattacttggaacccacccattaattctaaatgatgtaatggtctataaggtagtaatctggcacagcttcagtaatgtgtgctgtgtttgtaaaaaggtgaagtactttattggcattttctaagccctctgacattgttagtgtctgggttggttggtttgcattttactattatggtggaatctgtgttccttc

SEQ ID NO: 19761 - DNA, 1033 bp, Homo sapiens
ggtatgtctacatattcgtttaaatttagaaattcccacatgtttaagatatatgcccatcccctttttagagtaatcaaaatttctatcacagttcacatactggaatacatagtaaaattgagatgtgtccaagagattttcaatgttaattagctcattctaaatagccaatataaggtaacttctgtttaaaaaaaaaaaaaactagggaaaagttttaaatgtattagtatcaggctctgaggaaatttaatgcacattgactttttaaactatggattgaactcctcagtttaatacaatttgtgtttttgttaactagcagcagaatttcagcatttgctacttactggtagagaagaaaaatcccacagccctgccagtacaggttagtttaatctgtaagtacctgatgttcctatttttttcaaacatatccatataactcacacaaggaagaaagctgtgcggttacttaaatgttagtataactaataatagatccattggacactttaaacactcagtacttgggccaaagtagatctaggtttgctaaccccagttgtaataaaggtgtaatactgctcctttgttatctccttgtggttcaacctaagtagatacattgtacataaaaggaaaagacagtttcagttggctatgcccttgttgatagatgatatggagtccagggctttgggtccagggtcttttacttaagctatttcatggtggttctctcattcaccttttaactttttacattatgaatcaacctaagaaaaaaggcaagtttcctcacatctagaaatgataaatggtgtacagtcataagctagaatatgtttttataatgcttttttgttcttttagcaacacttgtaaatacaagtactcctctatttttgttctttttttgtaaactataacgtatcccgttggtgtaccagtgagttcattttactgtaaactaagaataacatacctttttaatactgaaagttgactactcatcaagaaatgtagc

SEQ ID NO: 19762 - DNA, 1082 bp, Homo sapiens
gatgttccttaacatgtagccatgtaattagaactcacaaggggcattgaaatgtttttctttttcagatagtctggggctatttacttattttaagtaagccaagtctaccatttgaaaaatggtgctttatttccatatctgaagcctgaagttattttttagtttgttttcatctaaaagtggaaagatttttgcttctgcgttattaagagcctctttgtttggaggagatggttatctccttcactcattaacctttgagtgcttgttatctacaaagatgaataaaatctttcatttattatttatgatacttgtctgagcccattttttaaatttgtatccagaacagttatatattaataaggtattatgatatgcatcagttgtcctgagcagtttttgttgtatcctgggaactgtaaggaataattattaaatacagaatgtctacggggaaaaggggtaaaagagcacgcttagtgtgcatattttgtatgtgatagttgggtaggtagatgagccagaagaaacagtgatttagagtgagcataaaactagatcttgcaaccaaatccttgcttttctattatttattagttatatgacctggaacaaattacttttcaaatggtagttataagtttcataggtttgtgagaaacaagtaaatatgtgtagaagaatttggcctggcaactttgtaagtgctcagtattttctgtatgtttacttgaaagaactaacacactatacatttgtgctaaccttgttagaccacaggcaatggtgggagcagacagttattgcaaatcaaaaaatttcatttagcacatatatatgaatgcccacagtgtgctttgatattatcctttgtacatagtagagaggaagtgcatctgagtagagactttggaactgaggatttaagaagccagcctttgcacaaagtctcattgagtaacagtgttttgggtagtaggtgtgcagaaaccatgagatgggaaacataacatcttgaacaaaaaatgaggtttgaatggtgggtgggatgggtgcgtgtgcatgtaaggtgagtg

SEQ ID NO: 19763 - DNA, 1025 bp, Homo sapiens
atgcttctgtgttcagtatgttgcagtgttttctgggttgaagtacccaaagaaaatccaacctcacacagacaagtagttgggaaagggattattttaatcgctttttcacttgaaagcttaaatgttttctgttacaacaaatactgagttgtttttcttgaagtgacagggttacttcatttttgaggaaatgtctgccacatacccacatctgtagatccgtggttgtctatcagttcttgcaaataaaaatggtgctccctgagaaaagtagctagttcagcccaactcaaagaattgcacaaatgtctttccatgagacaactcttgtacttctgtgtgtggaagtgttttatgcatgcttcccatgttatcactcacagtttttaaaagatgtgtattcatgggtcaaggatttataaaattaacaatttttattctgtcatctggggcaatcttaagtgaaactggctttttctgtgagtgcatgatgaagaatacagtgactactgggacagtttgataacactgcctagattcatactaagacaccagctcttttacccatcatcagttttgtaccattaatgcaaatgtcaatcaattgagaacaatttgtagtattattataaaaatagctttaacctttcagacccttgaaagggccttggggaacatactctgagaagtgctgccctaaatagtaatagagaggatctgtccaatggtgtgctaagaatctcttcacattccccaggaagagagacatagctgcagacatttagagtagacataaagttaagtgtgttgctttaaaatcaagagtaactactaaaaaaaacccagacacatctatagttttcaaattagcacggctaaaaaaagggaatacagaaatcaattcaatagaagaaaggaagagactcagaaaaagggataacatcttgtgtgtgatggctcatgcctataatcccagctgaggtaggaggacctgggcaacacatagtgagaccctgtctcta

SEQ ID NO: 19764 - DNA, 1050 bp, Homo sapiens
agctgctactcctcagccccacggcagaaagctccactaagaggagggtctctttcagaatgtgggaaattcaggggtgacacacacctcagattggcatttggtttgtggaggtggccgagacgctcatctgctctgtgtagggtgtaagagtgaggtgttggagcgggaccgcctggctagaggaggtgactaatctttccagactgcctgtaggggttggaagtgagttaagggagttagttgtcagccgcggagttcagggaattctttggaacgggtcggctgcatgttgccggaaaaattaaaatttcttaacgctgtaataacgatggtcttacacctacacacaacaggaaaactgaaatgggaatcccagccagtcgcttccggcagctttctgttgggattcaagtgtgaacagaaatttattacgacagaagaagacgttaatgttcactcataaaggattcaattagggcttggactagctcttcactgcacatgtaatggcatctttgtagtgtagtttgggaagatctgaattggctcaacaagtagtatgagaatgcacctgtatgtgggacttgcaagatgttggcatttgacttagtgtgttgaattttggtattccagacctgcacggagaaaggacaatgacaagatcttgatactttatcattggggatactagagaaggagaggaagtgggcgtcaaggtgtatctttgaatgatattggtaaaaggtgtttcattttaaaagttctgatcttaggtcagttacttctacggaaccagagtcatctcaatcaccgttacatggatattttattctgagtacacactattatttagaactaatgtgaggagcatgaattttaatagtctgtgtctagtgtctaatattttttctttcataaagtagaaattacgtcaaatattacaattagagtatttcctgttggcccactattctaggggagagttccctgaaagcttcactgttagagcaagcttgagtcatggtggttgacggccttactttttct

SEQ ID NO: 19765 - DNA, 1045 bp, Homo sapiens
acttctaaaaggaatctgttgagttctgtgaggtcctgcctcaggctcccaagtggctggaactacaggcgcccaccaccacccccggttaatttctgtatttttagtagaggcggagtttcatcatgttgtccaggctgatcttgggctcctgacctcaaatgatccacccacctcagcctttcaaagtgttgtgattataggcatgagccactgtgcctggccttttttttttttgagaccgagtttcattctgttgcccaggctggagtgcagtggtgtgatctcggctcactgcaacttctgcctcctgggttcaagcaattctcgggcctcagcctccccaagtagctgggactacaggcgtgagccaccatgctcggctaatttttttttttttttttttcttttagtagagacgaggtttcaccatgttggccaggctggtcttggactcctgacctcaggtgatccacccgccttggcctcccaaagtgctgggattccaggtgtgagccaccgcgcccagccaagttctgtgaggttctgacaaggaaaatctggtcatataattacagataatcccagtaagaataggaggaagtcagtatgattttatgggacttaaaaaaaaattaactcagtatgtatgaaagtggaaggaaacaggaaatacaaacaagaatgaatataaaacagtagtagactaaaacagatgatgaactgagtctgaaaaatgcaggtgggcacagtggctcacacctgtaatcccaggactttgggaagctgaggtgggaggattgcttgaagccaggagttatgtggaccagtttggaccacacagcaaagaccctatctctgttaaaaaaaattttttttttttaaagcagcatgggtaacataaggagaccacatatctacaaaaaagataaaaaaattgactgggtgtggtggtgcgtgcctgtgtcccaggtacttgggaaacagaggcaggaggatcacttgagcctgggaagtcaaggctgcagtgagccacaattgtgcc

SEQ ID NO: 19766 - DNA, 1078 bp, Homo sapiens
atatttcacttctgccttttctaggaaggaaaatgattttcaaactgcaaaagatagaaataacagcagaaagagataattaatggtaggtgagagaagacagagcagatagtctctgtaaataagttcaggtctctaggctctaacagtttcttttattatcaaaaaaatagttttagcagatataactatagagccatatattattctgagaaaaatcatggagaggtataaggaagatgaggcaaatgttatcctgcctttcaagagggtaatgcaaagaatagatgtattcactgtgtgctgcacattgaaataaagaaattaaaaataaagagtagacactatacatggtcatcagtggtagagttctgggacagattatttgataaggagatagtaatctcttaaaaaaaagtggatttattgtgaacagattattccaaattcaccttagttctctctgttttgttttgttttgtttttttgagacagagtctcactttgtcacccaagctggagtgcagtggcacaaccttggctcactgcagcctcgacctcctgggctcaagcagtgctcttgcctcagcccgccaagtaactgggactacaggccttcaccaccatgcctggctaatttttgtagagagggggtttcgccatattgcccaggctggtcttaaactcctgggctcaagcagtctgcctgtcttggccttccaaagtgctaggattataggtgtgagccactgcacccagcctagttctctttttggttagctttatcagacccatagattttcaggggtctgcatgccacctgtttttgtaaataaagttttattggaacaaagccacgcccatttgtttccacattgtgtgtgactggctgagttcaggacctgctactaagaccatataacctgtgaagccaaaaaaatttactatctggctcttcacagaaaaagtttgccagcctctggattagaggaatgatatagactgtatatctgatgtaagcagggtagttgaacatttgccataatattaatatcacaggtacaggttatgaatttac

SEQ ID NO: 19767 - DNA, 1051 bp, Homo sapiens
agtacctttacaaagtagagtttgttcagaggagagcaactaagttacctagaaacaaggacttcggaggaacagttgaaatagccaaagatgttaagcttggataaagggaaaattagggaaatgtaaatgataattatctttaagtatttaaagccatgtgaaagaaggtatagatttgtgttttgtgtttcaaaaaggaataatttgttttggccaacattggaataggctgctttgtgaacatttctgtgactagaaatcattcagaattgttcaggcacaggaggaaattctgtgggagaagggacattgcttcagactacttttaaaaagctatcattacataatataattgaaataaatgcaaaaggaatttgagggggagaatcactgtagactggagttacatgggaaactcaataggacttcagatggacctaaaaggatatataaggtttatatagactgagaagatggcaagacatttcagatgggattatggcattagtgcctcttgaaagcaggagtatatactgtagtcttgtgcagaggtgaatgaggtggcagaatggcgaaaagttttaaacattgggaatcaaaggtcattactggggagtgaagggaaaagatgaacttttctactctatatcaagttcttaagtaccggacacagtcccatgcattctctgactattcaggcagatgaggatttcagggccttgaattagcattctctggagggtgaggtttgcttgccctgaattagagttctcaggagggtgagtctgcaattggagaatattaaagaggcagtggcactaaagtaattttaacctacattccaaaatacctccttagttgttgagttgaaccattctctaatttttactatttgacaagcatatctctagtttattgtttcaaaagatgtttctttagagttcatatactgccctcttctatatagtgggggaaaagctctgtgatggatcccttttttggtcatagtttaagacttaggttttgaagattaatgaggaatttaaaa

SEQ ID NO: 19768 - DNA, 1051 bp, Homo sapiens
tctgaaagggaaaaagccagctggaccttttgagtcttaaaagcaactgctaggaatgaggcattagtgcttaggatgagaatttctcccctttattacctgtgtattatacattaccattactatttctaaccagggagaaatctgtgctttaaaaattcctaatctgtcatagaaatctacattccaggtctatacatgttgtttggaagttcttggtctctcctcagtaggtaggagtcttgaagatagagctcttttcctaaaaaacataatctaagcacaaaaatattttatgtgtaaaaagccaagttgatgctccattatgatataactattacacattgagatactgtggatcagacactaaatagagcaacatggataatatgtaaggagggaatttaagctgttctccaaagcatggtttgtgggaagaatttgaggacataatgttgcatgtactgtctctccttattgcaggtcgagctgtgtttagagtgcatcgaatgggccaagtcagagaaaagaactttcttacgccaagctttggaggtaggttttacattagtactcatttcaggtctctaagcatgagacagagggtgaatgtaagcagtaccatccttatcaaaagtatcttcagcaactttgtaattacctagataccgaaagattattgatggtagccccacttatgataattgctctgattgaagttttgagacagatttgctacttggctcagagtagtaagcaacaacatggtaaagttaacagtcatttgctggctataataggagacaatacattggctagatcgtctcttatgctgaatttgatgctatcatcagaaattgcatatttaacagtaacagttctgtgactgtcaatctttgatttctttctgtggctttttccccccccttcaatcaatgccttttctctttcctaggcaagactggtgtctttgtactttgataccaagaggtaccaggaagcattgcatttgggtaagtaagctggtaataagtcatctcagctagctaaa

SEQ ID NO: 19769 - DNA, 1085 bp, Homo sapiens
cacacccagctaattttttttgtaattttagtagagatgggatttgtccatgttggtcagtctgatcttgagctcctgacctcaggtgatccgcctgcctcagcctcccaaagtgctgggattataggcgtgagctgaaaccgtgcccagcatttttttttttttcaagagatggggtcttactatgttactcaggcttgtctcgaactcctgggctcacatgatcctcccatctcagcctcccaaagtgtggatttacaggtgtgagccaccgtgcccatttaggtagatgtctaagctgcctcccagctctgatcttttatggctctattattttatatgttcttattcctttcttttcaatgcccaggtattatccatgcagcagaagagaaggactggaaaactgcgtactcatacttctatgaggcatttgagggttatgactccatcgacagccccaaggccatcacatctctgaagtacatgttgctgtgcaaaatcatgctcaacacgtaggtgcaccttaactctggactacaagaactcagatccttcagcaagtctgtttgccatggcagagatggcctgagcagggagtttggccagttacagaaacagcagcagctgcggcctctagggctggctaaggtagagcgggaggatcaaaagtggtccagaaaactttcgcttgctagtctttcagaatcaggcagacattttagaaatccccttcccagctcctcttggagaattctcctcatcctttaaatattctgtcctcataggtgcagagcacaggacagagggtcaggaaatagcttacagatcagccagtaacagccaactgagccacccagaatgaggaaggaagggttaaggagaggtttgaaaaagtggacaacaaaagtatgacagacctacttataaagaagtctacagaattattcaattcttttgggaataaatgaaatattgactaagaactctctctggatctttggattacataagggctatgttttaataatacctgttacactgggatttgacttaaacttatagttctgcttgttgtgtctatt

SEQ ID NO: 19770 - DNA, 1883 bp, Homo sapiens
cctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttgggagtggggaaattgcttaaaaaaaaagaaaaagaaaaaaaaaaagattattctaaataaaaggaaaaaggcttacactacctaaagctgtgctctctgcctcctgggagagggccgcaaagccaggcaccccgccaaccactgggggtcctaatccacctgctgggcatcacctctcctcctcctcagaattgggtgtttgctgaccatcaaaagcaatgactttttattctgtttgtactgaaccaaaacaaacaactgtgtatagactgctgttttcttttttatttgaaatgaggcattttggtgttctttcccctaccatacggcctgtctgcccttccctccccacattggctccagcagagtagccgaaggtcctgccgccgccgccaccaccaccaccactgcagcaacaacagcagcagcagcagcagcgcctgcatagctccactctgacctgtgaaggaatggggatgaggccaggagctagtgtctaccacggccacacagggagcagtgtgggcccttagcccccaaggggcctgctatgcatgtggctttttttttttttttaaacacagtaaactagattagtcgtcagtgttttaattgcccctcttctcctctcctgcattcctctcctctcttctttcctctctgtcccttctctttcccctctcaaccaggagaccatcatgtctctctgccttcctcctctcccctccaggggagtcaggctgtctgtgaaagccatgagcttctctccctctcccactcctcctctcctactttcagatggatttattccttttttaaacaatgaacatcggaaatgagactgtggggtgtggtttctctctctcttttttttttaattttctttgttgggtttttgagcaacctcatgtccccttcccagggagctttttaatttacctcttagaactcaagtggatgggaagtagagcactatgtgtcagtatgctttgttttctgacacgattacacagcgaggctttaatgccatttgggtaggtgagcttctgcacttctgttgtgctgaactgtattttcttctctcatctcctctttgtctttttctcttttcctctccttcctgccttcttctgctggcctccttttctctttctttaccttccttggattatccttccaggttttcataataaatttatattttgtaaaaggattttgttgtaccaggttttgcatcctcactgaatctgactggcttttattttcctctccaaaatcaggtttttgttctcaacatctttccccatcatgtctagtcactgttttggttttggcaccatcagtatcaaatgtacaaacggttcttgctaaccaacaccaggtatatctgatgttcagatgagttccaataaaaataatttttttttttttcaaaaggtgtctttttcttgagtgctggagggcttccaagcaagtccagacagctctgtgtggccccacactagtctagctctcatctggccaaagctgttatctcatttgtgtaatgggagtccttaaggtaaatttggggtccaaacttggagggctttgggggcaagaaagttggtgtgtgagttctgaggttggaaatg

SEQ ID NO: 19771 - DNA, 1396 bp, Homo sapiens
ctgctaaatcctcttcagtctgagcagttcagccattgtcagttttagtattgtgtctctgtatttcacttgcagaaagagctttgcttctataaaggactttaaaaagtactccaaagagatctagttttggagtagaggggagatgttttctcaaacttagggcagtcctgagatgctcaggcagtagcccttttctcagttccctttgcgggtcttggtcagatgatgccctctagacccgtgctgtccaatatgtagccgctagccatgtgcagctgtcaggcccttgcaacgtggctggttcgagctgtgatacactgcaagtgtaaacacaaaccagacttcgaaggcttagtatgataacaaaagaaaaggagtgtaaaatatgtcaataacttttttatatatgtgttgaaatattttgggtattgggttaaataaaatatattattaaaattcacctgtttcccttttacttgtgtaatgtggctgctagaaaatataaagttacctatgtggcttctatctggacagcgcagctctagacctccaggaccagcagttgtgtcactgcctcctctcccaggcctctcatgacctgagtccaggcacagctgggaaggtcagctggccggtgggctggcctgggcccggctccctcacctcccttctgggctccagccttcatggtgccaggactttcttgtgtgttaatgagactctactggagttgggagcagaggctctggtcccctgctgtgtgctagttatgtaatctgtgctgctcagaagggccactagatgctgctctgtgatccctgaaagaacaaagccgacttcctcaggagtaagggctcaggcctgctctatttggaacccttcttggaagctgtagctggcccccgccttgacctccctccctcgggatgctatgggaagtggggcatgcaggaagagtggactctccggcagtccacgggcagcccagcccagcagggaagctaacaagcaggctggcccttcaggcagctagagataggcaataggctaagtaggctgattgatgggggtgggatttggaaatcttccctgcagttctatgatgaaggcagctaggaagaaaacagctctgcctcattcaactgggtctgccttctgggtccttggttctgccatttctggcagttgactgtcctttcttccttgcttccagttggagcagtgataggaactgggggtggggaggtggtggtgggttgaatgaaaagaggagctctgtggtgtctgaaaaccagcataacaggcatggcctgggtgataggagctcctggagacccctcccttagtcgcagcagcaagtgggctgccagtgccatcccattcctgctgtgct

SEQ ID NO: 19772 - DNA, 1788 bp, Homo sapiens
gtttttttgtttgtttgttttgtattttagagacagggtcttgctctggcatgatcatagctcactgcagcctcgaactcttgggctcaagtgatcctcctgcctcagcctcctgagtagtagctgggactacaggtgcatgccaccatgcccagctaattggtttcttgaggttttatttttagagatggaattctaatgatgttatccaagctggtcttgagcttctggcttcaagtggtccgctcgccttagtttcccaaaatgctggggttacaggtgtgagcatgtttttgaacacctactgcacaccaagcactgtgacaaacaccaggcatgcagagatgaagacacagtggctggctgatatgagacaaggatgcaaataatttcagtgcagtgtcatcgatgccagggtgctggaggagcagggactggcctacccggactttggaaagggccaggtatggcttcctgtcattctgtaggaaccactgccaaaatctgtgtgaactgatgagttgagctccagcagcatcatggagtaacatttcgtccagagctttgcccattcagccactgcagtgtggtgaacagagcacagcctaggagttagggaacctcagctctgacagcaacctgataggggtcacttttgttccctaaacttcagtcttcttacctgtaaggtggtctatactgaacagtgcccacctcttagatcataagaattcaatgagctgatggatgtaaagtaccagcatgtgcctggatgctcaataaacaggacagatactctgattatcctcattattggtaccagccaatgggaagacctccttatagggtgccctgcatacagctggcactagatcagtgtgtgtggacctgcactgagagcctgtgtgtactctgaattcctctctggactgtggcacagagggcttcacaatgaggtgtgatccttaaagtcaaagaaacatgggacaagggctggcagggagattcaggcccctctcacctggaaccatttctgttttaaagatgggaaaaccaaagtccagagaggggaggagttataaagccagggttaagacccgtgtgcctgactcccaggccagtggtctccttcttgtgtcttctttggtttcacatgagggtattgacaggggcagcaacgccaacaattgctgaaggaagttggttggtcacagctgtgggtaacctcacctctggcttcttcagggactgtatttggggaggcgcctcagtaggcctggtatttacattgagtaaccagattccatctccaataatcacatcacaaacagcatgaaatgtgaactatggggaaggctttgctaaatgtgtgactggttttcttatttttccctccattcccctccctcggaccccaacccctctctccctctcacgtctctctgtcacacacacacacacacacacgcacaacttgcattccccaggcaaccagtgcaggcctctgattccagcccagtgaaggccatctttagaagagagatttcccctgtctggggtgtggcaagaggaattggtatttgaagatcaggttcttgttccttgcagttcaccactgttccccaccatgaccaaggagtgtggagcccttggcagtttaaaaatggctaaacatcttacaccatgtaagcctcatccatgaaattggcaatcatgattcccattatgtggatgcggaaactgaggcttagagtatggaagggactgccaggtcacagagacagaatt

SEQ ID NO: 19773 - DNA, 1050 bp, Homo sapiens
caacagaagaaactggcccagtccccagtcacctctgcacacattgcaggtctcttttctgggccttgtcaccaccctatggggcagagaagggaggttagcctcattctgagggtaactaactgtcccagttggcctgggaccgagggtctactattaaacctgtagtagtctcaggcaaaccaggacaagttgatcagcctacttattccacagatggtgaactgaggcccaagtcacccctggcaggtggcagtgccctagacccccagagtttgccctactctcaacgcacacacacctgctgcctagagaccagctcaggaagggggctgtccttcccagccacccaattctctaggcttcatgtgacctggccctgagttggaggccactgaagacactaggaaagtagacagcatgtaactgagtcagggaaaccaagctaagactcaaagcgcagaaaggaagtggtcaattcggggctgaggaaagcaggctcctcctccaggggcaggtgcccagaggggcttggaatgtgctctgctgttgcttcactctcctccccaactggaaatgccctggcttttccagcaggggccttggcttatgggacccaactgtggagccccggcagagcccccactcagaggtaggagtgtgagttccaaagcccactctctgccactaaacctctgggatcttgaacaaatatcttcccttttctaggcctcagttaaaacaggcatcagaatatggtccaagtctcaggaatgtcgtcaaaacatcagagatcattcacacacaagtgcctggcagagcagtgaggaagtcccaccttcatgaccaagcccacctccagctcaggtctgggatcatagctcaggggatctctacacctggtccccaacttccaggctcactgctcccatgaagtgagcccaggaccagggaaatcaggagggccggtggggcctaacctcagctgtgtgttttggggaagcctttcagcctctctcagctttggttccgtcactggggggggcagtg

SEQ ID NO: 19774 - DNA, 1024 bp, Homo sapiens
aaaagaactgcagaaaaaggaagaagagaatgctgacagcgatgatgagggggaactacaggatttgttgtctcaggattggagggtgaaaggggcattgttatagggttttaaagacccaaggtttctaacagcctctgctgttgtataaaaagtgctgtctctcagtagtatagcggttacttcatgcctcaagatttgggtacctggattgctaaactggattgttgagataaaatgagccagtgagctacagcactttggaaaatttgtgtaacatgtttttgaggtaaagttgtttttgaaatttctgaagtgttatataccaaaatgccaacatttccacgacagacttaactgtataatttcgttgtaaaatctgtaagttgtaaatattgtacatagttaaatctgtattctgttttgaatttttttaattaatagaaagaccaaccggcaaactttcagatgaatgcttactgtggtatttggaatgtatgtatcttctgaaccctacatcaagttgaaaaggtttgttttcttgtttctttggtttttgtatggttttttagaacacttcataaacacataagtcattgtaggttaatcagttctcttagtgtgctttattttaaaaacataagaaaactatatgccaaacatgaccaaaccaatgatggtcagatgtggttgcacatgagagtcacctatgaagcattaaaataattaaagtgtctgaggccttccccttcaataaatctgggattgggcccaggcaactgtgttttttaagcacccaggttattctaatatatgccagggttagagagtaactgccctaaatccagaacccatttatgtttttcaggttttttctttttctttaaataacacattccataaatttgctgtttcttgaatgaaggaaaaaatattatcttttatttatttcatccagccttaaattttgttatttggtggtaaattagggttccttgtttgcaggtcctatctattgtagaaa

SEQ ID NO: 19775 - DNA, 1055 bp, Homo sapiens
acaggcgtgagccatggcgcccagcctgggccaaccttttctgagccatagtccagctgtactacagctgtatccaaaaggtaccatgtatctcccagggtaacctgaagacctaactgggcatactaactgtcctcagatttcagttctttaaggcccatctcttctagatcagtgtaaatatctgaactcacttggtgcttcaacccaattggtcttgggattcatcctttacctacccagctctcattctcttctaggttgttccatggcctcttccatatattacatttgtggtcttgagcaagttagttagttacaacaacactgagcatcttgaccaaggtcacttggcccaaccacaggctaatcccaggccatgtgcacatcccaggattagcttgtggtttatcagttgtcaatttttttttttttttaatacagggtctcactctgtcaccctggctggagtgcggtggcgatcagagctcactgcagcttcaatctcctggctcaagtgatcctcccacctcagccttccaagtagttgggactacccacatgcaccaccatgcacggctaattttttggtttttttgggttttttgtttgtgtttttttttgttttgttttttgagacagagtctcgctctttcgcccaggccggactgcagtggcgcaatcttggctcactgcaagctccgcctcccgggttcacaccattctcctgcctcagcctcccgagtagctgggactacaggcacccgccaccacgcctggctaattttttgtatttttagtagagacggggtttcaccgtgttagccagggtggtctcgatctcctgacctcgtgatctgcccgcctcagcctcccaaagtgctgggattacaggcgtgagccaccgcacccggcccttgtttgtttttttaagtagagacaaggtctcactacattgcccaggttggtctcaaactcctgagctcaagcagtcttcccaccttggcctcctaaagtgtggaaattatagcatgaaccactgtcaggctcttttg

SEQ ID NO: 19776 - DNA, 1048 bp, Homo sapiens
ccatgggtagcaccaaaccctatatctaatgtgttttttccctatactttcactgtttcacttaaagaaagcacttaaagaaaggcttttctttggcatatctgaattgccagcatcactactctggagatttggggccattaaataaaataagagttacttgaacataagcagtattagagttgatctggtaagtaagaaggctaccaagtgactaagggctagtagcatatacggggtgagtacaccagacaaaggaatgattcatgtcctggggtgagagggagtggatggcatgagatttcatcaggctactcagaatgaaacttgaaacttataaattatttatttctggaatttttcatttaatatttttggactagagctgactgtggtaactaaagcatggaaaaccaccagataagggaggactactatatactatcagaaaatagaaatcatttccagtattattgttatggcaaattgaatcatatgatatacactcttttatgtctggcttctgtcactcagcatcattgttttcagattcatctatgtcattgtgggtaccaatagttctttcctttttattacggttgagtagtcttctattatatggataatcaatattggcttcttcattcatctactgatgggcatttggattgtttccagtctatgtctttcacaaataaaaatgttatgaacattcatgcacaagtctttgtatggacatatgcttttttttttttttcctcttgggtaaatactttggtgtggaatggctgggtcatatggcaagcgtacgcagaacttcttaagaaactgccaaattcttttccaaaatggtcgtacccctttatatccctacaaggagtatatgacgatgcccattccttcacatcttcaccaacaactagcatggttagtcattttagccattctaatagatgtgtagtggtatctcactgaagttttaataggcatttccctaacgactaatgatgttgagcataattcaatgtgcttatttgtatccatatat

SEQ ID NO: 19777 - DNA, 1027 bp, Homo sapiens
tggagagcttggctacctccatcctcctcaggccggagcaggcttcctgagagagtccaggtcgtaggagttttacgacttagaaaagcgggctgcagattccttcctgggtgtttggttcaagccttggctccagcctcactctcagtcttcccgggagttcgtgggatttggaccttagattattagtattattttgagggcctcctgtgtgtaagcactggttgtgcgcagatggctgtgcagagggccatgaggtagaggctggggaaatgagggcttggaggtgcttgaggtatggtctttacctacgtgaaatgttggaggtaagtcggatttataacttgtgttgatgcttttataatctaggagcttagggtttagtaggaagagtcgctcattcaatgaattaaacgctcattcctatgtactaggcaccattccgagtgcagtggctacaaagactagtagaacatagtcctggttctttaggaactctgtgattgggcaagtgggagagagggcggaaaacgtgaactggtgagtagttggcgtgtgatgcgtgccgtagtggaagaaagtgctgtgagagttagaagagggggatgattgaaggaattaaggacatttaacagaaagtgatatttgagtaaagtttatttttgttttgttttttttttttttttgagacgggagtctcgctctgcctcccaggttggagtccagtggcgctatctcggctcactgcaaccgccgcctcccgggttcaagcagttctcagcctcagcctcccaagtagctgggattacaggcgcacaccaccacgcccggctaatttttgcgtttttagtagagatggggtttcaccatgttggccaggctggtcttgaactcctgacctcgtgatccacccgcctcggcctcccaaagtgctgggattacaggccaaagccaccgctcccggccttgagtaaagtttaaaaagtatacttagggtgggtatttatccctccatgaaagcgccttt

SEQ ID NO: 19778 - DNA, 1003 bp, Homo sapiens
ttgaaaacaggccaggcatggtggctcacgcctgtaatccgcgcactttgggaggctggagaaggtggattgcttgagtccaggagtttgagaacagcctggacaacatggtaaaaccctgtctctacaaaaagtacaaaaattagccagatatggtggcctgtgactgtagtcccagctacttgggaggctgaggtgggatgatcgtctgagcctggggaggttgagactgcagtgagccatgatcaggccattgcactccagcctgggtgacagagtaagaccctgtcttaaaaaaaaaaagaaagaaagaaatattaattagaaacccatggttgaaacttacctgaatagaaggctttattttttttcataggtaagcctatgttttcttggatgtgaaactagggcactgggttgctcttaggtaatacaaggagatgaaatgcagcgatgcgatgatgagtgaagtagagcctgacctggtattgccattgcttcactgttggctttgaccagggtatgatctcttaatcttctctctgagctgattctgattgtggtttttccacacaggtgtgttgtatcctgtttggacactggttttattatgtttaagatgtttcttttattttcttttgaattactgatattctcatgttttcctccttaggttgagatgaaaactcttgctttgaattcttcatggaggactacatcatttcaatcctgaatctggctcaattctattattcacttattactgtattaaaaacgtttaattggccaggcacagtggttcacgcctgtaatcccagcactttgggaggccaaggcaggcggatcacttgaggtcaggagttcgacaccagcctggccaacatggcaaaaccccgcctctactaaaaatacaaaaattagccaggcgtggtggcacgcacctgtaatcacagctacttaggaggctgaggtggcagaattgtttgaacccaggaggtggagg

SEQ ID NO: 19779 - DNA, 1025 bp, Homo sapiens
ctttgaggagttactgtggataaaatcacaaagccataataggttcatacttttacccagttgcatttggcctttagatttttgccccattagcttgaggagttacattcttagtttttcttgaaccatcaacggtggtgataaaggaagatgatactcatttttagaaattcttaaatataagtgttcctaaaattaattggatgttcttaaaattaattggatgccttgttggatatctataacctgaatgaaggaattcttttctcttgctataggtgcacattaaagatccaaagtcatgactgactccaagtatttcacaaccaataaaaaaggtaagtatgagaatacaatcaaatcttttgaaattttcaaaagttgtagtgtaagattgccccaggcagaatgctgctgacctcttccttcagacatacatgtagctgacaatctcactggacatctactacttctatagatgaatgtattcaagcaagttattaaagagtaggttttaaaagagagggctgtgatgcacattattatgacttgaaggttctgtttagtgaaagagactcctctttgctgtttgagatgatccattggagattggttaagtgtgaggaggacaaaagaagcagcatactttttcccttttattaaataatttttacttggaaataaacattttataacaaagaatacaattaaagcaatacagatatgtatgtaaaaggtaaaaatgaaagttctcccttcctgttcctattcccaagggaacttggtgtatatcctcaagtctttttctctgcatatgagtgcatatattaatacatatgatttaaaatttttttatctttaatgaaaaagcaatcttgcaaaacaatgaatagaaatgagttattttcatatccgtccatatacatctaccatgttcttcgtctagatgtatatttaaaacggaatctctagagccatctatggtttttaggtcatagacggaattacttgagggactttgcact

SEQ ID NO: 19780 - DNA, 1029 bp, Homo sapiens
caggggctgttgtggttttgccaagcttatttctgtatcctgcagaaaagttaaaactcttgatttttttttatatgcttgctattgctgatactttattatgtacttagcactataccacttatcattattcaaacaaaaggctagtggatgtctgtttgccttcatgatttttactgtctagttgatgaaacccaaaacttgaaaaattagggaaaaataaaatatacttatgtaattaggcactgaagtgtatattttaaaggcaatacgagttctaccaaagagagatacaggttaacaggaatagttgaagaacccttcttggagatgaaatatgagctgtacttagaaagatagtgcaaagaaataaaatggagattagctatttgtagattgtgatatttcagcctttcctgcaagtaacctcaagtgcagcactggccagtggaaatacagtgtgaaccacatatgtaattttaaattttctaatagccattttgaaaaaatgaaaaggaacagatgaattaattttagtaatacattttatttgacccagtatatctaaaatatcctttcagtatgtaatcaacataaaaattattaatgagatattttacattatatttttcatgctaagtcttcaaaatccagtgtgtgtttcacatttacatcacatctcagttcacactcgccacattgtgtttagtagtcacatgtgactagtggccaccatattggaaagttcaggtttctagtttataggttggcacttaacactttttacttcttgcttgatctttggctattaagtcttcttgaccttgtgtagattgctagaattaaactatttaggatcttgaatttattattggttaatgtttaacatttactggttatcgttgttttgtgcatgagctagtctaggaaatagaaaacacatttttggagagtatttactaaatatctacaggtgcatgaaactaccgtaggtaccatgcatacaagtgaaacacatagtttgctttc

SEQ ID NO: 19781 - DNA, 1050 bp, Homo sapiens
tcattcccttttttccccttattttccttgtggaaatacacctacatttgttttttctttcttctatgctagtagcaagatgtttagcagtattaaaaatgtataaggtactttgataaagcattgtggggaagatttattgctaacttcccataaagttacagttatcctatattgtaaagatacagcttacactttagaatctgacaagctcaacccttccaagctaatggtgctcctttaaatttgtttcctgtggcttataggagaatggtaaatcatgaaataactagaacttaggaaaggtataaactccttttatatttgattactctcaaattttcatttgtctgaatatgtaatgttaaaaaaataatttcactaaaagggaatcaggacatcttggaggatgactgattctaggtctggaattagaaatgtacaaaatgagcctggatggggcatcttgtcataaaggaaagtatggaaaataccaggtcatatcacaaggattcaggagctcagttcccactggtcaagactggaagaatatgaactttaaaaagcgtaactgaagtgctttgaaactgtagtagatggatatgaagaattattgttccttttgccctgtcgcactcctgaaagcaagatgattcaccagcagctctactggagccacccgcgaaaagtcagccagggttcttgctattgtgtctgctgaaactgggcacagtctgatctggaaattgagcctcgttacatgccaccagtgtttccatcatacgtgaaggatatagatttcattaagttggactaagtgatcttccacgaatggattatctaaggcacccacccaatgagagaaaccatgttagctttttgtacataaaataaatattttaaaataattattgttattttttatttttatttttgagatggggtctctctctgttcctcaggctggtgtgcagtggcatgttcgtggctcactgcagcctccgcatcccaggctcaagtgatcctcccacctcagcttcctgagtagct

SEQ ID NO: 19782 - DNA, 1036 bp, Homo sapiens
aaaatacctcattttttagaggaacaattttaaatttacagaaaagttacaaagacagtacagaaagttttcatatacgcttcagtcagtttcacctaatgttaacatcttacgtaaccgtggtacatttgccaaaactaggaaattagcattgggatgttactattaaccaaagtagaatttcaccagtttcaacactaatgtcctttcgctattccaggattcagtccggaataccaaattgtgtttagtcacttccttttataatgcatcagtctactctgtttgaaggtagctcgaaaacagaaaagtgctttacaaccatgaaatggcatttttcatccagtcaccatagcatagtggttgaaactcaggctctagaaccaaatagatttgggtttgtatcctggttctgctatttcttagacgagtggtgtctctaaattttagcatcctcatctacaaagtggagattacaaatagtgcttctatcgtaggattgttgtgaatattaaaggacagagggcttgcaaagcacttaatactggtcctcatatggagtaagcccctaataataacaaacacatatccttttttttttcttaagagacaaagtcttgctctgtcgcgtaggctggagtgcagtggcacaatctcggcttactgcaacctccatctcctgggctcaaataattctcccacttcagccttctgagtagctgagagtacaggcacatgccatcatgcctggctaagttttgtatttttagtagagacagggtttcaccatgttggccatgctggtcttgaattcctgacctcaagtgatccgcctgcctcagcctcccaaagtgctgggattacaggcgtgagtgagccaccatgcccagcagaaacatatattctatattgtacagtgattgtagtgccggatattaataattttagaagggttagtatttcagtggcaaaatttactttttaattttataagattaaaattttaaggttaagattaaaacttttaggatgaaga

SEQ ID NO: 19783 - DNA, 1076 bp, Homo sapiens
aagacgctgtctcaaaaaaagaacaacaataatattcttatgctattatttattaatttacctatcatagactttttctgttaactatctgctataagaagtttacttcatacacccaccattcccacttccgtctcctgttttccagtgtagttacataatgaaggtttttgttcctatatccattatcatggtagattgaaataatatgcctttgtttcttattctatcaactgttggcttgcaaaatttatgcatattacgactgtgtaaatatttagggccaatgtaatgcaaatgattacattttctttcttatagcatcttttttttttctggaggttttttgttttgttttgatttttgagacagagtctctgttgcccaggctggagtgcagtggtatgatctcggctcactgcaacctctgcctcccgggctcaagcgactcttatgcctcagcctcctgagtagctgggattacaggcatacgctaccacacctagctaatttttgtatttttagtagagacgaggttcgccatgttggctgggctggtcttgaactcctagcctcaagtgatccgcctgcctcagcctcccaaagtgttgagattataggtgtgagttaccacacctggccctggagtttctttaattgcctctttttttcttgcatgtgtgtctttatcatgcccctatattattcctgttccttaagcataatatcaaatctgtaaactttcttttgtcttagacccttctcttttgcagtcctctgtcttcttgttttttctactctgactgattgcttttctggcttctgcacatcattccatacagcctccctatttcttgttattggtatatttttccttgcattgctctttttgtggttgcaatagcttcttgaatctctgaggatatgaatgattcgtttttttgtttctgcactttgaatttaattatcggatattttttggtgatgattgcatatctatgcatataattttttaattgagatgtataccatgcatacagtaaagtgcagctcgtttctgtttaagaaagaggtaa

SEQ ID NO: 19784 - DNA, 1029 bp, Homo sapiens
tgtagtttctgttgataaataatttaatagaaaggctgttaacagcaagaagttagctagtcctgggttctattcctggttctgctagctcacttgattcagatatttaatgtttctcttcattggagaaatgttaaagtctttttgttggatcttgatatgttaacattgtttttattaccactgtcaccacacgtcacaacttgtttttcttttctttttacgttaacatatcttactagccgtctacttagtattaatgtagataattttcagagagattttggtagcataagagtaaggtggttttgttctcttcactagtgtacatagccatcttttccacaagactgccattgtcttatgacctacctctctgacaaagctgtaaacagtaatacaaaaattatatcttattctgaagttcagagactttctagccctggaattactagaaagtgttctcaaagcatctagattcctcaaggctgttagtcatctattgtgactaatggaaaggttctccataatcttctggaaaagacttctgatggctttcacttcttcctttgactaagcgtgctttgatgggagtatgacaggatgtgaggaatgaactttcccaggaaacttaaggtcacccttcaggaatcctgtcttatctagtgctgtcatttcagattacccagatttaccttagaacttttcctgtaactgtttcagccatgaaggttttcagtttgacagagttgccaagccaaacagttaattggaccaggagaggcaatgattgcctgtttgcactaactcatccatgggacaggaatcagcagcataagaattgtaatgaactttctgtatagctttgggaagcaacaagctgttgagcaaataaatagcactgaaaaagcaatcctatggtgctatttttttgttcaataacttttgcctatttctttcaggagtaaacaaactcctggtccttttcagttttaaaaaggagagaggttgaggcactaggttaagacc

SEQ ID NO: 19785 - DNA, 1050 bp, Homo sapiens
gtgtgtgtgtttctctgtttctggactttttgtatatacagtgattggatgtcactctacttctctgccatactgctgtaatggtaggtttttttggtggggttgggggcatagtctcgctctgtcggccaggctgtagtgcagtggcacgatctcggctcactgcaacctgtgtgtctcccgggctcaagcaattctcctgcctcagcctcccaagtagctgggattacaggcatgtgtgaccactcctggctaatttttgtatttttagtagagacggggtttcaccatgttggccaggctggtctagaactcctgacttcaggtaatccacccacctctcacctcccaaagtgctgggattacaggcacaagccactgcacctggccataatggtagttttttgttttgctttgttttgttttgttttgttttttgagacggagtctcgttctgtcaaccacattggagtgcagtggtgtgatctcggctaactacaacctctgcctcctggattcaagcaattctctgcgtcagcctccggagtagctgggattacaggtgcctgccaccacgcccggctaatttgtgtatttttagtagaaacagggtttcaccattttggctaggctggtcttgaactcctgacctcatgatccagctgcctcggcctcccaaagtgctagtgctgggattacagtcatgagccacagtgcctggccttttgtttgtttgtgttttttgttttgagacagaatttcgctgttgttgcccaggctggagtacaatggcgcgatctcggctcattgcagcctccacctcccagatgcaagcaattctcctgtcaaagcctcccaagtagctcggattacaggcatgcacctggctaatttttttgtatttagtggagacggggtttcaccatgttagtcaggctggtcgcaaacccctgacctcaggtgatccacctgcctcagcctcccaaaatgctgggattacaggcatgtgccatcacgcctagccttggtagtatttttttttttttaatc

SEQ ID NO: 19786 - DNA, 1035 bp, Homo sapiens
ggatcacttgaggccacaagtttgagaccagccggtcaacatagcaagacccccatctctacaaaaaaatttttaaaatttagctgagtgtggtggcactaaattgtagtcctagctacttaggagactgaggagggaggatcgcttgagcccaggactttgaggttacagtgagctatgatcatgccaatgcactctagcctgggtgacaagagtgagaccctgtctccctgtctcaaaaaacaaaacaaaagaacatctgatgaatttttataaaggttttaaggtctaggtcttaaaaaataattgaagggaaatttaagtcattaaaatcttctgacttaaaacctattcattctcttgactaaaagcttttacagtttggtggtttggtttagggtcccttgtttgtggttttgcctttagccttcactgttaaattagttcttagttttgccctcaataaccatagttcattttttttcatcaggtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtaagttcttgtctcttgtctatcctagtagttttagatgtctttggggagatttcagagaaagcaaaggttataggcagtttcttctgtgtctgtatttacatatagtatgttcatttttctcccaacagggatgtctcttctcagttttactaattttttgtttttgttttcgagacagagtctcgctttgttgtccaggctggagtgcagtggcaggatcttggctcactgcaacctttgcctcctgggttcaagcgattctcctgcttcagcctcccaagtagctgggattataggtgtgcaccaccacacctggctaatttttatatttttagtggagacagggtttcaccatgttggccaggctggtcttgaa

SEQ ID NO: 19787 - DNA, 1051 bp, Homo sapiens
ggggtgaggtagtaaatagttgtctaattcagaaaaatctcacctttaaaaaatattgctttaatgacagttatgcagttatttcccttaaaattggaaatgtctttatattaattttcttatattttccattgagaaagatgtataataatgatgtatcatattcttgtagaatctataggatcatttatatcttttcattgaactcactttatcttctcatattattcattcctttccattagagtgaagaaaaatatgtgcatgatacctattctaccttctttttagacatactgatagaaccatgtgttctgtcacattttctaaatggtatgtcagaagatgacagaatttcatgtgtagagaatactctgtgaaagattttatttatttcttgtcaggtgtatgaaatcatttcccctttttacttctttcttaaagccttttcatcatggcttcctggacactttccttgtaaattagctttcctagattgtatttctgtctttaatctttgcagttccatgtttcttctcttctctgattattaatcttggttgtatcaaaaggttcaatctgaaccctttctttctgtgtttctctacatattcccttagggaaattacccactgaccactaatatattacagagctttaccatttagaccatgttttcaattgatccttgctttaataaaaccttatgcttcagtgatattgttatcactgaagaaattttgtctcacagaggttgtcgctttccgaaaattatgcagctagtaattaatggagccaacacttaatcccctgtttttaccaccatcctacactgacccacaccctcatgatttcacctgagatgtgtatgtgaatttctaaccaagcttacttctctagctctgactgccagtcccttggttttgtttttgtttgtttatttgtttgtttgttttgttttgtttttgagacggactgtcattctatagcccaggctggagtgcagtggtgcaatcttggctcactgcaacctctgcctcctaggttcaag

SEQ ID NO: 19788 - DNA, 1054 bp, Homo sapiens
ccagttatgtttttatgtaactctaaattttaacatttcctgactttgggatctaaaatggtatccttggtgttacagccccagaaattgtttacagtgcagttttcttcagcttattctgagattgaaagatatcccagaaatcaagatgagaagaaattaaagcccttatttttgctttggatccgtatgtggttaaatatatattcactcagagaatcaaggttcctttttcgagaacatcacaaggaagacctaaatttgcctgtgtggaagaagatgagtttctaaggcggcagtggacttttaaaatgcttttattgttcttatgcaaattacctaaagagaagattaatcctcaaagccattttttgaatgcatccttgccttacagagtgcttctcaaaataaattatataccttgaatctcctaaagattttgtacaagagagggtttgttttgttttgtttagtttgtggaaatgggttctcactatgttgcgtaggctcatcttgaactcctgggctcaagcaatccccctgccttggcctctggaagtgctgggattacaggtgtgtgagccagcacactgagcctgcaagagatgatttagttggtctggagtgagacctagagtctgcgtttctaacaaggtgacactgaagctgctggtccatgggccacattttgcatagtaaggacatagaatatcttgtgaccactgtgaactacttcagtttagtgtttgaactgtagctacctagatgctcagatacctttttctttttctctctcttttttttttttttttttggaggtggagtttcactcttgttgcccaggctggagtgcagttgtgtgatcttggctcactgcaacctcacctcccaggttcaagcgattctcctgcctcagtcttccgagtagctgggattacaggtgcccgccaccacgcccggctaattttttgtatttttagtagagacggagctttaccatgttggccaggctggtctcgaactcctgaactcaggtgatccacgtccctcagcc

SEQ ID NO: 19789 - DNA, 1045 bp, Homo sapiens
gaatttttataatttctaatcctcagaacaactcaagaagataattggtattggaccccattttacagaaaactgaaggtcatacagtaagttgcagagttgggatttgaacccagggcttctttaaaacttcaaagtttgtacactttatactgtcctatgattttccagtttgtttgttattgtcatcttgcagaatagaatacagtttcacctaactggtccttctcaaactgggaaatgcagtctctggagtacacagcagagtgcagggtgcatttgaagctgcagaataaatatggctcattgtcttgcagtgtcagtcttacttgatggtaaataatgtaaacagaatatacactggtgtgttaccacttagaatgtaaaattgcatgactttaagataaaaaatacagcttgcttgccctgggcctcttgatggtgtacatcccaggtccctgagtatatgagtttgggttaatgtgtcacatgaaagttggagaaggactacagaagtgtgttcattcatgaagaaaagagactgaataatgagtaagttcatgcacctttcttgcagcaagaggaacagattgttcatcttatccttatttatttatttaaagacagggtcactgcaaccttgagctcctgggctcaagtagtcctcccacctcagcctcccaaagtgttaggatttacaggcatgagccactatgcctggtcattttattttcatttaagtaaaaccacaaaaatctccgtttcccatctcttcaccagtgagctgtaataaagcagtagtactttgagggcagttaaatgatgtgcaggcattcttcttctgaaaatttcctatcaaaaccactcaaacaatacatttcctccctagaatgagttttgacccggctgggagatgtttgtttatttatttttttgagacaaggtctcgctttgtcacccaagctacagtacagtggtgtgatcatagctcactgcagcctcaaactcctgagctcaagtgatcctctaacctcagcctcccaag

SEQ ID NO: 19790 - DNA, 1117 bp, Homo sapiens
tataaaacttattataaaaacttttcatcagaacactcattaaactacttattggcttatagactatttgaaacactatttaaaaatttaaaagataccattcattctttttttcttctttgagatggagtttcattcttgtcacccaggctcgagtgcaatggtgcaatcttggctcactgcaacctccgcctcccaggttcaagcgattctccagccttagcctctgagtagctgggattacaggcacctgccaccacacccagctaatttttgtatttttagtagagacggggtttcaccaatgttagccacgctggtttcgaactcctgacctcaggtgatccacctgcctctgcctcccaaagtgctgggattacaggcgtgagctgccatgccctgcctattcattcttaaaatgtaaaatacattatgccttaaatatgggaattaaatacctagtagagatttgaacctggaagaatttttctactatactgacatcgactgtaaaagcttttgtgaatcagcttataaacattatacaaagtaaagttaagcttgctcctactgggagcctttcttgagtttatttatatcacgtaattatattccttaaaaagagaattgattctctctgtttaaatacagcagaaaccttaataagtgtctaaatgtgtttcctctaaatgagttttctctgactcttgatgtccttgtttctcatttcgtgtgttagttgtgcttagaaacattttcccagtgaacttcttcaaacttggactgctttttcaagtcagtgtctgcaaggagacagtggaattatgatttaacgtgttcatctccagggtaatgctcatggtctttatgtagatgctgcagggttcccacagctgcttggcctcctttttccagggccataaactcttttgagaacattgatagcatcattctttcaagttttcaggatgataaaagcacagtttaaagagccaactaattctacaattatttaagaaaaactggccgggcatggtggctcacgcctgtaatcccagcactttgggaggctgaggtgggcggatcacgaggtcaggagatcgagaccatcctggct

SEQ ID NO: 19791 - DNA, 1079 bp, Homo sapiens
ttgacctcccaaagcactgggattacaggtgcgagccaccacacccagctggatttttctgttttagatattcctgtacatgtccccactcactgccatcatctacatacttttcatgttcccattttttctgacagaactatcttaaaatttacttaaatcagtgttcaatgtttacatcaatttttttttttaagagataaaatcttgctcagtcacccgggctgaagtgcagtagtataatcatggctcattgcagcctcaaactcctaggctcaagcgatcctgctaccttaggagaatctcaagtagctgggactacaggtgtgtgtcaccacgcctagctaattttttatttttatgtagagatggggtctcactgtgttgcccaggctggtctgaaattcctgggctcaagtgatcctcctgcctcagcttcctaaagtgctggaattacaggtatgagcctccacaccctgcccagtgtttacattattatgactgcatatattctttgaagctgagccatatattaaagtgatttttcctcaataaaactttttgtagataattggagttaatacccatttatgttggtgtttttaactgtaattcaatcccaaattccattgagatcagacccttcaaagtatactattggtttccctttcttaaagtctcttctagactgatttacttgaatgcctggaacatagctgtcttcctgggacctcctttcatcttaaccctggagattcattcccttcatcagctctctcctactcaggatctcctgttatagtgtccttttcttggtttactccctcttttgatgaaacacattttccagtggtttcctgagaataggtatgtagactattccataggtttgagcctttacatgtttttaaatgtctgttttagtctgtcttcatactaggttaggaatcattttcctcctaatcagaagccgttctgattcttgatacttgctttagccctgtttttttctcagtgaaagcttgtactttgtccccagtgttttaaatttcagtgatgtgcctcattgtgactctgtc

SEQ ID NO: 19792 - DNA, 1032 bp, Homo sapiens
cactgcttgctttagtgtgtgtgtattgtggcttttatacttttttgactgcaacttacagtaagaaatgtattttacatagtgtatacacacacaatatgtaaaactgaacagtttcaggaaatattacttactcttcatgagatgcactgtgatatttttcattttatttttttaatgccagtttgaacccacttagttaattttaagaactaccggttggtcatgacccaccaagctagggatacttgaagctaaaggatacacaatagcacattttcctagagcatcagttttattgaaaggtaaagagagaaacacatattaaaacatatatgggtacattatgggatttagcatggaacttcaaagatattttgttcttatgatagtctacttcatattatacccctaatcttgacccagccccatgcctccttcacagtatgtgtccattctttcctcttctattacgggaaatacactagaaaaatgtgagaagtactgtgcttttgggacttgtttgttcgtttgtgagacaggatctcactctgttgcccaggctggagtacagtggtgcagtcatagttcactgtaaccttgaactcctggacccctatcctcctatcctcttatcctcgtgcttcagcctcctgagtaactgggaccaaaggctcatgccactgcagtcagctttttttgttttgttttgatagagacaaggtctcacttaggttgcccaagcttgtctcgaactcctggccttaagtgatcctccttccgcctttggtctcccatagtgctgggattacaggagtgagccactgtaccaagccccatagaacttttaagttcattattgtgtaaacccaagtgaggtcagaaactttgtatagtttattttacaactgttattcttactcagcacctattctgtgccagtcactattctagaaactgagaatattgtgacaaatagaagacaggaattctttccctcatggaatttatattctaccacaagtggggtat

SEQ ID NO: 19793 - DNA, 1050 bp, Homo sapiens
aagtctcttctaatctcttttttaacataatagtagtactacatctgagcatatgtaagatttcagataagtctaatgtggttatccttaattaggatgctgagtaaaaaaggtaaaacaggagatggtgaaagcagagtgaaattttttttttttatttgagatggagccttgctctgttgcccaggctggagtgcagtggtgcaatctcagctcactgcagcctctgcctcctgggttcaactgattctcccacttcagcctcctgagtagctgggactacaggtgcatgccaccacgcccagctaatttttgcatttttagtagagatggaattttgccttgttggccaggctggtctcaaactcctcacctcaggtaatccgcctgcctcagcttcccaaggctcacatggtggctcacgcctgctgggattacaggcgtgagccactgtgcccagccgaatttttcttttttgaacagacactttctacagtacttatgagtcaaggctgttcactgtgctgtgcaaatattaactcattatcctcataacaaccccatgaatttagtactttgtgatctacattttacagacaggaaactgtcagagtcagaatttgaaatcaggtgttctggctcccaagtccatgctgtgaacctctgtatctgccgcttctgatgtgtgggtatcctagctcctcagaaaattgttctacagtagaagtcccaggaaagccctcagggtgtcccaaaactcctgaaattctatggcaaaatgttgtgtgtacatttttcagcaagagagtcagtggctttcctctgtttgtccaaagggtctacagtgcagaacagtttagcaccacttacctagaggacctttttgtgtcctttccattgttaaaaggctcctgttggcataaggattcttttggaagaacaagatgtttacaaacccattcagacttcttagataacaatgttctaaattaattgcttatccggttgatcttcctgggaactttttcccaaatatttatgccaggtccc

SEQ ID NO: 19794 - DNA, 1052 bp, Homo sapiens
gcagctgaaaggaccatcaacaagttaagggctttggcccttcccttttcatttaataataatccctataactcttagaaaagcattagagcagctgttgctctgcagtcagtggctttgatgtttttagtatggattatttcctaatcttatagacccacatggaatggaggtagaagcacagcacaacttgatattgattaaattgaaatgctaaaacccacagcacttattaacataatctctttgtttagctactccagtgatagaagtttctctcccactgtgtcaaaagttttcttgaactgagtgcttggatacctttagagctaatgccaacctctgtgctaatcttccatctcctttttctcctaacagctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcc

SEQ ID NO: 19795 - DNA, 1033 bp, Homo sapiens
ctggctgcctgaaaccgctcttgcagctggcacgttgactaatgaatctgttaaggaaacttctctttagtgtacttggcctttctaggagtctcttcaccttgagctgtaccccccaatcccttgagaagttgccacaaacattcaggaagttcatctccctggagctgcccaggggccctactctacatcagcccattatgcatccagtctgaatctttttctgtttctcaaccctgagggcagagagaagcatacagaaggggcacatcaggtagcagtctaagggcagtggcagaggcaggagttgcattgatcccagcttgggccatggagagctcaccagcccaggtagtgctattaaggagcacctgctttgagccaacagtgctagacactcagggaggaagagggagtatatacaaatgaggatggcctggctgtggccttctcaggagctcacagcagaagtggggaactggagatggaacagctctaatgaaagtgtaatagaaggattgttagaacacaggagatgaagggagtagtcccctgcttgcaggaaggatgggaaatcaggaagcttcttggaggtggtggcactttagctgaaccttggaagatagaattttaacaggtccaacacccagctcagagctggactcttagaggtacttaataaatgtacttgttgaacaaaggcctcgatggatggatgagggcacgacatggagcaaggcagagctaaactccagatgtgcacaagacagtgcagtggccctgtagatcaaacaatgtgacctgctccatcctggcttgggaatggggaggctacagctcctccattctccctgggcctggtctcctggggatggtcgggtatggaaggcttcaggtgcagtggcaggtgagagcactgcccctctgatgggaggtgtttgggggctaggggagccctcatggctgctctgaccctggtactggctggggatattgcaggagtgggcagacacctgctgcaggggactccgga

SEQ ID NO: 19796 - DNA, 1032 bp, Homo sapiens
ggaatagagggccctgggaaggcctcagggctcggcggctagtaccagtgcagaaacatccctcctgccgcagctttgtggtaccacccgctgcccgctgattggctgccggggtcccgcagtccgcctcagcccgccgcgccgccctcagtacagctccggccgccgcgccgcctggctttcgtattcgttgttctcggcgggctgtggggcctccgcgccgcggccgttagtcatgtcgggtaggtgacttcttcagcgagcagcggcagcgacgagaaggtcctggcggggttgggctgtcttcccgcccaccggagggccctgaggagaagcctccggccctgagggaggcttggggtgggggggcggccgctgccgccgccatgttgaactggaggcacgcacgctcccaatggctccccggctgcaaatcacggcgggagcgcctcgggcctcttgtcttttgaccctgtccttggaacccgaggagacttgccgttcccgggggagggtgtgtgtgagtcggggggcggaggccgtctacgccatcgtaggggcggggggagccgagattagagcatcagcctgagagaagcggtgcttctggttctccgctccgcctcggatctttcagcgaggcctcgggccagtcatctcgccgcctcgtacctcagttttcccatcctcgaagtggagctgggcctgcctgactcacccattcatcaggtgggggccttgacgctctgggagccctttcaaaggacgttgccttacacgaaatcgtacttatcgttattcactctgcagtaaccacctggatttgagttgggggtgtttgcatagtaatttagcttcctcttcaccctcctgccattcgtcttccccaccagtttatctcctgaaagagtttgaaagtgagccttgtctatctattattgataagctcctgtaggtgtatgtggcatttaccttaaaacatgcagaccaaaggaaaggcaatcttttttccccccacgaagcagttaactt

SEQ ID NO: 19797 - DNA, 1047 bp, Homo sapiens
gagactctgtctcaaaaaaaaaaagtgtgtgtgtatatatatatgtatatatataaaacctaaatgacaattacaagaacttgacaagtccatagttatatgggaagttaaaaaaaatacctctttgtgtaattaatagatcaggcaaacagtaagaatatgaccaaacattagtaaaatatgagtgatacaactaatgagcataatgttatagactgatagaattcacttgaaatttagaaaatacataattattttcaggcacacagggaacatgtgccaagggggaaaagcaaaacaggaaatctgagcaaataccaagaataataaaataacttttctggctgcagtggaatattaggaaaaaacacaaagagaatcaaaactatacacttggaaattcaaaagcactttaaatttaaattcgtaggtccagacacaaagcacaattgtcaaataatcacaatgaacagttgtttaggatgccttaatctataaactgattttctctgatgaatgtaaaacacctgcactttatcactcaaggatttataccaagggacagatttactagtcagtacgcttatttctatatcatctgggagtttttaagctagccagctaaagaagttagatttataatttcagagggctgaaatgactgggttaagattaagggccttactgttagatttgagatagggttacaggacctatgtgctgtaccctactaaaattttgcctgaacctaaagaaaatatgctgcgattatgtattttgtcactgggagaacctacatccatgcttcaggatatagtttaacctaaagcttcatgcatccacaaataccttgttttactcattgttttccccctcataacccttttcatcctttgatttgggataatctgatttcctgtcatttcatagaggcatctaatctcttaatggtctaattagattgtgtattcttttccgatttttcttaattggttgttagctacaactctagctatcttctcatgggcctggcagtgatgtgtaatt

SEQ ID NO: 19798 - DNA, 1032 bp, Homo sapiens
gctacaagcaggtattgctgacttgctgtgccaattggctgaatccctgaaagcttggtaaaatcagaatagagcaactaacttagctgctttttttttttttttagcaagtctttggaaatatttttgttggtgctgacagccaaagcagtccaatacagaggaatggtgtatatcttggggtggtaaggatgttcaagtagatgtaatcctggggatgtcatagtgcatgtctttcccctttttggacctgattagttttaacagatgtctttttgtatataataatattgcttaaggtcttgagtctgtttaaagaatggattttcactgtttacatttgttcactgggttcttgtgaccctagcacacatgtagaatagtagtttgcaaatacgtagttattgtaaaaagtaaatactatttgtacaaatttcttgtttcatagtatttaacttgagttagtttttctttctgcagttctttacattttcttaccacatttcttctgtatgagctaaagtcagcctttgaaggaaccataattttaaataagatttaaaattctttttatgtgttctagattctggaagttacggtcagtctgggggtgagcagcaaaggtaaagtatacatacattttaataatatgaaagggtagaactgaggtgaattttgtcaagcttcttctcttgagacttgatgctggatgtcataagttaaatattagcttgtcacagagtgaagagagtcagtgtaaataggtgctgtaagacatttattccctttctgtttttctttatgttttgagacagagtcttgctgttttgctcaggctggagtgcagtggcaaatcatagtgtactacagccttaaattcctgggcttaagcgatcctcctgcctcagtctcccaagtaactgtaatctccactacagacatgtgccactctactgggcttcttccttttcttttttttttgagactgagtctcgctctttcgcccaggctggagtgcagtggcgcgatctc

SEQ ID NO: 19799 - DNA, 4268 bp, Homo sapiens
tgtagtcccagctaccctggaggctgagggaggagaatggtgtgaacccaggaggcggagcttgcagtgagctgagatcgcaccactgcactccaacctgggcaacagagcaagactccgtcgcaaaaaaaaaaaaaaaaatagttcttttgggggctgtttgaagaatatctggcattagttgggtttatattaaaagaagaaggggcatgggccaggtatggtggctcacgcctgtaattccagcactttggagggcacagcgggtggatcacctgagatcaggagttcgagatcagcctgaccaatagggtgaaaccccgtctctactaaaaatacaaaaaattagctggacacgatggtgggtgcctataatcccagctactcgggaggctgagacaggagaatcagttgacctgggagttggtggttgcagtgagctgagatcacaccattgcattccagcctgggcaacaagagtgaaactccatcgcaaaaaaaaaaaagaaggggcataatttgtggatgaggattggatataaggtaaaggatgggacattcttggacttacagatggtgtgattgcctggctagaagaagaattcccggtcaaaaagaaaccatcagctttccaagtgtgaaagagagataaatctgtgaagattatagggactacaggaaacttaatctttttctttgaaaaagcaattgtagcaaaaaaaaagaaaatttcttactgtcatctaaaattgacatggacatcttagtggactagaagttaagggcataaattctcccagtgatttttaattttagcattgtgattaacaccttctaaaattgccagaacttaataaataattgcttttcattattagtatgccatcaaatttagtagctgtttcaggctttaatgtgtcaagcctaaaatccagatttttgaggatcttctccctcttaaaagagtattcagttaactgccgtagaaatacacatgtatacaagggcactgtatacatcagtctaaaaaataaaaatatgtatacgttctggtgagtctagcacagcattgcccaatagaaatacaatggaggtcacaaatgtgacccatatagttaattgtaaattttctaatagccacattaaaaagaaaacagcacaaataaacaaatgagaaaatctatttaactcaatatattcaaaatatttcatcatgcaatcaatataaaaaatttctttttgttggtcatgatggcctgcgcctgtaatcctagctacttgtgaggctgaggcaagaggattgcttgaggctaggagtttgtgactagatgggcaatatagtaagatgtcatcttttaaaaatgaaaaaattagctggccactgtggcacacgcctgtagtcccagctacttgggaagctgaggtaggaggattgcttgagcccaggagttcaaggctgcagtgagctatgattgtgcttatgaatagccactgcactccagtctgggcaatagtgagtcggtcaaattccatttccccctccgccccatacctcttcaaatgtttaaaaaaaaaaaaaaaaaagtactgtacattccttttttcatattaaaatttagaaatccattttgtattttgcatttagagcacatcttaatttagactggctacatttccagtgctcaacaggccacatgtaggtagtggatactgtattggacagtgcagctctagaatgatagattcttggcctcctgagatgttgataaatgctgaatccagaaagcctttttaccatgcatgtaagacataggaggaaataaaatgtaaatacagctgttatggagaatagtacttaaatccattgagtcacttaaatgtggaattaatgttggtcttttcctcacactcagaaaattgtattctggatttagtagtctgaaaacccaagcacagcatgggtttttaagctaacctttctccatttttagccaagtcctttctctctagttagtgaaattttctaagaatagagattcctgcattgtccttttacttcttggcagttttagtccataaatagatatagttaggtttttattttatttttattatttttttttttattaaaagatttggaggctgggcgtggtagtcatgcctgtgatcccagcactttgggaggccgagacgggtggatcacgaggtcgggagatcgagaccatcctggctaacatggtgaaactccatctctactaaaaatacaaaaaattagccgggcgtggtggcgggcacttgtagtcccagctactcgggaggctgaggcaggagaatggcgtgaacccaggaggcggaggttgcagtgagccgagatcgtgccactgtactctggcctgggagacagagcgagactccatctcaaaaaaaaaaaaaaaaaaaaaaaaagagagagagagacctggagtagagattctgtcaaagaactttttctttcttgagaagcatctgaaatggaatctgttgtctcttcgaaatatgtactgctgtaacagtgaaacaaccctcagagtatgccttcgtgtgggctgctcgttgtggttttgaacttgggggaactgtctgtgtttgggtcaagaatatgcaactggctgggcacattggctcacgcctgtaatcccagcaatttgggaggctgaggcaggtggatcacctgaggtcagggcttcaagaccagactggccaacatggtgaaaccccgtctctactgaaaatacaaaaattagctgggcatggtggcaggtgcctgtaatcccagctactcgggaggctgacgtgagagaatcgcttgaacccgggagttggaggttgcagtgagccgagattgcaccattgcactccagcttgggcaacaagagtgaaactcttgtctcagaaaaaaaaaaaaaagtatgcaactagctgggggctgtgacgcgtacctgtagtcccagctacttaggaggctgaggtgggaggatcactgatgctcaggagttcgtgaccagactaggcaaaatagcaagacaccatctcaaaaaacaaacaaaaaaaccagctagttttcttatgcagggggtactctgccaataaagttgagtatgcttatattgtgtttctgttaaatatctctgctacttcaggaattctttatgtgtaaatgttttctgctttttctgggaattaaagcaaatttgttgtgtcaacatcttgactcagatgttcaagtacctttgtgtcttgatttgccttagcatgtagaaaagggacttgtaacattaatgcagatttgaaagaaagattgttaacctcaggcacatcttctgttaatatctaatagtactacttgaaggttattttctgtatttaataaattccttaaaaaggataattttctaataagaagagagaaaatgattgaaacgtttgaacttgaaagaaggctttgcataaaattacagatcatctagatcaatgcctaaaccaaatgtctagacattttagacttaaatgtgcatatgaattacttgggggatcttattaaatgcaggttcttattcagtaggtctagggtggggcctgagatcctgcttttctcagaaccttccaggctatgcttacgcttatattccatcatgttttgattagtaaggggacagacccttattttgttaaggagattgaagcttatggagaaccactgacatgtccagattttcaagattgattagttatagttaagactgtaccctgagtttcttgaagactagttctttttccagtgtactatggtatttccaaatttatggccatgtgttgaaatcttcagctgctttattttcaaaggaaatgcacagtaaagatgacgttcaaggccgggcgcagtgactcatgcctgtaatcccagtgctttgggaggccgagacgggcggatcatgaagtcaggagattgagaccatcctggctaacacggtgaaaccccgtctctactaaaaatacaaaaacaaaaattagccgggcatggtggcgggcgcctgtagtcccagctactcgggaggctgaggcaggagaatggcgggaacccaggaggcggagcttgcagtgagccgagatcgcgccactgcactccagcctgggcgacagagcaagactccgtcgcaaaaaaaaaaaaaaagatgatgttcaaatgtattatatggaggaataggaaatcataaacctatttaaatgtc

SEQ ID NO: 19800 - DNA, 1197 bp, Homo sapiens
ctagctatgtatgaaattgcatgttttccatccattgtggccaggtttggtattcccttaagatggcaacaaagtaagaggcatttcttctagcacttattcgtgaacccagtgacctccaatttcccattttaaaagtcatctttatcctcggaactttaacctactggcataagaacgtgggcttaagttcttttttatcactttttggagttaaaaaacctctgagaggccgggcgtggtggctcacacctgtaatcccagcactttgggagcctgaggcgggcagatcacgaggtcaggagatcgagaccatcctggccaacacagtgaaaccccgtctctactaaaaatacaaaaaattagccgggcgtggtggcgcctgcagtcccagctactcgggaggctgaggcaggagaatggcatgaacccgggaggcggagcttgcggtgagccaagattgcgccactgcacttcagcctgggcaacagagcaagactccgtctgggaaaaaacaaacaaaaaaaaacctctgagataccttggtttctattaataatattttcagcagtttaatctcaactctgttggcttccctttcttaaagagttaggcagtgatatacatgtcatttagaagtaaagggagggctttagtactgcctgttctgaagtaggagtcttagaaattcagtggcaaactgtataggaagggcctgagtttcatattgtctatattgccttgaaatagccttagtctcctgcttaaaaaggcatcctggaaatcatataaaaagtaacaacaaattaaaatgcatgtgtctgtacctaaggcagctgtaagtggaaatatttttacctcatagtgaaatagaatggatgtattaagaagggagaattttttttcagagtgttttatctcagtgtggctcagaaaagccatttatagggtagggtaatcactagagttgagggttcctccccccaccccccataagattggtatccataaagcagagatttctaagcagtgagagacttcagtattttagattagattcttgggttataatagaataagatcattagtagtagaacatctggtatcagaaaacttgagtgtttttattgccatgttagcatatgaatcttaaaggattacagaattcagttaagagaaacaagcttttattggatg

SEQ ID NO: 19801 - DNA, 1121 bp, Homo sapiens
aaaacacttagatggaaacaacatttagaactctgtgaaatggaatttactgaaaacttagaggtgctactgttttcctaagcactctacttgtgacagttaagtgtagattgagcccagggctcagcacattagagacttaaggaagaaatcatttcttcaatttttcctctgcagtggtggtgaccgcggtggcttcaaaaattttggtggtaagtgctgagtatcccaaaatgtttcagtggaaatgctatataaatctaaaagccaccaatatcccgcagatgtagtcaaaagtcctttcttactctgttgaggctggtgtgtgttgtgtgctttaaaaaaaattttatatatatatatatacacatatatatatcaaagtaaacattaaaaagccaaagttgatctcaaaacagtccaatgggttttctacacagtgaatttgcatgaaagagtctgtggtgaccaatgaatgacaccttcactggattttgacaatttgttcttataaaggtagctgacatggtgtttttaaattattagggttgtccaatcagcctttacaaccagagcttaacaaaagtgatactagcataatgctaaagtggcaggtgctgtctaggacaagttaaaggaaatgttgacattcatcttgatttcctaaactttaaataaaacataatttatatatttactttgtaaatctgtgatggttgactttcaaggattttggaagtattgacttttcatgccttggtttattactattttttttgttaatgattttaaataaattgccttaaatagctcttttttcttttcttttcccttaggtcacagggattatggacccagaacagatgctggtaaggtttatggtggtttgtcactttgccattaagaaaatgttagttttttttttgatgggaaaagtgtgtgtttggaggggcttagtacaggaggaagatttaatttgatagtgctgccagaactggggagctttatttcttttttttttttttttttttttgagatggagtttcgctcttgttgcccaggctggagtgcagtggcacagtcttggctcactgcagcccccacctgccgggttcaagcag

SEQ ID NO: 19802 - DNA, 1031 bp, Homo sapiens
tttttatttaaatgaaattcaaggctacagatttacctgtggagcctgttgaaagttataatttagaggttaaaaatctatttgagctaaaaatttgaaatcagaacttttgtttttattaagatgccaaagtattctatgtggatggcaatttctgaattatcccttcatggactgaattcttatacatctttctttctttgttgtactaatccaaaagtgtgcatgtcaggtaacatgtacaaggtgcctccgcactctggtatatacaaagcttattgcaatgaatgggaaaccagcagttctgctttgtggcttgcttggaagttcaaagtatcagatttggagaattttgtactagagaatcttaaaaatgtttaaccgtaaagaattagagttctccagagaaagaaatgctaaactaactccatctcttcatgacgtttagccctatgtctgaatctgaagagtgaggtttgtaagatcatccttaattggtatataggtatttcacatagtgtggacttgatccactttacttgaaatttagttgtaagaattgatcaaccaaataattactgtgaatactttgcatgtttatataaggttgttcttatattggtcctttccttttggtcatagaaacaattgaatattggacaataaattattgtctttgattactgaacagaatgtcataaccaaggaatatgtaaaattaaccatcactttttttctcttagattcagaatctgataattcagataacaacacaatctttgtgcaaggacttggggagggtgtgtctacagatcaagttggggagttctttaaacaaataggaattatcaaggtgagtaaaaatattatatgttgaaaatctcataattaatgttctgattacaatacatagactatgtagtaagcctacatacttcagtacgccttgtctcttaaaattttgtgatgcacatgctcgtttatgtctgtagacgtttgctaaatttgttgaatatatgaagattttattc

SEQ ID NO: 19803 - DNA, 1736 bp, Homo sapiens
cttgttttttgtttttgttttttttttaagcttagtaagaagtgactgtctcccagtgacagatatgctcttttcagtagataatgtcacttttagcactgttatcttgactctttgcatttgaatttctgtgaggacatgtcagttactcctctgaaactaaagatttccaagactttttcatttttgttgacaggtggaggtatagagtagcattgcttcaaagctgatttcttttttcttaggaaaagaattccatggcaacatcattaaagtgtcctttgccactagaagacctgaattcatgagaggaggtggaagtggaggtgggcggcgaggtaagatccttgctgcgtacagtcctggatactatccaagggtttaagtttgagttcatactctgtttctatttgtgtgaacttgctactgctttttctctcgctaggtctttttccctctatcttaaaatgagttcaggtactgaatatattaggtaaatgagatatcgtaatagctaagaaagtagtgggaaatggttgtagaaatccctttggaaagctttattgtgatttgctgttcacttggaaatcaggaggcaattttttttttttggtttttgtgtttcttttgagatggtgtctcactctgttgctcaggctggagtggagtggcgtgatctcggctcaccacaacctccgcctcccgggttcaagtgattctcctgcctcagcctcccaactagctgggactacaggcgtgcgccaccatgtccagctaatttttgtatttttaatagagatgatttcactatgttggccaggctggtctcaaactcctgacctcatgatccagccaccttggccttccaaagtgctgggattgcaggcatgagccaccgtgcttggcgaggcaattgttttaatgatacctaattaggtaattaatctgaccagtttttaagctgcctgatacagttactgccagctttttttttattttttatttatttatttatttttgagacagagtttcgctcttgttgcccaggctggagtacaatggcgcgttcttggctcaccgcaacctctccctcccgggttcaagtgattcgcctgcctcagcgtcccaagtagctgggattacaggcatgcgccaccatgcccagttaattttgtatttttagtagagatggggtttctcccatgttggtcaggctggtctcgaactcccgacctgagatgatctgcttgccttggcctcccaaagtgcttggattacaggtgtgagccactgcacccagcccagcttctttatttctattggattcatattcttgtcttttttctttttctgttttgtgggtggatgttactgtggcctttgcattcatattcttacatttggagtttttgtcttctcacctaatcttcttcatggagattctcaaactaagtagggtataggttaggcatcctaagtttgaaaatctgaaattggaaatgctctggaatccaaaactttgagcaccgacataatgctcaaaggaaatggtcatggtcattgaagcatttcaggttttgggtttttggatttgggctgctcaactcgcaagtataaggcaaatatttcaaaatctgaaaaatccaaaatcagagacacttttggtcccaagtatttgggggaagggatactcaacctgtattacagaaaatggactttgaagttttctagtgcat

SEQ ID NO: 19804 - DNA, 1330 bp, Homo sapiens
ctttagttctagtccttctgtcattcctatgaagtaggtatacttcccattttacagagtcagtcatttagtgtaacttttccaaggtcacatagtaagtggcagatccagaattcatacatgtaagtgcttgctcattccactatgccactctcctatttagagtgctggaactgggacagtttctgatcttctgaaatatttgtggtttggagttttaagtggaaaatttttaagagagtgaagcaaagcttcttctaggaactttgtgaatcttaaagctggtaaattagacatttaagtatcttctaggagtacagaaataaatgaggcatggtgtcattctttagaaattgtctagctgatgccaatcactagtaccctgaagaagtgtctaatgctcccccttcgtagaaaattagaatttagtccggctctttatttttcattcctagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggacttttgtacatactagtgcattgttctgtcacactcaggactcagttacattagactctaatcctaaagaattaggaaatgaattatatacttcagtaaattaaaatgttactttaaacaatatttattgagctcctactgtgtttagtggttcccaggaatgacaagtcagaatcacctgaagtttgttaaaattagattcctaggttgttaaatttagattcctagattcccagccctctaggtctgctggatcagagctcaatgaggtatggggagttagggctggaaatacttatttagctcaagtttaccaggtgattttgatatagttatttagtatcacttgacaacgatttatttaggggagtgttttagatgctgggaatatgaagttccaaggaaaagaaaggatttacaagccagggttaagatggcaacatatgtatgttatttgctgtttattagagaactatttattctactcttaactatgggtaaggcactggatcagattctagatatgttgctgaccaagtaaacaga

SEQ ID NO: 19805 - DNA, 1056 bp, Homo sapiens
aagatagatgagaaggtttgagggagagagtggagggtgtgaatgctttttgtttgccatcagaagaagcatccagagatcccattagaaaggtttgggttagaggagagaaaagagagggacttacattttgaatagtgtctaaggatcagtcccagtaactgagaccagtgggtgtctttggactatgagagaagccagcgactgcttggataaagtagacttctaagagtgtttgatctaggtagctttggtactgggagggctctcgtacattggtggtgtaccagatggtgactgctctgtgaaaacctttatgcccctcactgccatcttgtcttctggtggggactggtgaaattaggattgaggtgctactaggcagatatttgtatctggttgaataataagacgtcctctggaaatacctaaaaatatggaggtggagtggttggggatctgtgggcaggattttgcagaagttgagtttgaattatgtagttagtaaggtcatgttttgtactcacaggcttttgaggcacagggaaatttgggttatgttgctcatggacccaaagcagtggagtgggcaaaagaggaacatctttcctatcattggactttggcatcacaatattagaggggtccccaggcagtgctgcatacactcaaaatagtgaaaccacccttggtttttacttacagctcgctcacaggcaaaacatgaatctagaagtgatggggtaggttgggagataattctgagtgacacactatacaggtttagtatcccttatccaaaatgcttggaaccaaaaatgttttggatttcagatttttttttcagagtttggagtatttacattatacttacaggttgaatatctctaatccccaaatccaaaatgctgcaatgagcattttctttgagtgtcatgttggtattgaaaaagtttctagttggagcattttggattttgggattaggaacgctcagcctgcactgaattcagaataactgttgggattactgtagaacctggggtgcggggaagt

SEQ ID NO: 19806 - DNA, 1081 bp, Homo sapiens
tctcagattttatagtcagcttgctcattgggagatggaacattttgatgtgggtttgatgtacctctttgatgtacctgtgtgagaaattgcataggcagctttggtccctttgtaccttccctcctcaggttgcaacctcacttctgccacagggctacagcccagctcagatatgggaccagaggaagacagatgaggactcagtgatatccaccagagccgagccgagccgagccggccgagccagatggagctgagccaagccgagccgccctaagctcctctctgggacctgtaggctgacttgccttactccctggcccaccccttccttgcccttcctcactttcctagaagatgtggagggtgagaagaatatggaggccagcaaaacacacctacagtcatctctcattttcctcaacatcttctcagcctccctttcctctcgctgatcatacaggtcgtgccagtgcgtgtagatctcaggtttcttgaagtagcagtacgggactgagtttggcttgctcggatgctgcctccagcactctggacttgggggaaactcttcctttggcatctgggggttgcaagtggcagaacagtcagaggggtcccctaggcccttacttgtgagggtatggggaggagggggtaaagggagggaagggcagggtgaaacagatgccctctagcctctcatctgagctggagtcacagctaccacctaaccccttgcataacttgggcaagttacttcatcctatcaaagtctcagtcttcttatctgtaaaacaaagctaataatccttgttctgtgtccctaccaaggttgttgtaaagatcaaaagagagatccagattgtgaagccactggtgatctgtaaatcgatttgaatacatagtttggttagttgaggatctcaaagcactttgaaaatgacacttgagtagggaaatgaaaaggcaaggtgtggggaggatgtgggataaaggtggggaaaagacagactattgctcattcagatatttatttgagtaccaactatgtgccagatactgtgctgggtgctagggt

SEQ ID NO: 19807 - DNA, 1027 bp, Homo sapiens
ttaagccaggtatgctaattacacaagaatgctgcttttcacaaatccattcctttgctcttgttttcacaggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgttgattatttttcccctaaataagtcctggattattgccctcggcattactgtattataccagctagcccttgactttacctcactgaagaggttaatattatatggcactgatggtagtggcacacgggttggtctattaaatgccaaccgcgaaggaataatctctaccctggggtatgtggcaataca

SEQ ID NO: 19808 - DNA, 1032 bp, Homo sapiens
atgattgtattgctaggccctttcttcaaaacgggctttcttcgcattatttagtttacaggtggacttttttttttttaaaggaagccaaattattgaatgtgtaagagtactataaaaagctgattgctcatcttgagtgtcaagacccagttccgggtactttattctttagatttggtagtgtagcattatcgaccctctgccctatgttgctgtactgtttcctttaaaaggaaatggctgaaatttgaattgaatctgaacaggaaatgagtgcagttgcttgccacttaagaaatgaaattaaccttttccgaatatcttttgaaatctgcgttttgatgatgctgaagctttggattatacatttgcttatttcgataaggtgcacctaagtctcttcatctcatcagtattcttttgctatcaaaggcagttgatcagttttgttcctcaatatttttttttgcaaatatctaccgaagttttttcaaattttatgtaaaatgcaagtcattgtagagatgccagtctatgcctttatgcttgccagtctcaattaagacttgattgagctgcagtactttaaaaaggattagaagagctattgaatgacttaatttattagaagtttttaagtgacagcatttctaattattcaagtgcatttatttttcatgaaaaaaggtagaatgatttgttctgacataaagtaaatagtgttgatgcattagaaattgtgtgtcttgattatgatttctgtactttttgcattagaagtataatggacttgtatttttaaatagttgaaactagcactgtgatcatattaaataatgcatttctcagtttggacttcagatagggattcatttgttgatattttctttcttctctcccctgctaacataaacacttttctgaagcatatagttatgatatcagcctttaaggtttattgtcccacaatggctgtggagttaaaaaaaaaaattcagtgagtttggatataagattattatttaatga

SEQ ID NO: 19809 - DNA, 1031 bp, Homo sapiens
gtggtggcaggtgcttgtaatcttagctacttgggaggctgaggcaggagaatcgcttgaatccaggaggcagaggttgcattgagccaagatcgcaccattgcactccagcctgggcgacaagagtgagactttgtctcgaaataaataaataaataaataaaataaattttattagtaaaattgtcaaacatagaaaagtaaaaaatacaatgattgaacctcccatgcacttttaccaagatttagtagtaatcaagagttgccacacttgcttcatttatccacctttttctttgtattttaaagcaagtcccaggcttcgtgttactctattgcatccttccacatgcatctctaaatatatggacattttttttcacacattgccatcataacacctaacaaaattaagtgtaacaatcgaatacccagttcatacttagattttacctgtttctggttttttttttttttttgaatgttggtttgtatgaatcaggatccaaacaagaaccacacattatgttcttgtagcctgaagaaaagaagttttcttaaggatagttgttattttgctgcttgatttgtcagtatcttttttttttctttctttcaaattctttttttttttttgagatggaatttcccctgtcacccgggctagagtgcagtggcgcgatctcggctcactgcaacctctgccgcctgggttcaagtgattctcctgcctcagcctcccaagtagctgggattacaggcacctgctaccatgcccggctaatttttgtatttttagtagacacagggtttcaccaggttggccaggctggtctcgaactcctgacctcaggtgatcaacccgccttggcctcccaaagtgttgggattaacaggcgtgagccacggcgcctggcccaatttgtcagtatcttttaaaaattttttattttttattttttcatcagctcattcttccttctcagatttgtcagtagcttcagagaatttctgactctaaatgcagagta

SEQ ID NO: 19810 - DNA, 1035 bp, Homo sapiens
ctgagacagggtctcactctgtcacccggactggagtgcagtggcacaatcatggctcactgcagcgttcatctcccaggctcatgtcatcttcccacctcagcttcccaagtggctggaactacaggcttaccccaccaggcccagctaattttttgtatttattgtagagatggcgttttaccatgttgttcaggctggtctccagcttgtgggctcaagcaattctcccacctcagcctcccaaaatgctacaattacaggcatgaaccaccgtgcctggcctcttgtattcttaaattatctctaaattataatacctaatgcaatgtaaaagctatgtaaggctgggcatggtggctcacgcctgtaatcccagctacttgggaggctgaggcatgagaatttcttgaacccaggaggcaaaggttgcagtgagccaagatcgctccactgcagtccagcctgggcgacagagtgaaactctctcaaaataaataaaaactgtttaaatagttgttatactgtattgtttagaaaataaggacaagaaaaaagtctgtacatgttcagtacagatgcaggttgattttttcccccccaaatattttcgattcttggttgaatttatggatgcagcacccacagatatggagggttaactgtatggctttttgctagatttgggcatttttactatgcttttccagatgtgagctcctgcagtttttatatcagcttttttcctactgtagtctgtataagccagaattttaatgtcatgtctatgttttattaagacaatgttgagtagttatctctttacctgactttaatgtattattagatcaaagtcaaaatatagaaagccacctctgtgcatgacctagagcagttctcaagtttttggtcttaggatccctttacattcttaaaaattaaggtactcaatgagcttttgtttatgtgggttatacttaccaatatttactgtattagaaattaaatgataaattttaagctactccttcaaaa

SEQ ID NO: 19811 - DNA, 1021 bp, Homo sapiens
gtccccggcctcctgggacctcgaggaacacaggacgcagccggtagtacggccagctcagctcgccgctcctctagccttgagggaggcgctgtgggggacagcctggcagccacgcatgcgcaaaacaccgtcaggaaggggccggggaggggcgggctcccgaacccggaagcgagggacccacgtgggagcctgggagcgggtggtcgtagctcggtagtccagttgtgggtaatcggggctgtttgttcctgtccgagagagctcggcggagacggctgtcgagtacccttcacctcggtgttgggagcctgggagcgaactgcggcgcgggttaccgctcccggggacgcagcaaggggcatcgagtccctggcgggagctgcgccatggcattgctctcgaccgtccggggcgcgacctggggtcgcctcgtcacccgtcatttctcccatgcagcgcggcatggggagcggcctggtggggaggagctaagccgcttgctgctggatgacctggtgccgacctctcggctggagcttctgtttggcatgaccccgtgtctcctggctctgcaggccgcccgccgctctgtggcccggctcctgctccaggcgggtaaagctgggctgcaggggaagcgggccgagctgctccggatggccgaggcgcgggacattccagttctgcggcccagacggcagaaactggacacaatgtgccgctaccaggtccaccagggtgtctgcatggaggtgagcccgctgcggccccggccttggagagaggccggggaggcgagcccaggcgacgacccccagcagttgtggctcgtcctcgatgggatccaggatccccggaattttggggctgtgctgcgttccgcacacttcctcggagtggataaggtcatcaccagccggagaaacaggcacggacgtccctcattctctatgtgccccaacttggagacgcagccgagttcctaagcaccttggcccttgggtgatcccttagc

SEQ ID NO: 19812 - DNA, 1069 bp, Homo sapiens
tcccccaactgtcatattattctgcagccatatattctgagggccagatgaggccctggctctgacaatctgggggcacttgtggggacaatggggccagtgctcctgggaagactgagaatgtgcagctctcgaccctctttgtctgctgcgcccaagcaccccaccttcaactcctttaggcctggactgtcggtcttgttgccggctccgggctgcaggcgatagcggcggaatccgtgttatctcatcacattgggcagtgtgttaagaggcaggagaccctatttgagtcttggctctgctttcccaaggctgtgtaaccttgggcaagtcgctcaacctccctgagccacaactgtcccatctgtggaatgggggtaatgatagaatcttccccataggtgggtgtgaggttgaatgagataatgtggcatggtgcttagcagagtgcctggcacactgtatgccctcgataaccaaattgagaagattggatagagcgagatttcaagaaaagcgtctgatgctgtagtggaaagagcaggatctgtagtcaagagcccgggtttattttcctgcagccttagttatgagccatgaggctttcccatctatggcctgaactttcctcctctgtcaattggagattctgagttaaaactcacctcaaagggtttttgtgagcatcaaatgatacagccagggctcagggtccctagcgcacaattggtgttcagaaaatgttagttcttctctccttcttctcccacagggtgggcggggcagaaaaacgtcccaggggcttggagaatgtttgggaggaatggggccagggaaggtgcccagggatttgcagctcaatgggagaaggtatgggttggtcctaggaccctaagcccggatgagtggggacatgacattgtgtgtgttggggaggtcacaggaaatgagggtgtcagcacacccatggctgatggctaaggagcctgggagggaaattgaaggagaaaaggtcagctcaggtggtccccctacctacctctcccccagctcctcatcactggtt

SEQ ID NO: 19813 - DNA, 1044 bp, Homo sapiens
gatggtgggtgggggtggacatactggtggccccagttggcttcctgtcacaccagggcatcccctcccatatgaagtcaccgtgagatctctctatcccagctaggttagttgctcttaattaaaccaattgttggacttaatacccatcccattaacatgtctcccagatctattaattatgaccagtggaggaagggcacgggagctttgggtggggatgcaggggtttgaaaaccaagccaatctgcctcacagagaagagaaggggcaagttcattcctggatatgagggcaatctggctgcaacatttgtcaccccgttgatcaccaggattgatttgggtgatctggctggctaggcgggtgtccccgtcctccctcactgctccatgtgtgtccctgctgaagctgcacacttggagaggatgaccttccctgatagaggaggactgttctttggtcaagggtataccaggagctcgactcgcctgctggaacctccgaacaacctctcaggttcactccttgtttcctcctgggagtcttggaaacattcattacagcctcagaattcctggaagcctgctgtgtctgcatcccatggggtctaactgaggccctctggccaccatgacccttgggacccctttcccatttagctttctcagagccactggggcagggacaggggaggtggaggtgactgtcattggtgcaaggtaggggccaagaactcatccgtggggtcagaacggaggctgagtgggaatgaggattacagatggagagctggagttaccccagctccacccacacacacctgtgttcagaatgttccctctgcagctctttgggaccaggtagggctccctaaatccctctgtactctgatcaggccttcctggatggtgggtggacttagaggcagatgctggacctacgcagggatgctcagactattagtaggccctccccttgtgccttctccttcctccttccctcccaactgggccctccccgctgcccccagtgtcaggggcc

SEQ ID NO: 19814 - DNA, 1033 bp, Homo sapiens
ggccctcttttatttattcacaccagcatagtacttggcttattctagatgttcaataaatgtttattattacacacaggtgcttcctaaatctcacttctatggtgggaaatttttgaaatactgacttttttcttccttcgtaacatcccttccttttacccctcggtatcgttgcctcaaaggacctcagaggatgaggcctgtgcccaggcagacccctgagagccaagagggtgtggctgagaggtggcatctagatagcttcatggagaatccagtgcctcagcaggaggagcagaccccctaacgtgccttccatcatgacctggaaggacacagaactgaaattgccacttggacaagaaagaagatcctcttagaaggcacctgggtgaacagatcacatggacgatcacgtgatactctccccacccagcctccagcactacagaagccctcccagacttagacggaagtctagggaaaggacgagaactccgaggaaattcaaaaatcactgagactgaattttttttccactgccagtggcacaaggactcagcatggaaattaaattgcattaaagaaaaaatgttttatcataagagtctccggactgagacttttactacactgcccctatctgggcatttgctcggctggagaaacacatttcagggtggcactggcctctgagcatgcggaaggaagtgtggaattctaagccacctactgagggcagggaggtactgggagttcggaacccagaaaagcagacaaacatcctgaggccaaagttacggagactgataggtgttctccccaccgggaaggtctccccttctgtgtgtggaggtggcaaggagggccctcttgttggcaaacttagagcttcctcccaaggtattttggacccattacgctctcaaacaggaacctaattaaatatatatatttatatatatttataaatatacatatacatatatatttttttaagggatggggtctctctatgttgcccaggcta

SEQ ID NO: 19815 - DNA, 1044 bp, Homo sapiens
ttacctatatttatgctatttatcctgtgaggcagacattactctttttatacccatttttacagttgaaaactgaggttcagagagggaaagcaacttgtccaaagttacacaactggaaagtgacagagccaggactccgatactagtcttctcgctccaggtggaggtttcttcatgtaaacccctctttgaaaataactctttggcaatgcacttaaaaagagccataaaaatggctcatcaaagctgtcccgctcagtgagaagaatagtatcaagtgtcctctcaagaaggagctattatgaacacagaaactgaggaccagaaagtcaagctaggtggacggttgagctgaactaaaactgaattgggtgttttgtggaactagactcttgtcctttgctgagcacagaaggggcccatccagctaccccagagggcaccagagcttggtgctgggagctcaaagccaatgcagccactggtccattctaacccagctctgcagcctctattcacatagtccctcagactgtgaaatgaatgaatgaatgaatgaatgaacaaaaatgttctgcttctcacctccacctttttccccaccacccgcctacttggtgtgagagccctgttctccactcccaaaggtcaacccccaacatctctcctctactatctgcagggaatctactcaacctcttcagtctgacttctcaaccagtaccttatccccctcctcctgccaccttcttagctgcccccaagcctggccctgggaggagcgaaggttacctgggaactagcattcccaatgctgcccccgcccccccgccccacaatacacactcagttactgactctcccacttcttctcccaattttctcatcctgctgctaagctgtccttttaactggcatcctatatggctttttttttttcttttgagatggagtcttgctctgtcacccaggctggagtacaatggtgcgatctcggctcactgcagcctccacctcccgagttcaagtgattctcctgcc

SEQ ID NO: 19816 - DNA, 1044 bp, Homo sapiens
cgggggatgcagaatggtttacagagggaccgcgaggcgctgattggtcgcaggccgcagtgacgtcggcgggcgctgcattaaggcgagggggcttccagagctcagccaacagccaggagcagtgaccaagccgccggagctggggagagacgcaccggggcggcgactgggccaggagaccagggactgagggacgcgcccggggagggccagcaacaagccgcggcccgggcgcgacagcggcggtccgcgccgagccgttccagccgccggcctactgtagccgctgcgccaggacatttttttttaaagctctccaagctgcccccctcctccccgactcctcccgctgcaaaagaaaaacaaaaaaaaaaaaggaaggaggctagaaaggaaacccagatttgccaccacaacgaaaaaaagaaggggaaaaggaaaaggagagaaagtcgagcgactgtggggttagacggaggcagacagagcgtgggccgagcgatgcggggctgtgcgcccaggcggccgcgagttgtgactggagccacgatgcacggccaggcgcggtgagaagccagcccgtagtgcctcccgaaggagcccgggcgcagggagggtcgccctgaggacacggaggccgccaggcaggccaagggccgaggtgactgggctggggcggtagggaaggagcgagtgcgcctggctgcctccgcacggagttgtccctctctgttttcgattgacacaaacacttctccaaaagcggggaaacctaagcaacaacagcaatcaacaccaagatcttcctcctaccctcccctctttcccttctcccgcggtcggccctcgccccctcccccaggcccagcgcgggcgctcggcgcgtccagacccgcggcgcgatgccggcagtttaggatccaaagcttctctgctccttttgttctttccttcccttttttaaaaaaagaggggggaaatcccagtggtgggcagcctggcacgcacacagtcgccctcataccccgacaaaagcagatg

SEQ ID NO: 19817 - DNA, 1053 bp, Homo sapiens
ggagtgaaatttgggtatgggagcctacctggaggcagctgggcctgtgggcggaaaggaggtgagactgctgaagctccaggccagggggagtctctggctcagtgctaggtgtccggttcaccgggcctgatgccctgcgtggctgtgggtggatgtacctgcctgggaggctggctgtgcatgtgcacatgtgtgcaacacggaaggccctgaggcctacaggagactgtgagaacctgtgtacatgaatgagaagtcgtgtgtctgtgtcactattggcaagaggctgtggataagtatgtttggcactgtgagattgtacatgggtgtgaaaaggagattgtaggttttggtatcataggctgtttctgtgtctctgtcatggttggggggagggttgctgcaagagaccgtgaaatggaaacgcggtgtgtgtctgacattattttggagaggcgtagtctctatgtgtgtacagccccagagaagcggtaactgtgatagtgtgactgttagaaaaactccagctataccacaactctccccctccagacacggcggcctgtccaggtcctcctgtgggattcctgctcaccattggctcagggtccgccctgagtggtcctagtcagagatcgcaccgtcaccactaccctacacacacacacaagcgcgcgcgcgcggtgtcggctagccaggcggtgaaggggtgctggctaggcccggagcaccccggggtcgggggtggagtctcggtggcctcaccccgccgccatgtgctgcaggtctggttccagaaccggcgctccaaggagcggaggatgaagcagctgagcgccctgggcgcccggcgccacgccttcttccgcagtccgcgccggatgcggccgctggtggaccgcctggagccgggcgagctcatccccaatggtcccttctccttctacggaggtgggtgcgcgccgaatggcggggcacggccaggtcggggcgggcttcgttggaagcgggtggcagcgcgggggggcacgcctcgctctctgtaagcca

SEQ ID NO: 19818 - DNA, 1046 bp, Homo sapiens
taaaggacataatcaatagaaagcattagcacagtgtctggcacacatctcaccatgaatgttaggtactaatattatctttttctgctcaaagaggcatttggcagtgttcgaccatgtgagcaatcactcaatagttatcagtgtaactgagcctcactagtcttcagtgttttttacttttttattagtatttggattctttatataatttaaattaactaattgttctggaaagtgttatagtttactaatacttacaatgcagtgttggcctcttacgacgctatggaaagatggctacagatttccttattgctatacccagctactacctccttgaagcgtttaacttttccttgaaatacttttctttggcttggtgacactacctgtgctgtttgggttctcctacctttctgatctcttctctggttccttttgtatcctctcaatgtaaatttcattccgtttagaatcctgtcctcaggttgcgttttctcaatatagtctctccttggcactgtcacttactctgataaccctaactattgcctctaaaataacagacttccagctgtattctagctccagtaaactcctgagtaccatgcctttgtagcttcagcaccctaaactctacttttcagaaactaaatgaatatctccttcctctccacacaccaccccaaacacgtaaacttagtccccagtcaccttggtgttacatgttggtaatttaaacttgaactgtggaagtgatttcaaagacatcgtctgatattttagtggctgcataagtggtaagtcatggagtaatcttaacaaaattaagggattttctgtgcacaaaaccatttctctaaaagggtttgctttttctctctttcttttttttcttttttttttgagatggagtctctctctgtcacccaggctggagtgcagtggtgcgatctcaactcactgcaacttctgcctcccaggttcaagcgattctcctgtctctgcctcctgggtagctgggactacaggcgcatgccacc

SEQ ID NO: 19819 - DNA, 1525 bp, Homo sapiens
taaaatcacacaggagtaagataaatatacagaagccttcaggaagacagtactcctttgactgacattcagtctcattttatttgttttacttctgtaactttagataatttctttatatctctgtcttgatttatttattctctgatatgaaaggtgagactgctgctaatggaagtaagatggggattgagaactgacttatctagcaacatggtgggcatccttgaccttgatggagtttggcaggctagtaggcttacaggcttgactggaatgggtttaagagagaatggagtggctgggcacagtggctcacgcctgtaaccctagcactttgggaggccaagatgggcagatcacttgagcccaggagttcaggaccagcctgggcaacacagtgagaccctgtctcaatttttaaaaattaattttaaaaaagaaacaaaaaaagagaatggggaaaatgaaatagtaaagtataggcaactctttgaagggttgttgctttaaaggggagcagagaaatggggcattggatggtgaaggatgtggtcaaaagaggggtgttttgcttttttttttttttttttttaaggtgaagtatcagcgtgtttgcatgttgataggagtgacccagcagagagggggaaattgatgatgcaggagagggggacatctgttgtcacagtgtcctatagtgggtgagtggggatggagtggagatgggccagtgcacaggagtgccttagatagcaatgtggaccatctcatggtggcgggtgcctgtaatcctagctactcaggaggctgaggtaggaaaatcacctgaacccagaaggtggaggttgcggtgggccaagattgcgccaccgcactccagcctgggtgaaagagcaagactgtctttaaaacaaaacaaaacaaaaaccaataaactgcatttacagtgtattaccatgtaaataaggtagactactaggacagggaagaattggaaaattgtgttttcttccctgttttttcagtcatggctcctaggccactcaaaggagaatattcctagtttagttcaagtttttagttgctctccattacctgcttaaaatcatgctattttcagttcgcttcctatttatttattttttcccttttgcccccctcccccccactgtagctcagttttatcatctcaatcctttttttcctaaactttacatcatgccatctcttgtgttaaattttccattttgagctggttgttctctaggagtagtgcacagctgtgctcttgggcctttcattgctcttctggggagagctaccgctttcgggttttcaggctctcttttgttatctcagtttactgtcagtttgctgccaaacatgcatccagagtaagttatctgagttcttgtaggtttgaaaatactgtgccctcattcctcattgatgtattcttgtttgattgggtagacctttctagattgaaaattactttccctcagaattagaaagtattgcc

SEQ ID NO: 19820 - DNA, 1024 bp, Homo sapiens
agacctggcagctttctggcttcacacccatttgtcacccagcatttccctttgtgtatagaacaagaattaattaggctgcactgcaggaaaagtttatggctataatttatataggatgaatttttttttaaagagacagcattgttttgttacacctatatacatgtaagtgtgtgtgtatagaaagtgtttttttccccctcttaaagcagtgtctgtaagcttctggagtaaacatttttttttttttttcctaatgcaagatgatagtgtaatagatgcatttatcatgattgctgtctgatgaaactgttggggttttttgtttgtttcttgttttttaattcattgtttactagtgagaacactcagttttaggtttacattttagacattggtcagacttgtctggtttccagagctttgtattctttctgtctcttggaagactcgggattctgtcttttttagggtcttgctcattcaattaatgttttcataatcaatgcaagtcagaacttgcaatttgttcctgatttgcacattaaagagctccattaattaagaatcttggtgtttggcatgttcccgcaggatctgtgcattatttacatggtgaaagtgcaagatgcaagtttctcagttgtaagggcaattgcagttaatcctgctttttcttttcttctttctttcttttttcctttctttttgcttgtgagtaacaattatttcacaactcattgaaactccttaaggatacattgtaccaaaataggaacaaattattcaaaagagggggctatggtgaaaaagtagaaagtaaatcctttttttaaaggattttaaaggatttatcctttttttaaaggactgtgtacaacacagtcacacaattggtgagaggcaaagccagtgtagaaactgaggtctgctgtgcctcacaaacgttgctcttggccacactgcccactcactatgcatatggtttaacttaactcttttcatctgagggttttctccc

SEQ ID NO: 19821 - DNA, 1027 bp, Homo sapiens
gttgaagacagtggaatcggtgttttttaagattgtgggagaattaaaggcatattttaatagatgttgacaagaagtgaactaacaaaagcaaagcaaaggatttgcttgaaaagatttaatcaaacgtctttcttgggggattaattgctggggatgactagtgcaagtggcaggcttgtgtggatttgaatgaaaagtattgttctcaggccaatatatcgtgtgtcattttgacctatagtttagctctagttctagagttacttttgaaggagaaaaaaatgctcttgtaatctgtaaattccaattcaatgtatttatctggggtaatatgaatgggggagtttatgtgtacttgtacataaataattgtaatgtttgcgtatttatttaaaaacaactgtatagatatttaaaaactgataagctttatttactttatacactcactcttcctgttctcgcttcacgccattgccagaaattgtacttactggtttataatctaattaatgaactgtgtgtccatgcccaaacttattcctcgcttacagttttgtttatgttggacagcctagatgaatcagggaaaaaaataaagctgttaggtgaaaatggtttttagattggtgacattttatatatagaatgcttgcatatgggtagcatataaatgaatacctaatataggagtctgtgaatactgtccaatcctagtacaagcagagcttaagatttttaccatgtgaaatatgatttttgatagtaatatgccttctatttttacagcattaaaaaaattctaaaatgccttaatatataataacacagttactatttttaccttattttgtaaggacaagcaaaggcttgtccacattttataaacgagaaaattgagactcaaagagattaaattggtccattcagcataacatgactagttagtgacagtgtcagttgaaatacagggcccctaacccccagtaaagtactgtttacatttatcctctactgaaaatta

SEQ ID NO: 19822 - DNA, 1034 bp, Homo sapiens
gatgttgtcacgatgtaatggtaatcattcatttctatagcaaaatctactgaacttctggcactggggtttatacgattcagacttgggattttaactttattagaaagaatgttttattcttaaaattgaggccttgtaagtgttcaagtgctgaaaatccaaatactttaaaggagtggatttcaaagcaataattattaaagtatcagaagctaatctccgtgtgtagaaaaatgatatgacctgcttaagactaactttttttttttaagaacaattatagccactcacaaactcagtcctttacagaaagtccctcctgaaaagatgattttctatctctctgctgacacagaaagatagagaaaccaatgtagcttgccttcagcactgattttctgcattatctgacactgcttaatgttgttgcagggttttggtgcctttgaacgctcaatcttgactcagatcgaccatattctgatggacaaagagagattacttcgaaggacacagaccaagcgctctgtctatcgagttcttggcaaacctgagccagcagctcagcctgtcccagagagtttgccaggggaaccggtaagaactctgtaatgcagagtgattatggggaatagtttctatgaggcttattagctgaaaaacttgtagctattacctgtttatataagaggttagtgagagaaaggaaagcaacactactttactggattactgagagaaacttgagtgtatgtgagaggagagagtttttaaaaatggggcttctattaactcctgtgtgtcatcttctcttaattttgagtttgatgcaggagtctggtagtagaagcattcataatccaattttcaaaattcagttttaaagctacttctgtagaaatgtcagtattgaaacaagtgtgtactttaggctcaacgtttgccatttaggtactttagaaagggtgcagaagtggaatagtcaaattcttttgtttaaaggaaacatttaaaattttttaattatggaa

SEQ ID NO: 19823 - DNA, 1034 bp, Homo sapiens
gacacgatatatcatgcctaatggaaatatatggggtctgatgagaaagttttctgtgttgactaataaattttaacccaatggccaagcttagtgaaatattatggcctttgaagtattttagggcttgtgctgagaaaatagtactgctttattcaatgaatgaatttatcatttcttccaaatcataggccttagcgctagctccggagtggaggcatgctgcaacgcagaatcaaaaagtggaaaaactaatcaaatccttaaagaccaagggcagtgaggcagaattaggctgactttttcagtggtagcctctagctatacattctcttatttgagtaaccaaaggtggactatttgtaactttagtattaagatgcttcttagaccttatttgcataacctgatttcctttcattcttccctgtgtcattctgtaaatattgcacttccccttgcaaaaggtggctgcttttcatgcttgttgacaaaatctagaagactgcttgctacttgactctttgattttaggaatattattttgaaatagggtctcactctgtcacccaggctggaccatagtggtgcagtcatagcgcactgcaacctcacactgctgtgttcaagctatctttccacctcagcctcctaagtagctaggactatgggtgtatgccaccacacctggctaatttaatttttttttttttttttttttttttttagcgacaggttctcactgcattgcctaggctggtctcaaactactggcctcaggtgatccccctgcctcagccttccaaagcgttgtgattacaggcatcagccactgtgcccagcccttagaaatattattgaataatcactgtatgcaaaggcagtggtggagttccaggtattaggggtaagagtttcagtcagatgtatcccctgcctgcaagaagctcatagtcaagcaagcaagatgacataaacataaataaccagaacgcttggtgagtgtgtatcgaagaattcagaaaagggagaaa

SEQ ID NO: 19824 - DNA, 1079 bp, Homo sapiens
ataacctatccttttgcacctcccttctactttttccccttggagacctcatcctagagctctctggactcttctggcgtggctgcacaccaggcctgctggctgtattcctgggacttgcctttgcttcttccctgagttagacctctcgtttctaatatcttatgtcttgattttagtatactcatttactgaagtacatctttctgtgaaagagtacacagaaagtaaattgttgagtccttacgtgtatgaaaaatgcatttatgtaactctcattatacttggttaataatttggctgaggaggcagaggctgcaatgcgctgagattgcaccactgcactccagcctgggtgacagagcaagactgtcttagtaataataataataataataataataataataataaggctgtatatggaatttgagtctggaagtcattttccatagaattttgaaggtaccttgctgtcctctgctatctgctcttgctattgagacgtcttttcccattcagatttccattctttaatatgtagggcgactgtataatttattatcaaaactgggacaggtaaagtgctagtctgacagcatattaggacaacaggtgtaaaccaggactttcttggtaaactgggacatatgatcacctctttatatgtaacctgttttttctttaactgcttaggatcttctctttacctctggtgttctacatttcatgatgatgtgtcttgacagaggcccttttttattcattgcactaggtctttgcagttgtattcctgttctttctttgatttgggaaaattttcagtattccttcaaacattttctcccagcctttgttagttagatgtttgactttctggattatcctctaaatttttgtcttgtcttgcaaataagcaaggggatattatctttttgccttttggctttctttttgttttatatcagagattttcattcatttaagttcttctgttggattttttaaaattttctgtttagtgtttaatttctcattttagtctttttcacagcatcctgctcttatcaaagtatacc

SEQ ID NO: 19825 - DNA, 1051 bp, Homo sapiens
acttgaatttaggaatttgagaccagcctggacaacatagcaagaccctctctctaccaaaaaaaaaaatttaaaaattagccaggcatggtggcgcacacctctagtcccagctccttggtggtggtcggggctgggaggcagaggtggggggatggcttgagcctgggaggtcaaggctgtagtgagccgtgatcgcacactgcactccagcctgagcaacaaagcaagaccctatctcaaaaaaacaaaacatcaccaacaaaaaaacaaggatacatagaggccttttttataaaaagtgaagaattagactgggcatggtggctcacgcctgtaatccgagcacttttggaggccaacacaggtggatcactcaagtccaggagttctagaccagcctgggcaacatagtgaaaccccatctctactaaaaatacacatattagctgggcatggtggtacactcctgtagttccagctactcaggaggctgaggtgagaggatggcctgaacctgcgagtcagaggttgcagtgagccgagatagcaccactccattccagcctgggtgacagtgagaccctgtctcaacaacaacaacagcaacaaaaagtgaagaattagaagcaatgtatgtgttcaaaaatatgaaaatagggtacttctgttcctacggttatatgcagctatttataaattgtttatgggacattgcttataaggctaggtgagaaaagaattcattcaaaattgtgtgaatatatatatatataaggatcattatgtgaaacaaacgtaacaacaattgtctataggtagaaggattgtgtgtgggattttttgtttgtttgttttttagataagctcatactctgtagtgagccatgatcacaccactgcactccagcctgagctacaaagcccagaccggagggctcactgcagtctcaacctcctaggcttaagcaatccttccacctcagcctcccgagtagctgggactacaggcacatgccaccgtgcctggctagttttcttacttttttat

SEQ ID NO: 19826 - DNA, 1058 bp, Homo sapiens
tgtgtgtgtgtgtgtgtgtgtgtgtgtgtgtgtgtgtgtctgtgtctgtgtctgtgagagaggcaaggtctcactctgttgcccaggctggagagcagcagcacaataatggctcactgcagcctcaacctctcaggctcaattgattctcccacctcagcctcctgagcatgtgggactacagcagtgcgccaccatgcctggctaattttttgtattttttgtagatacggggttttgctgtgttggccaggctggtctcaaactcctggacttaagtgatcctccctcctcagctcccaaagtgttaggattgcaggcatgagccactgtgcctggcctcagctttgagtgattgaccacatatagtccatgagagaatgctccacttgtgactcatcttttgaccttggagaagactcttaccctccttagacctcaatttttccttctctcaattgaggatagtaattcctgtgttatttttatatcctctgcccttatcctttattgacgttatgatgaacaatgaataatatgggtacactgttttaagctatttgaagtaaaagaacaagataaaataaaggcatcaagacagtattgttacacttttttttttttaatatttgtgaatcattctttgcttttgtctttttttttttgagatggagtctcgttctgtcacccaggatggagtgcagtggcgtgatctcagctcactgcaagttctgcctcctgggttcatgtgattctccagcctcagcctcccaagtggctgggactataggtgtgcaccaccacgcctggctaatttttgcatttttaatagagatggagttttgccatgttgtccaggctggtcttgaactccccaccttaagtgatccatccccctctgcctcccaaagtgctgggattacaggcgtgagccaccgtgttcaacctttttttttttttgttaaataagagacagagtctcacacttactctgtcacccaggctggagtgcagtgtcactatcatggctcactgcagtctccaactcctgggctcaa

SEQ ID NO: 19827 - DNA, 1029 bp, Homo sapiens
aaaaaaaaaatagctgtcataaatgaaagtctgtatcgttagtccaagagtagatagaactaacctaattactgattgaaacgacccaagtagcagttcgagagttactgactgctccaatctaccagttattgttagtcagttttactctccatcttctttgcagatacatctttggattagttgtttggtcagtagtgatccccagagttgctgctctggtgtctctgcatgatatttgcatgacagttgtcaaataaaacttcattagcagtaaattaagttgtagtagttaatttagtttggagaaaggcaaaatgacccatatgaaggatgaaaaaaatacttaccttgcttgaggatgtgtaggtgggacatgcaagaaatcacactttttctcagctaatgggaaatcttctggatggattattttgtctgtagcttctttgttttcctgtgggagttaataccataaattttggccataattcttcctaagaatgtaagatctgcctttaattgtctcgtccattactgccagcagttcctgcccctgtgtagtttaaaagacagtgaggtggccgggcgcggtggctcacacctgtaatcctagcactttgggaggccgaggcgagcagattgcctgagctcagtagttcaagaccagcctggccaacatggtgaaacctcgtctctactaaaatacaaaaaattagtcgagcatggcggtgtgcctgtaatcccagctacttgggaggctgagacaggaaaattgcttgaacctggggaggcagaggttacagtgagctgagatcacaccactgcactccagcctgggccacagagcaagactccatctcaaaaaaaaaaaaaaagacagtgaggtggctgggcgcggtggctcatgcatgtaatcccagcactttgggaggccgaggcgggtggatcacctgaggtcaagagttcaagaccagcctggccaatgtggtgaaattccgtctctactaaaaattcaaaaattagctgggt

SEQ ID NO: 19828 - DNA, 1029 bp, Homo sapiens
agtccaggaaatcctttaatactttaacatttttaaaaagtgggctttagggagggctatgtttgatgggttcctttgcaattgggattttaaggcaaaatggattaaaaatgcttttcccaaaatcacaagaaatacattaaccattctctgtgagatttaaactttactaataaggttaaagctttcttttgaacctcttcctcaaaagtaactgccgagtgcatcttgatcggtttgtgtatatctttttagacttttctaagcatttttataaatgtccgtttgcacaaagtggttttttaaccgaaattaattattttaaagttgacttgtcctgtttataaagatttggcttctgtcaagaacaagtaatgtgtttaagtacaactgttggtaaagttttaataatcctgatagacggtgttacttcccagggcaaggggcaaattaccccttttaaacaacttcaaagtagtagaatcattacgatcctaggttttactcttaggtgctgaataaaactttcctatttaaaaaaaaaatctaggactactagcctattgtcttgtctttgcttataaagaaacgtcaaagggagtggaagacagggagagttgctaaagcaaccaaggcctgggtataaacttacagagctaacatttaagatggctttattatttatgaaagcttcacttcacctgggtgaagacaaaggaaagtgttaatgtgggcacccttcaaaccggtaatttcaggaaatggatgggttaaaacaaaattcatgtcaggattctgtggatttatatattatacatttaccgaggacttttaccatgctaaaggtgctgtgcctgaatacagaggaagaaggcaagtaaggtcggtctctgaccttatgaagctgacaggcaaatagtgacattcagagagagttggccagaattgttgtcatggttctgaattcccagaaatcaacattagatttattgaattgtgaattatgtaaaaaagtgtctaaaacaaatg

SEQ ID NO: 19829 - DNA, 1044 bp, Homo sapiens
ctaggattacaggcgtgagccaccatgcccagcctagaaatgttttactaattagtaatgtagtcttctaaagggaactattacattgtcatattgtgtttccagacagtattttttcagttaaagccaagggaataacttcaggatcctctgccttgggacccctctcgttcagctgaaaacttcatccctccctttgctgtaggatggcacagacacccagttgccctcacagtgcagtcggactgctctcagcatgggagcgggcatggccttcgccagttgcctccatcccgctgaagcagaagactcagctgtttacctcaccctgctcggaaactctagcgtggtaattataggtgcctttgatttgtaaagaaaaatgggaaattaatttattagtacattataagtgaagttaatttggtataaaatcactaaaagatgtggaattgggccaggtatatggtaaggaagtcctcatagggtgaaggttgaaactctccgctggagctttaaggattttgatatgtctgatgagacatcaaagatgatcaaagggtgattattaactactgagctgttagtcctgtgaactttattctaatttataaattctgttctttatcttcccttaaagtagtaatgagcttgtaaggactgaaatcttatttatgaaaagacctgcattttctgagatgtcatggtcttgcttctcagagggcagtagtaactttgacagttttgaggcaaactcacacctacctgggttttattgctgattagtgatttttttaagcactttgcctctagatgttctgagttacataaataacagtttatcatttaaccaagcacatatgattcacatttaatttttaccacttagtcctggaagactttaaaatgttatttatataagccattgctcaaattggtttccagttatcattaaacaagtttaaatacagctgtggacttttgcgagctttttattggatatttcacacccgaagaccatcttgtaccaccaacagtttagga

SEQ ID NO: 19830 - DNA, 1024 bp, Homo sapiens
atgatgaacaaagcacatacggttttaccatgcagttctcttctaggggaggaaaacagtcattaaatactgatcgcacacaaataattataggtgtagtgaagtaggagtgccatgggagcatatgacagggaaagataatggccgggcgaggtggctcacgcctgtaatcccagcgctttgggatgacgaggcgggtggatcacgaggtcaggagatcgagaccatcctggctaacacagggaaaccccgtctctactaaaaatacaaaaaattagccaggtgcggtggtgggcgcctgtagtcccagctactcaggaggctgaggccggagaatggtgtgaactcaggaggcagagcttgcagtgagccgagattgcaccactgcactccagcctgggcgacagagcaagactccgtctcaaaaaaaaaaaaaaaaaaaaaagataacttggtctgggagatcagagaagacttgcctgaggaaatgatatttaaagttgggattgtggctggatgaggtggctcacaactgtaatcccagcactttgggaagccaaggctggtggatcacctgagaggtcgggagttcgagaccagcctggccaacatggtgagatcccatctctactaaagatacaaaatttagccaagcatggtggcacatacctgtaatctcagctactcggaaggctgaggcaggagaatcggttgaacccaggaggtggaggttgcagtgagcccagattgcaccactgcattccagcctgggcaacagagtgagactccatctcaaaaaaaaaaaaaaaaaagttttttttttttttttttttttagagttagccaggtggagaagtgtggtgaggaatagcattctagggaaacagaacagtacaagcaaggctttgaggttaaaagagtataaaggggtgtcagattttgtcaaatgcttttttgtgtctattgagatgatcatgtgatacttgttctttattctgttgatatgatgacatattaattgatt

SEQ ID NO: 19831 - DNA, 1047 bp, Homo sapiens
ccaataggggccgggggcgcgcgcggcgtcactcgccgtggaggccagcgcgagcacgccctggggaaagtggcgtggctaagcccttccggaagtgacgtcggcttgggggcggtgctcggcggtggcggagcgcggcctgggctcgcgctgggctccgcgcgccccccgcccccctctatgaggcagaggccgcggcggccgttagcgctgtcgctccgggggccgcggcgggcggggctccggcggggcccggcctagtccccaccccagcccggctcccagccgcccgccctccctccctctccccgatgcaggaggccgagctccgggatggcgaggcggcggcggcggccgcttcgtaccgcgtcctgagccgcctccttggctatggagaggcggcccccgagccaggccctccgccaccgcccccgggccatggccccccgccgccacccttcctcgcgcggcccggcccgcggggctcccggccgccgcagctgatggtgttccgcaacgtgggtcggccgccggaggaggaggacgtggaggcggccccggagccgggaccctcggaactgctgtgtccccggcaccgctgtgccctggaccccaaggccctgccgccgggcttggcgctcgagcggacctggggcccggcggctggactagaggcgcagttggcggctctggggctcgggcagccggcggggccgggggtcaagacagtcggtgggggttgctgcccgtgtccgtgtcctcctcagccgccccctccgcagccccagccgcctgctgccgccccgcaggccggggaggaccccacggaaacgagcgacgcgctgctggtcctggagggcttggaatcggaggccgagagcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagc

SEQ ID NO: 19832 - DNA, 1049 bp, Homo sapiens
cctgtaatcccagcactttgggaggccaaggcgggcagatcacttgaacctggaagttagagaccagcctgggcaacgtggtgaaaccacatttccacaaaagatacaaaaattagctgggcactgtcatgcgtacctgtagtcccaggtactcgggagggtcaaggctgcagtgaaccgtgatcatgtcactgcactccagcctgggcaacagagtgagaccctgtctcaaaagaaaaagttgtgaaagccatcaagcccaaaacaataaattactgctgaagaaaactgtgtccagaaattgtatgtgacttcataggatctgtgacagagccaatcaaggaaatcatgaaagagatatggcaaaaaaagaaggtgaagggtgaaggatttcaagatagggatcttagagaaattcaagaactcatagataccacatcagaggaattaactgaaggtgacttgatggagatgagttcttctgagtcagtgccagatgacgaggaagaagacgtagaagaaacagtgccagaaaacattaatgtcaggcaatctggcagaagggtcgaggttatttgagactgcttttgagttattttagacttggacccttctatgatatgggcactaaaaccaaagcaaatggtagaagaagaattggtaccatatagaaacatttttagagaaatgaaaaagcaaacctgagtgtggaggctcaagcctgtaatcccagcacttgggaggccaaggcaggaggatcacttgaggccaggagttcaagaccagcctgggctggtagcttcagctattcaggaggctagggcaggaggatcacttaaacccagtagttcaaggatgcagtgagctgtgatcatgccactgcactctagcctgggtgatagagtgagaccctgtttctaaaaatagaaaaagcaaaaaaagtcagacaaattataacatttccataaatttataccacatgtgccttcctctcctacttccccttccaccttctctacctcttctacctctgccacccctgagacacc

SEQ ID NO: 19833 - DNA, 1050 bp, Homo sapiens
gtaccacattttgtttctccattctttaggttgtttccagtttttggctattatgaaataaataatgcttctttgaacattcatgtacagctgtttatgtgaatatcttttcaattctcttggatatattcctaggcgtgaaattgctgggtcatatggtaatcccatatttaaccccatgccagactcccaaaacaattgcacccaagattttgttattgtccatctttttgaatatagccatcctagtgagtatgaagtggtagctcattgtggttttgatttgcatttccctaatgactaatgatgttaacatcttttcatctgcttattggctattgtatctctattcacaacctttgctcattttataattgagctatttgtcttcttattgagttatgagttctttacaggctgggtatggtgcctataagcccagtacttagggaggccagggcaggaggattgcttgagcccaggagctcaagacctgcctgggcaatacagggagacactgtctctacaaaaaatttaaaaattagcccagtgtggtggtgcatgtctgtagtcctagctacttggaagactgagatgggaggattgcttgagtccaggaggtggaggttgcagtgaaccgagatcacgccactgcactccagcttttattttatctcaaaaaataaagttctttatatattctggatacaagtcccttgtcagatataaattacaaatattttctcccattctgtgggttgtctttttactttcttgatggtattctttgaagcatgaaggattttgatgagttcctattccaacttttttttttttttttgcttgttatatttagaaaagtttgcctaaccaaaggtgatggagcttaatgcctatattttcttctaggagacttaaacttttagcttttacattaggtctactatccgttttgagttaatttttgttttttaatttttttgtttggtgtgtatgtgtgtgtatatatatatatatgtacatatatatatgtacatatatatatatatg

SEQ ID NO: 19834 - DNA, 1157 bp, Homo sapiens
agtcttgggagcagtgaaatgggggttggatcatagagacaggcgctggggactcgggtactgcagttaggaaagtagcgttatgagttgtactgaaaatgttgattctctaatctgccagaaaaggacctgtcttttcatgcagatttcatattgtctttgtccttttcattgcttcttgaccttcctggcaggtgtcgctcagtttcttcctgtttcccttcctgtcctctccacacctgctatcccgtcccactcccatctacctcccgggaagccagccctgcatgctgagtttgtgacctgcttcattcccatttcatttctagagggtttagaggtgacctggaaccgttccctttccctctcctaccccctcctctgcaacaccaagaggcctggaggggcagacagaaagcagccagccacggcgggaagacatgcatgtttggttgcagctggactgcgatcgtagttcctcctggagatagagtgtgaggaacttaggacactcttcctcagactctgggatcatcacataccacactgccccgctcagagtttcgtcctgagctccctaaccagctcaggtggagcagaagcctgctctcactcctccatctctggtgctcccttgggcggggacctgtccctcactcttaggcccagaacctgtccaagggacaggtagggtccaggtgccactttgggtagctggctgttggaatgcccacactggtgctgcctgtggcatagccactgctgtacgtttttggttgtttttaagaaactcgatgaagaggggtgtcattctgggctcggggtggttgccaatttttcaccagaaagggagccaccccttgcaaccacttctgtctccgttagccccccctctgccctcctccaagccaaagcgtggcctggcttttgtcttcccatttagttttcctcttttacccttccttttgtgcttaatttattaaaatagttgctgtataatttattttcataaactataaaaaaatactaaatggttaaaatagacttgcaggccaatcttaaatggggtgggaggggtctgagggtgggatggggaaagggaaagaggttttgatataaacaaaacaaatgcactttgggtgtgttttggtattttt

SEQ ID NO: 19835 - DNA, 1055 bp, Homo sapiens
ctgcccctggccctgcctggggcccctgccccactcccgccccagccgcagaacgggttgggccgggcacccggggcagcggggctgggggccatgcccatggctgaggggctgttgggggggctggcaggcagtgggggcctgcccctcaatgggctccttggggggttgaatggggccgctgcccccaaccccgcaagcttgagccaggctggcggggcccccacgctgcagctgccaggctgtctcaacaggtgagggagagctcagccctgggaaggggaacagggtggggggctggctctgggaagggagggattttccccaaaacacccacaatccctaaaaggaaaaatggcctctggtctcacagggtatataatcctagtcacctcttggcctctaaggactccacagactgttagacatgtgtgtcctctggacggtagctccccagggacaaaagaattgttgacttcctgtcctgcactctaggatttccttctgggacagttcttctaaatcagacctgtatccctcttgctgcaccctatgagcacggtgctctaagatcgcacatccctgccttgcttcccctgggtctgagggagtctaggggcttgggattaggagcaggagtgtttccctggccctcccccatggtctgtgtgttgtcccccccccaccccccacccccacctcagccttacagagcagcagagacatctccttcagcagcaagagcagcagctccagcaactccagcagctcctggcctccccgcagctgaccccggtaatgcccctcccttccctgcctcaggtgccccttggtctgcctggaagggcacatctcagaggatcagggccagccaggagagggcaggagcaggcagagtgaggggaagctctaggctgggcctgtgggactggggctgggccctgtggagcatccatggcaggtaagggggataagatcatgcccaggatcccctgggcattgagaaagggctgctgtaatagccccaggtcgcatcctggtgaaagactctggag

SEQ ID NO: 19836 - DNA, 1166 bp, Homo sapiens
ggctgcgcgcggggcgttccaccgccaggcccgcccggcagggggcgccgggaccgaccgctcacgcccggcgtgctgaggaggccgctgggcgggcgccgtggtcgggcttccgtaccccgcccgcccctggcctccgccctcgcagaacgccgcggcgtcttccggggcctggcgggccggggaccgagggggcggggaggtgacccggcgggggcggagccagcgggcgggcgcggcgcgggaggcgaccatgcgcggcgcgggggcgatcctgcggccggcggcgcgtggtgcccgggtgagcacccccgccctgcaccagcccccgtcccgaaccccagccgggcccctgccagcccccactccagccccggcccggccgagcatcccggagctcccggcccgtcccgccggtgtctggcttgcctcagctcacaggcttttcccgagcgccagtccctgccaggacctccgcagccagcaccttctcttgcgacctttttcttaccctctcattcctccctcgccccttcagccctgtcacctcctccttcctagatggcctcccgtgtccttccctttccactgattttatttttccgtttccaaaccaccgtcttgtgatgcctgccatgcttgcgtaccttgcaggacctgaacccgcggcgggacatctcctcctggctggtgagtccccccatcctcccctcctcctcgcacaagacccccaggcacggagatctcaaaggcagaaacaggaaatggagctaggaagagtacaggcctattccctggagttagcccgtggctctcagggaggtggggcggaccagagggcactgggcagggcgccagtcttctgtactgaggacagcagcacctaatgaaccaagccccagtgtgggtggccctgccgtaggctggaaggatcccagcccgccttccctagcacgcaggtgggagccagcgtttgagggaaggcagctggaccctgaaacctgagtgcctgcatggctttgaaatctccctgtccaaagctcacggtcctatggtgtcctggggaacggtcttgttgggtggcatcagatcagcctcttgtagaggaaacctgccacacacacaggccagtgggaaactaggaagggtcgcaggccggacggtgc

SEQ ID NO: 19837 - DNA, 1048 bp, Homo sapiens
gccttggtgacagagtgagacttagtctcaaaagaaataaaaaataggtcgggcgtggtggctcatgcctgtaatcccagcactttgggaggccaaggtgggcggatcacgaggtcaggagatcaagaccatcctggtcaacatggtgaaaccccatctctaataaaaatgcaaaaattagctgggcgtggtggcacacaccggtaatcccagctacttgggaagctgaggcaggagaatcgcttgaacctgggtggtggaggttgctgtgagcaacttgcctcagcctcctgagtagctgggattataggcgcctgccactgcacctggctaattttttaatttttagtagagacaaggtttcatcatgttggccaggctggtctcaaactcatgacctcatgatccgcccacctcagcctcccaaagtgctgggattacaagcatgaaccactgcgcccagccaacgaaaaaaaaagttaataatatctgggattatctggataagaaccttaaaaccaaatactataacacagctcagggcctgtgtttgaacttcctattatgctgatgccgagttaccatctgaagtaacttttactgcagtgtttcagacagaggtgcgtagatggtatctctggggtccagattttaaaaagggtctggacattgctcaggtttgcagttcaatgcctcagcctgtcctgccagaaaaatcactgatttcagatgggctcatagaggaagctcccgtcaatagtagctaagaatccagaatttttcaggtcacctaatgtattttttttcttttcaataagagtaagacatttattttattatttttattttttattttattattattatttttttgagagtttcactctttcgcccaggctggagtgcagtggtgcgatcatggctcactgcaacctttgcctcctgggtgcaagcaatcctcctgcctcagcctcccaagtagctgggaccataggtgcatgccaccatgcctggctaatttttaaatttttttgtagagacaggggtc

SEQ ID NO: 19838 - DNA, 1049 bp, Homo sapiens
ttcccacatcctgggaatcatcccttacttcaggcatgtcttggggccagagctgggaatcttgagcctagaaaaaagagagttaagggaccagaccaaatcagagccagaggctgtggtttgaaggggttccactctgttggcaggatccggatcacctgtttgaaaccatctcccaagccatgctgaatgctgtggaccgggatgcagtgtcaggcatgggagtcattgtccacatcatgtgagtatgggctgggagaagtctagaagctctgcagacaccctgcctctctcccttctccacgagcatacaccccattttcccagccccctggtcaggtgtgagataagaaaggtgcttttggcagtcctgggtgagcaaaagtccatgcctccctatggctggtaactggcagcctacccagcttcctctggcctcttgtcaggtgaggttctgtgaccccgtgctcacaagagacatttcttccttaacaatgtctccgaagtctcagggatccgtgttggggtgagccacaacaaagctactgcagatggattgaaattctaggtggctcgcatcctctctccagcccagatctgtgtgatgttctgagctctagagaccaatttccaagcctcagccaactccctaagtgccatcctccttgtccttttacttgtttggggccatcaccaggaacctgattggatagagtaggaggtatccttccaaccactttcctacattgcaggataagcatttggacccttttgggggatagcctgcttaattaccgtgaaatagtatttggccaggcgcgttggctcacgcctgtaatcccagcactttgggaggctgaggtgggcagatcacttgaggtcaggagtctgagaccagcctaacatggcgaaaccccgtttctactaaagatacataaaattagccagacgtggtgtcacgtgcctgtaatcccagctactagggaggctgaggaaggagaattgcttgaacctgggaggcagaggttgcagttagtcaagatcacgcc

SEQ ID NO: 19839 - DNA, 1404 bp, Homo sapiens
taagttccagtgtttccatcctttttgagaccgtggggccaagaatgtgagcagtgtctctggcctggcctatttggactctgtgatgtgcttgggccccagttgactgaccaggtgcattatgctttcccaggtcagcagatccggaagctcatcaaagatgggctgatcatccgcaagcctgtgacggtccattcccgggctcgatgccggaaaaacaccttggcccgccggaagggcaggcacatgggcataggtaagtgtggtcatcttctccttaagaaatgataggtgctggcatctatgctgaaatatattcaggatctaagcactctgtctcatcttgagcctgtttcttactccttgatatttgatgtgttttctgcctgtgtgcaaatcagaaagttggtgctggtattggaattgagagtatccctggtaggaggtcacatttactaagtccctacctacactatgccaaggattctgtactttctagtttcagaatgatcgaaggaagctccttacaacgtgctgtgttgccttggtgcactgcctgttacacccacattctgcatgaagtgaatggggaattattgctgtatttgtgcttcctttaaaattgagtaaacgaaagaacttacgtagttgggatcatcatctggaaaatggaagtaatgctacttaaaatgaggttgtgaggattaaatgagttaaggaccctgacttgaaactatattcacttggtgtacttatacacagtgggcctgggtagtggcccgttcctaactcatcttctccacaggtaagcggaagggtacagccaatgcccgaatgccagagaaggtcacatggatgaggagaatgaggattttgcgccggctgctcagaagataccgtgaatctaagaagatcgatcgccacatgtaagcacaccctcttgggcccagtacccatttgctgctttgatggctagttcatttcccagagatttttttttttttttttttttttttgagatggagtcttgctctgtcacccaggctggagtgcagtggcgcgatctcagctcactacaacctctacctcccaggttcaagttattctcctgcctcagcctcttgagtagctgggactacaggcatgtgccaccatacctggctaattttttgcatttttagtagagacggggtttcactgtgttagccaggatggtctcgatctcctggccttgtgatccgcccgccttggcctcccaaagtgctggggttataggcatgagccaccacgcgtggcccacagagatctgtcttactggccttgggtagggagctttttttttttggagacagagtctcgctctgtcacccaggatggaatgcagtggcacgatcttggttcact

SEQ ID NO: 19840 - DNA, 1045 bp, Homo sapiens
gcaactcattccagaagctgactaggctcaaagggagaggtctggggatgtgcttctgtctccctagcatctcatctcttcccaaactgacccgtcttttctcttccctgaccagtgaccaggctgaggcccgcaggtctaagaccaaggaagcacgcaagcgccgtgaagagcgcctccaggccaagaaggaggagatcatcaagactttatccaaggaggaagagaccaagaaataaaacctcccactttgtctgtacatactggcctctgtgattacatagatcagccattaaaataaaacaagccttaatctgccttcctctctgcttcttgcaaggtttacggttactgagtgaggttttttttttttttttgagacgagtcttgccctgtcgcccaggcttgagtccgatggcgcagccttggctcaccgcaaactccacctccaggttcaagcagttctcctgcctcagcctcctgagtagctgggattacaggtgcgtgccaccacgcccggctgatttttgtatttttagtagagactgggtttcactgttggccaggttgatctcgaactcctgaccacaagtgatccacctgcctcggcctcccaaaatgctgggattgcaggcgtgagccactacacttggcctgctcactgagtcttttaccttgttttagtgggatgtagggagaaaaggaatggcttttatgcaagcctccaaaatactgtgcctcagaactgcccttcgaagcacgagtgacacctaagaagtggtctcagaatgttggttgggaccagtagttgtgacatcagttaaggaatcagtctttacaaaagccataggaaatacttagggtgtttatacttctcagctgacaagtgggggttacaaatgggacctgagcttggactactggctactacctaagctgtcactaaacagctttattgagatacagttgaaagtttgagacagaatcaccctgtcacccaggctggagtgcagtcggcaacccctgcctcctgggttcaagcaac

SEQ ID NO: 19841 - DNA, 1050 bp, Homo sapiens
gcggtggctcacacctgtaatcccagcactttggaaggctgaggcgggcagatcacgaggtcaggagatcgagaccatcctggctaacacgatgaaaccccgtctctactaaaaatacaaaaaattagccgggcatggtggcgggcccctgtagtcccagcagctcgggaggctgaggcaggagaatggcatgagcccgggaggcggagcttgcagtgagccgcgatcatgccactgcactcgagcctgggcgacaagagcgagactccgtctgaaaaaaaaaaaaaaaaaaaaatctaaaagttttgtaaggagctcacttatattctctgttttatcttctcactcgagactgcagcagcataatgttgagaatgtgacttacacatcatttttagtatgttgtgggtggaatacagaatgcaattagtaatgttggttattttaattgatgggtaaataaaacttctaatggagccaggatcagggcttgtgtgaaatgacagtggacttgtaaaagaagtcagtgtgcacataaagaacataaagcttacattagaggatttgtctgtttttttttgttttgttttgttttttgtttttttcccccgagacagagtcttgctctgttgcccaggctaggatgcagtggcatgatctcggctcactgtaatctccgcctctcgggttcaagcaattctcctgcctcagcctcccaagtagctgagactataggtgctcaccaccatgcctggctaatttttgtatttttagtagagacagggtctcctcatgttggccaggttggtctgaaattcctgacctcaggtgctccacccaccttggcctcccaaagtcctgggattacaggcgtgagtcactgcactggcttttttttttttttttaagacagagttttgctcttgttgcccaggctggagtgcaatggcgtgatctcggctgactgcaacctccacttcctgggttcaagcgattttcctgcctcagctgcctgagtagctgggattataggcccccgccatcacgcct

SEQ ID NO: 19842 - DNA, 1350 bp, Homo sapiens
aaagtgctgggattacacacgtgagccaccacaccagcctaatgcagacttttttttttttttttttttgagatggaatcttgctctgtcacccaggctggagtgcagtggcgtgatcttggctcactgcaagctccacctcccaggttcaagccattctcctgcctcagcctcccgagtagctgggactacaggtgcccaccaccacacgcggctcatttttttgtatttttagtagagacggggtttcaccatgttagccaggatggtctcgatctcctgacctcatgatccgcccacctcggcctcccaaagtgctgggattacaggcgtgagccaccgtgcccggccaatgtagacattttttaaaggtgataaaggtgatatttttgttgttgttatttggtaaactgttgattatctctcaaaattttcagtcttatactctcttctcatctcacagtttaccctatagggatactataggatcatcttagccctttgtaattactactaactgaacagaacaaaactggtaataaaaacctgtatggggggattaaaacatttcacaaatccaaataatgtggatcatttaggattattatccgagtattttttctttcctctgttataaccagttctttctgttctctgcctttctgcccttaaagcagtaatgtcatattttcctttctgcatgccctgtaatgtaataaccaaagattccccagacctcaggaggtaataatttctgcttctgaaacctccggaattcatgatgttgactcactcactccattgttcttgcttttgctttgttttcagccgactttgtggtagcccttgtccagctgtgtggcctgatgttatcaaactgccctacttcaacaccatgaaaccgaagaagcaatatcgaaggcgtctacgagaagaattctctttgtgagtttggggaaaatgaacatctcgtttctgtgtctggctggtgttgggacttggctttttcctggtctgggtagttaatgttgtcccagtttatcatggcaacacagtgtaggaaaacattttagtttcgaacagtatatgagttttatcatagcccttttgtaattttctcttctgaaggctttagacaatagaaaaccattttattttgaacaatatataaattttctcatagccttcttgatctttccatgagaaaaagagaatggaattgttggcttcatgggttttgtttgtttgttttttaaattgagacagggtcttgctgtgttgtccaggctggagtgcagtggcacgtttagggctcactgcagccttgacctgctgggctcaagcaatcct

SEQ ID NO: 19843 - DNA, 1035 bp, Homo sapiens
atgttggccaggctggtcctgaactcctggcctcaaacgatccacccgcttcagcctcccaaagtgctgtgtgggactgtaggcatgagccaccattgcacatcctttttttttttttttttaaaaagagatgggctcttgctctgttgcccaggctgcaatgcagttgtgcagtaagaactcattgcagcctcaaattcctaggctcaagtgattttccaatgtcagcctcccaaatagctgagactacagggtgcacagcattgcacccagctaattaaaaatatatatatatttgtagacatgaggtttcagtatgttgcccaggttgatctcaaacttctggcctcacgcagtcctaccttggcctcccaaagtgctggaattacaggtgtgagaccctttgaaacaaaattacaaatttgagaactgtagggtcattgtgaacttgtcctttctgtgttcttttccatagcattccttctgcagcacttgatttattggaccacatgctgacactagatcctagtaagcggtgcacagctgaacagaccctacagagcgacttccttaaagatgtcgaactcagcaaaatggctcctccagagtaagtgctggtagccatgttgtgaccctaaatctttccctgggccttagacgatgagaaactcataaaagaaccacagatgcccagtaagacccaaatgaagaggtgtctttgagtattatggttgaggtttgttttttttgttttatctttgttgtttttttctttatataagtaatagatttagctttgatacttgttctaatttgactcaagctatcttcttttgtccctggatctccatcccagaatattgttgtgtagagcctctttgaaagtattccttttagatttttgtgggttggtttatttatttatttatttatttttgagatggagtctctgtcgcccaggctggaatgcagtggtgcaactcagctcactgcaacctctgcagggttcaagcgattctcctgcctcagcctccc

SEQ ID NO: 19844 - DNA, 1065 bp, Homo sapiens
ctttcctctccaccatctcacattttgcttttaagtgaacactttttccccattgagcatcttgaacatactttttttccaaataaattactcatccttaaagtttactccactttgacaaaagatacgcccttctccctgcacataaagcaggttgtagaacgtggcattcttgggcaagtaggtagactttacccagtctctttccttttttgctgatgtgtgctctctctctctctttctctctctctctctctctctctctctctctctctctctctgtctcgcttgctcgctctcgctgtttctctctctttgaggcatttgtttggaaaaaatcgttgagatgcccaagaacctgggataattctttactttttttgaaataaaggaaaggaaattcagactcttacattgttctctgtaactcttcaattctaaaatgttttgttttttaaaccatgttctgatggggaagttgatttgtaagtgtggacagcttggacattgctgctgagctgtggttagagatgatgcctccattcctagagggctaataacagcatttagcatattgtttacacatatatttttatgtcaaaaaaaaaacaaaaacctttcaaacagagcattgtgatattgtcaaagagaaaaacaaatcctgaagatacatggaaatgtaacctagtttagggtgggtatttttctgaagatacatcaatacctgaccttttttaaaaaaataattttaaaacagcatactgtgaggaagaacagtattgacatacccacatcccagcatgtgtaccctgccagttcttttagggatttttcctccaaagagatttggatttggttttggtaaaaggggttaaattgtgcttccaggcaagaactttgccttatcataaacaggaaatgaaaaagggaagggctgtcaggatgggataatttgggaggcttctcattctggcttctatttctatgtgagtaccagcatatagagtgttttaaaaacagatacatgtcatataatttatctgcacagacttagaccttcaggaa

SEQ ID NO: 19845 - DNA, 1052 bp, Homo sapiens
atctcggcctctcacagtgctgggattagaggcatgagccactgtgcctggcctctgtaattgtgcttttgaagttatttggctgtgttggctgcgattgctctgcagtcctcatgcgtacctgggaattcttgcaaagtgagaagatctaacttactaattgttttcagatgtcatgaaacatttcagaatcctgcactgaacaattagtagagtccacatgatgtttcccttggcagacatttaattaaaattgtattgattttcagtcttgtagttttacttttgtatttgggagcatatatttttagttcgctgacagactgtgtctgtgttgcccagtggttacaaggactcagtagggtcgtgctgagcagggggtttggagccagagagtggcaaagcaggggctgagacttggctctcccgagtcctgatcggtcagcaccggtgggtgcccaggctggaaagaggaaggaggacagagctctgaggcctagtgactgagggtggaaggggctgcagagcccagggcagagtctgaggagcaagaggagtgctgggtggtgtgggttgggtgggatggggtgggtgggtggcaggcctgggggcctcaccggcagccagaggagaggtggcatcagatttcatggagctggggtgggcttgaggaagaggcacatggtggggctgtgtgctcagtgggggagcatctgtatctttaacaagcccccccagatttggctgccctgctggagagcggaagccccagtctaggcggttgtgaggggtcttcctctccagggctcctgggctccatcgcccagagtccctgtgtcctcccttctccagggtggctggtgccccacctgaaggagcctaggcccgtcacccccgtcattccaaggagtcaggtcgcagtctggcctggtgtccatccagttccctcaaacctctggacattggagtcagggccaaggcctcaggggtcctggtgaaaatgtctggtgggctggggtagggacaggggcaaggacacatccactccgtct

SEQ ID NO: 19846 - DNA, 1049 bp, Homo sapiens
cagggtcctggagacaaggacactcctgggtagaattaggacctaccccccaggaaatcaacggggaccaggtgccgtggctcacacctgtaatcccagcactttgggaggccgagacgggcggatcacaaggtcagcagttcaggaccagcctggccaacatggtgaaacccgcctcaactaaaaatacaaaaattagccaggtgtggtgtcaggcacccgtaatcccagctactgaggaggctgaggcaggagaattgcttgaacccgggaggcagaggttgcagtgagccgagattgcgccactgcactccagcctggcgacagggcgagactccatctcaaaaaaagaaaaccaatgggacagggcagatatggggacaatggtaaggagatgggagagtgggagggaggtgtcaggaagaccttcttgacttcatgtaggctggtgggggtgttagccagcaagcctccagttccctgggaaccgttctcagggtaccaattttaccacctgtctgcaaacactttaagattcttaatcagactcaaattggccacaaatcaggtaaacaaactcactagtggggtggggctaccacccgttctgaccctccagcccaacccagcccagccaccctgccctccgtagagcctgtggtgtttatcggtggcattgggagaattagtgtgtatttatgttggcgtggggtgtggggtggatttgtgtgtgtgcagttaggcctagtggaaggaatgtgggatctgaaggcaggccagcctgagttccagtcctgcctgttgctcacaagctttatgaggcgagagctaacccctgccagcctcagttgtcttctttgcaagatggaggttgcagccccagtctctggagcatgttatgcagatccaccgagagtgcctgccaggcacacagtaggtgctcagctcagttactgtggcggcccccactccccattgttgttgttttcctattgcctggcggccacagctggtatcccttgaaaagggctacagggggtggagtcgga

SEQ ID NO: 19847 - DNA, 1045 bp, Homo sapiens
ctccaagtactggggaaccccagggaggccctggggggtggcagtgttcctatttcagccccactctgcttccccctcccaggatatccaggaggtgcagggctacgtgctcatcgctcacaaccaagtgaggcaggtcccactgcagaggctgcggattgtgcgaggcacccagctctttgaggacaactatgccctggccgtgctagacaatggagacccgctgaacaataccacccctgtcacaggggcctccccaggaggcctgcgggagctgcagcttcgaagcctcacaggtggccttcaccgtcattgaaaccttctcttggttattcagagctgaccagggccactgctaaccagggggaggctttgtgtgcattagaaatggtgtcccttctgggcagacgcaggcagagcccgggaagacgccctcagaagattggaaaaagattccccttcttcctgggaagttgtagcttgcgtcagcacatataattcaatcgtgagaatgcaggctgggtttttgcccccacttggctgagtgaagtgtacagtgaacaacctatgtaactatttgctggccctggagccgactctgccccagagtctgggtgccaggtgctttgcccgcatggcccatttcagtcacgctgcagtcctgtcaggaaaaaatcagtgttattctcattctacatatgagaaaactgaggcttgcagatataagggccaaaagttacacagctagtgagtgatggggctgagtttcagactccacagtctcttaaccaccaagcagcatgcccagagtagaggtgagaaggaaggagagagctgcggtccacatgagcatctggacctagcatggacaactcactcctccctggctctcgctttgttcttgttgcgggtgtggtggtggtgggactcaaagacggtaaagatagctttctctcctccctggggaatctgggggttgtttaaaaggcctgctcctcttttagaaggcaggagggccccaagggaagcagaaggtgacagaagg

SEQ ID NO: 19848 - DNA, 1372 bp, Homo sapiens
agcgccgggcaggaggggtcctggttgcctcccatctgcagagcttcctggaggtgtcgtaccgcgttctacgccaccttgcccagccctgagccaagccctccccatcccatgtatttatctctatttaatatttatgtctatttaagcctcatatttaaagacagggaagagcagaacggagccccaggcctctgtgtccttccctgcatttctgagtttcattctcctgcctgtagcagtgagaaaaagctcctgtcctcccatcccctggactgggaggtagataggtaaataccaagtatttattactatgactgctccccagccctggctctgcaatgggcactgggatgagccgctgtgagcccctggtcctgagggtccccacctgggacccttgagagtatcaggtctcccacgtgggagacaagaaatccctgtttaatatttaaacagcagtgttccccatctgggtccttgcacccctcactctggcctcagccgactgcacagcggcccctgcatccccttggctgtgaggcccctggacaagcagaggtggccagagctgggaggcatggccctggggtcccacgaatttgctggggaatctcgtttttcttcttaagacttttgggacatggtttgactcccgaacatcaccgacgcgtctcctgtttttctgggtggcctcgggacacctgccctgcccccacgagggtcaggactgtgactctttttagggccaggcaggtgcctggacatttgccttgctggacggggactggggatgtgggagggagcagacaggaggaatcatgtcaggcctgtgtgtgaaaggaagctccactgtcaccctccacctcttcaccccccactcaccagtgtcccctccactgtcacattgtaactgaacttcaggataataaagtgtttgcctccagtcacgtccttcctccttcttgagtccagctggtgcctggccaggggctggggaggtggctgaagggtgggagaggccagagggaggtcggggaggaggtctggggaggaggtccagggaggaggaggaaagttctcaagttcgtctgacattcattccgttagcacatatttatctgagcacctactctgtgcagacgctgggctaagtgctggggacacagcagggaacaaggcagacatggaatctgcactcgagcagccaaagcctggcagggaagacagaggcacagggaccatgggaacccggaaaggagagggcatggggtctgggtgggcttaacaggccagacacagccagacaagatgaagccagggagtgctgagcatctgcaccaggcttgtcatttaccatcttccataaact

SEQ ID NO: 19849 - DNA, 1034 bp, Homo sapiens
gggagcctccagtcaggccgcctgcctcaaacagatccttctgctgcaattggacctcatcgaacagcagcagcagcagctgcaggccaaggaaaaggagatcgaggagctgaagtcagagagagacacggtacgggaggggttaatctgcattcgggccgaggagcgagttgtgcgcatgctcgggggaagggggctgtaggaggttaaggcacccccgggttaggggtaaaggaggttggccaccggcaaaggagtatcttaggcgctgggtctctgggagccaggctcacagacacgttgggttggagggaagggttaaagggcaacctctcagggggagggggaggggtttcaggtgccaaagggttaatttaaaatgacagccccagacgtgtgggaaagacgtttagtggaaaaagacgtgatctgtgaggggttaaaaatgaaagggtggggtgtaggtgttgtgtccttatggaagggttaaattaaagagctattgcgttagaaatgcacggtggaggagagggctgtagcaagcagctgttgctttcaccactgctgcagcatctttagataggagggcagtaggccttttagtgggcacaggggtagaggtgatttacgtggaatcctattttagttttcttaaatgatattaagagaatcactgcctttgatttcagacagcttttaataggaacctgagttctaatacatgacccactgaccaggtcccttttataagcatggtgtttgaaactggaagattttagggcatcaggggaaagtaagcttattaaatgtattaaatagacctccccatccttattttagaatcttagggagtaggaaagtcgtttattatttctttacttctgaggagcttggacgacacaggcttgtttttactgcagcagtagttaagggcatctctgcgttaaaacatattccttcagatatgagggaagctggggtggggggtattactgtgctagcataccttacagctgcctaaaaataaacatggt

SEQ ID NO: 19850 - DNA, 1050 bp, Homo sapiens
aacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggtt

SEQ ID NO: 19851 - DNA, 1846 bp, Homo sapiens
gaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttggctcccttgccagtgttttgcatgagtcttgatttgggagggagggaagaggactccctaattcccccacagggtcacggtcacaactcaggtcagcccaagttgtgaaacagaagcccagagagatgaggagcccctatgaggccataaatgtgtctgcactccccatcagttatcttttttaaccacatagatcaccaggatgtcatgccatcccttagattggaagtgtcagggacagaaaagtagtgagatgctggttattcacatgagcatctagtatcctttatggcttcctttgtgtttggcaagtaagtttcccaaggtaatatgccatcagatgtcaatataactataccaagtcctgggttg

SEQ ID NO: 19852 - DNA, 1071 bp, Homo sapiens
attcatagggtctcatgtaagcatgggcctctcacagagttattttaggacctaattgtaaatgtcagaccactgagtagaatgttacaggctcccagccaggcacggtggcatatgactttaatcacagcactttgggaggctggggcgggtggatcacttgagggcaggagttcgagatcagcctggccaacaaggtgaaactccgtctctactaaaacacaaaaaattagccgggtttggtggcaggcacctgtaatctcagctactcaggaacctgaggcaggagaatcgcttgaacccaggaggcagaggttgcagtgagctgagatcatgccattgcactccagcctgggcaacagagtgagactccctctcaaataaataaataaataaataaataaaagtaacaagctgtcttagaaacatcaggccttccagtgaggtatagtcaggtttgtggtaaacaccattggcatttattaggcgcactgtgagctccaggccctgggctggtcagaggttggatgggtctgggcagggtatcctcaagtgaaaatctaacctgtctaacctgcaggagctggatgtggtcaagtggtcatcgctacctactctaagcaaaagcctgggctggggcatgaggaggtcttggcttcaggaccaccgaaactcctttctctctggccccaaatctagagaatacttgggggcaatttagcctcccatctttcttttcttttcttttcttttttttttttttttttgagatggagttttgctcttattgcccaggctggagtgcaatggcctgacctcggctcactgcaacctccgcctcccgggttcaagtgattatcttgcctcagcctcccgagtagctgggattacaggtgtacgccaccactcccagctaattttttgtatttttagtagagatgaggtttcaccatgttgaccaggatggtctcaaattcctgaccttaagtgatccacctgcctcagccttgcaaagggctgggattacaggtgtgagccaccgcgcctggccttttttttttttgccttttt

SEQ ID NO: 19853 - DNA, 1027 bp, Homo sapiens
tcgggaggctgaggcaggagaatggcgtgaacccgggaagcggagtttgcagtgagccgagattgcgccactgcagtccgcagtccggcctgggcgacagagcgagactccgtctcaaaaaaaaaaaaaaaaaaaaaaaaaaaaaaaaaaagaggtgggctgggtgtggtggctcatgcctgtaatcccagcactttgggaggccgaggcaggcagaatgaggtcaagagatcgagaccatcctggccaacacggtgaaaccctgtctgtactaaaaatacaaaaattagccgggcgtggtggtacacacctgtaatcccagctacacgggaggctgaggcaggagaattgcttgaatccaggaggtggaggttacagtgagccgagattgcagcactgcacgccagcctgacaacagagcaagactctgtctcaaaaaaaaaaaaaaaaaagtagtgaaaacaggaaggaaactgtttttttggtaacaacttatttgattataaattttatgtattatttattaatttgtattattattttttaatagagacggtttcattatgttgtccaggctgggctccagcaatcctcccaccttggcctcccagagtgttgggattctaggtgtaagccaccacacctggcctgactataagtttataaaacatatatatttatatatggagatatatttgtttatttatattttaatggctctttaaaaaacagttggtaaaattccccagaacttaacagtatgctcttgtgagccagtgtgaaccagcttcaggacaccactgtatccatccatccatgaatccattctgcccttttagtttctctcttctcttgtccccaccaccacaacccttagggaggcctcagcttgtggtctagcatccttctctgccttctctgtgctgacactagagagatctttcatgctcctgttccaaaggcatccctgctccccatgcttccaagagaaagtgaaacatcccagcattcaatacccttccctttc

SEQ ID NO: 19854 - DNA, 1029 bp, Homo sapiens
tggcaaaaggggcggtggcggcggcggcggcggcggcggcggcggcgacggcgagaaagagcttgccggggggcgagcaggacaggacgaagccggagtgtaggcggcagaggattcgctcccagagcagctgcggccaggtcggaaagaggccggggcggctgggtcagtcgctgaaatgacctgcggacctgagtgggagggaaagtcgcggggaggggggctcggggcggggcttgagaagagaggggggcattagaggaggggccggagggggagaggggtcttgcgggtggggcctgaggggcggggggccgggggactgtatcggaagaacctggaggagagagggcgtggggaatctggggaggagtggtcgaatattggtatggggcgagcggggactggaaaaatggggaggaacgtttttgagagacaggcaataagggctcctgaagggttgggtgagttaaggcggcaactctgtgaggaacgaggtaatcgtgcgcaaaaagggagacgggaacggaggacctgttgggaacggctaattagcaggatgctgtgggtgaggagtccagtgtgacattttggggattgagttaggtgaaagctagtgtttgggaagatggctcgggaaactgcttacactagagggaatcttgagagcgttctttgaaaaggaatcagaatttagttaaaggttggattgagaatgttaagatgcgcattggaacgtctggagttgagggttcatgttgaagtggtgtgaagtgagggaagatggaatttttttttttttgttttaaaggtggggtctggctatgttgctcagactagtcttgaactcctgggctcaagcgatcttcccaccttggactcccagagtgctgggattacaggtgtgagccactgcacccggccaagatggaaatgttaaagtgttcagcatggcagtgtgtatggtcgagttttttatcaggaaggaaagttcttaaaaatagcattgaggcaaggaactgatatgtg

SEQ ID NO: 19855 - DNA, 1069 bp, Homo sapiens
agctggtactgataagttatgtgatagcaccaaggtgaaatgcaggagaggtgtgaacattggagttttcaggttttactgatggcttttacgaagggaagagattctagactcactaggtgtttttaggaaaaaaaaaaggcaagaggcaagagacagaagtcttgttctgttgaagagaaaatttttttttgggttttttttttttttttttgagacggagtctcgctcagttgcccaggctggagtgcaatggcatgatctctgctcactgcaacctccacctcccaggttcaagcgattctcctgcctcagcctcctgagtagctgggtgccatcacgcctggctaatttttgtatttttgtagagacgaggtttcactgtgttggtcaggctggtctcgaacttctgaccttgtgatctgccagtctcggcctcccaaagtgctgggattacaggcgtgagccaccgcgcccggcccgagaaaattattaaatgttctttctttacttgtgttctctgattgggagagtaacctggtatatgttagtctgttttcctgctctgaaataactgtgaaattcatgggctcttggttcaggcagcttcagcaaacatagtcttcttacaaccccaggaagagttgcaggctacaaaatatatgtacttatttgggagtaaaaacctgcttaatattatgctattgcaacctacagtgtacctttttggtttgttttttaaggggattttgagataacatatggaggctcggtgctcctgggcggacttttggtacagcctgcttattttttttttcttttcttttcttttttttttttttttttgagacggagtctcactttgtcccccaggctggagtgcagtggcgcaatctcggctcactgcaagctccgcctcccaggttcacgccattctcctgcctcagcctcctgaggagctggactacaggcgcctgccaccacgcccggctgattttttgtattttttttttttttttttttgtagtagagacggggtttcaacttgttagcgaggatgtcttgatct

SEQ ID NO: 19856 - DNA, 1030 bp, Homo sapiens
gtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgaggtgaagtgaagggaaaagagctgagctcgctggaggtctgaggtcgggatcagggaaagggcaggtgccctcggggtagttctagcagttatgcgtggtgtgaaggaggtgaaagttgtaggaaggaaatattctggggtgcgttgagagctgcctagaatgaggactgagtgcaggggcggaaagaactgagggaagactgagctgcagtgtgagggcttgggatagaagagactaaatgtggcgggtgctgggctgaactggtgataaagacaccccgcgtgcctggagggaggaaactagaagttctatataaatcaattcatgtaacttttttttttttttgagacggagtctcgctcttgtcgcccaggctgtagtgcagtggtgcgatctcggctcactgcaacctctgcctgccgggttcaagccattctcctgcctcagcctcttcatgtagctgggactacaggcgcccgccaccacgtccggctaattttttttttttttttgagacggagtctcgctcggtctcccaggctggagtgcagtggcgcgatctcggctcactgcaagctccgcctcccgggttcatgccattctcctgcctcagcctcccgagtagctgggactacaggcgcccaccaccacgcccggctaattttttgcatttttagtagagacggggtttcaccgtgttagccaggatggtctcggcccgtctcggcctcccaaagtgttgggattacaggcgtgagccaccgcgtttggccgtaatttttgtatttttagtagagacggggtttctccatgttggtcaggctggtctcgaactcctgacctcaggtgatccgcccgcctcagcctcccaaagtgctgggattacaggcgtg

SEQ ID NO: 19857 - DNA, 1027 bp, Homo sapiens
caaagcactggatgtttgcaggtgagttacggctctgttgcattcttttattaaaaaaaaaaaaaaagaaatgctgttaattgtctcatgtaactcaagtgaatgtggcttaagaggctctgttctgctacttttttacgctcagaaaggaggacttgtttctcagtggggagctctggatttccaccgtgttaatgtctgaaacattatcagtccattacctacagagggagaaacaaatgagatgttgctggcactccctgtggtgattatagattggttaattacatttgtattaaaaaagactccagtttacttttccattagctggtctcaagcaggtttatttatggacctgaaccgtctttgcctttagacttgttccccttcctttccttttgtgagcaccccttcttcccttcagttggtggtcccccacagttgtactccagacctctttctcccttcccatcctcctgcccctcctgctggggaaagcctctgtgccgactgatgaaatttcttccttcccagtagggacactgggtccattaaaatgatacttgctgtgctggcctgctggtccaacctccccctattgctatgcagaagacccaggtctggcttatggcttcctgtgggcaagtactttggagagagcagtgggagagtaagctcttcctattgctagattgcatgatcctgaatttgaaagtttcccctaatcagcaaactacttgggtaaagactgcaactatgagcaatagtcatgtaggctagcgtggtttagcctacacatatcctatgtatatataactgaagatatcccttttaggtttggtgtgtatgggtgatgctgactccctttagtcagtcacccacactacatatcctctctcctacccatgacattttctcctcatccaaaatgttatcattggcttaatgtatgatgacctacttggcatccattaggaggaaaccattgaagtttctcaaatctgatgtccatgaattatttcaaagc

SEQ ID NO: 19858 - DNA, 1062 bp, Homo sapiens
gttgttgttgtttttgaggcgcgtctcaccctgttgcccaggctggagtgcaatggcgcgttctctgctcactacagcacccgcttcccaggttgaagtgattctcttgcctcagcctcccgagtagctgggattacaggtgcccaccaccgcgcccagctaattttttaatttttagtagagacagggttttaccatgttggccaggctggtcttgaactcctgaccctcaagtgatctgcccaccttggcctccctaagtgctgggattataggcgtgagccaccatgctcagccattaaggtattttgttaagaactttaagtttagggtaagaagaatgaaaatgatccagaaaaatgcaagcaagtccacatggagatttggaggacactggttaaagaatttatttctttgtatagtatactatgttcatggtgcagatactacaacattgtggcattttagactcgttgagtttcttgggcactcccaagggcgttggggtcataaggagactataactctacagattgtgaatatatttattttcaagttgcattctttgtctttttaagcaatcagatttcaagagagctcaagctttcagaagtcaatgtgaaaattccttcctaggctgtcccacagtctttgctgcccttagatgaagccacttgtttcaagatgactactttggggttgggttttcatctaaacacatttttccagtcttattagataaattagtccatatggttggttaatcaagagccttctgggtttggtttggtggcattaaatggcaatttgtgactgagacaccagagggcacccttataacattgactactttgaaaggggatgcttgaggctgaggtagttttgagggaaagggggaagttctagtttgatttgtttgggagattgctgtcctttcataactgaagcaaatgcttgaaatgtaaaccatgtgtgatacgaatgatctgagagccagtgaccaagtctgcttttccctgagctctcctgctgccgcctctacctttctgacatggccttcca

SEQ ID NO: 19859 - DNA, 1051 bp, Homo sapiens
acgtgactcgctatggccgctgccatcgccccgcgcccctgagccgcggccccctggacggctcctctcccgggaccccgcaccctgatgccgagcagcaccagggcgccgggttagggcagacgctgtgctcgctggcaccccgaacgggttgcttcccccgctgcgaggtaattcctcccctggggattttggggagcccctggttcccgcaggcgtcggggccccatgtcctgccccagattggtgctgcgggaggggactgggtaccgggaggcttccgacgggaacccggggtttcctgggcttcccaactcgctgccgccgtgtccagggtgggggagccccgtctgtgagtctgcctgcgccgtgtcttcgcgcgcagccttgaggcgtctggggccgtctgctgcgcgtgtcccccgcgctcgagctgttgcagaaccgccgctgggaacttctgttctttttctctttaatgataagcaaaacaaaaagacttgaattcaaacctgtttggggagagatcggatgctcaacggactagccccctctctttttccctcctgttatctgagctgccctgtggtttggggagaatcagccagggggcccactcccaccagagggagccggccgggggccgggccggttcagctggtgtcccccgtggagtgaggggaaccgtcagaattgggtgcgggagccaatgcagtatgtgtgtaggggtgttcctgggtcttgtgccaccatggggtgtgggaactttttggggtgaggggaagacggaatagactgacttgtcgactttgctctgctgagggtgtctgggacctggtgccacccacgaggcttggaagctgctggccagatgtgtgtgtgagcctgttgtggggttggggggacggctgggaaatgagcttggctatgtcccctcatctcctctctgggcactggcctattgtcaggctgctccttgcgaaaggaaagacaggcctccagtgtgctagggtggggatggggaccaactaacccggaaaccagacagaag

SEQ ID NO: 19860 - DNA, 1069 bp, Homo sapiens
gtagctgggattacaggtgtgcgccaccacgcccggctaatttttgtatttttagtagaggtggggtttcgccatgttgaccaggctgatctcgaactcttgacctcaaacaatccgcctatctcagcctcccaaagtgccgggattacaggcgtgagctaccacacccggcctaacatgttattttattatttatttatttatttatttattgagacagagttttgctcttgttgcccaggctggagtgcagtggtgtgatctcagctcaccgcaacctcctcctcccgggttcaagcgattctcctgcctcagcctcctgaatagctgggattacaggcatgtgccaccatgcccagctaattttgtatttttaatagagacaggatctctccatgttggtcaggctggtctcgaaatcctgacctcaggtgatccacctgcctcggcctcccaaagtgctgggattacaggcttgagtcaccgcgcccggcctcatgttattttataatgtgaaaaataggactttttccccccagaaggctctgaattgagagttccctcctactgccctgggtggcgggggaagctgttttatggagaagggagtaagggtgaccgacggtgatctgagtggtcagggaggggacactccaggctgagatgtttggttgtctgctctgccttcctaggggtccgcctgagtgcatagcaaaacccgcttcacctatgcacctgctgggccagtccccgtgtggaaccccgttagctccatatgccaatgagctcattcgattctctgtcaatggtggcatgagggcactatttacaccaggggaaactgagactcagagggtctaagccacttgcctgctgtcgcgcagccggtaaatagcagatccaggcctatgcgaggcccaactagttcttgagcccaagctcttgagcctttcatggaactgtcctccatccagcctggctgggcttcccaggtgctgtcccagggcctgacagtccccaggaggggttgcctctatgccagccttgtgtggggctggtgggtgcaggc

SEQ ID NO: 19861 - DNA, 1059 bp, Homo sapiens
tccaatctatttactggaatacaatgatttagcacacattgatttttcccataaacattcatatgcaatgattgctcactaaaatgcaaaaagggtgaggatacaatatgtgtttttattgtttttggatttggcttctttcacttagcatgttttcgaagttcatctctgttatagcatgtatcagtacttcattcctttttattgacgaataagattctattgtgtggatatattacattttgtttatccattcatcggttgatggacacttgaggtgtttcgctttggggcttttatgagtaatgctgctatgaacatttgtgtataaaaggacacatcgtattaacctatttatatgaaatgtccagagtaggcaaatccgtagagacaggaagtagattagtggttgttaggggctgggaggaagggaaaaggcggtgactactaataggtacaagatttccttttggggtgatgaagtgttctaaaactagatagtggtgatggttgcaaaacattgtaagcatactgaagaccactgaattgtacgttttgtaagggtgaatttcatggtgtgtgaattatatctcaataaatctgttattaaaaaaatgagagacatttcattaaaaatatatgttcaccatataaagaaagagaggacctgatagtatatgcagcttattatcaaaaggagacacattttgccttgagaagggtttcagtaatgttgtttttaatctatttccattttaagtatagtgtacttcactcttattctgctcagcatttgtgattgaatttgactctcaaattattcaaaaagctgtgttgagttttaaaaggcagtggaagcaatgggaaaaagcagatatagctcaaaggttgtagagttgtactgatgctgaaaaatcaataagattaacccagaaattggctcaataagaaaccagggactcccaaagggggttttacaattcagaaacaggaaaaaattagaaagtggtttatttgcaatttacatggattcctctactttgtgaggtttagtataat

SEQ ID NO: 19862 - DNA, 1029 bp, Homo sapiens
gatgcaacagggtcaagaaggtggaacgtaccaaaggacacagtgcgtaggcgcgctcgaaacctgggccggtattctcggcacccagacaccgtccactcgcactgcgcaggctccgagacagatcaagctttccctccccctcccagctctcctagagtcaagaggacgccctcctgccgcagacttcctgcgcaagcgccatcccatgtccccgcctccaaaccaattggaagcggcgccgcctgggcgcttggggcacgacgctgtgggtggggtcaggacgtgagggcagcgcgctggcgtcagaggcgcggctatataactaaacacaggcaccgcccctctgccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtggggcaccgcctggcagcccggactcccccgacatgtgatcggcttcccagggag

SEQ ID NO: 19863 - DNA, 1030 bp, Homo sapiens
tttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagaggtgagttcagtcactacttgatttgtgcctctctgctggcaaatctcagatcctgtctgttagcttctgctggggacataaaagttggctttgtaaggctgagcaaaacctcagttgggttttaaagtacatagacttatttctgttttataggaaaaagcagaagggacttgtctacctttggtttactgtttctgtggatctacttcacagatgcaaatttgaatagcatatagatgcattgtaaaataagccaaatgctgggttgttcctgtatttgtaaggacatgagtttttaaaaatgaatttcctgagtattaatactaaaatactgttacatgatcagctcttgatataattgaagagatttcagatacctgatgagtctcattctcacactaattcagaaccttggaaggcactgagtgttcaaaaaaggtagctcttaactgaggaccctctgttgaaccattgtgcgcacccctggctcttgggcagtgtagtagcaggaagac

SEQ ID NO: 19864 - DNA, 1033 bp, Homo sapiens
gggtagcgcgtggctccctgcggaggccctgtctacgtgtcacacagtcggacatgccaccctgggctccttggaggaatttcattcctccctctctggttctcctggaaccctcatctctctccattttaggtacaccaggccagaggcacaggccgcccatttttgccagccttggggtttgtaaggtggcctcctggtctgacccaggcctttggtctgccccagcaagtccacttttgttagcggggacagggcagggctgtatgccagcctcaggggtaaatctagggtcccagttacacacagaccccacagcacactgaaagaagtcagtgtttcttagaccctcctctgaaacacacaactcagcccacaggaaattagtggccatgactttagaggcaggcatatattggggtaagcctacaaactccaagagtcccaagaccctggttcaaatccaggctatgaccatggacagagaattttgtctctttaggcatcactttccttatctgaaaagtggagacaaaaacaggacctacttgctaaggctgatgttaggactccaaggacatggatgaatgaacgtaggcttctcacagggcctggcagtcctccagccagttcagcacacattaacattgaccctgaggaaaaccatatgacctgatgctgtggaacttgtagaaacttaatgcagagcttaagccttcataacaacactgagaaggaaacagtccagacttaaaacctgtctgcttggtgggcaaattcagatatagggtagtagccagaagtgcagccctgagcccttgactgctaggagtgaggcaggggttgggatttaggggatgtcatccctgatggggactctgggagcccagctcatgagtgttgagcttggaaaactttttgttttttagctggaggctcactctgtcgcccaggctggagtgcagtggtgccatctcagctcactgcaacctcctgggttcaagcaattctcctgcttcagcctcccaagtag

SEQ ID NO: 19865 - DNA, 1500 bp, Homo sapiens
aatagccatgcccacgcaatccccgcacccaggaagcatcgaggaagaagacgtcccccgtccggactgcccacccgccctggtgctcctgcctgcgctgagtcccacgcctcaggctccttgtccctgctttttcctgggcacacatgcaggctgttccctacctgagaccagtcacagactatccccatgccacgcctccaccccagcccccaccaggaccccagcaccagtgcctttcccagcccttcctgagttacagggtgcgggggagcctgggaaaaaagaagaaaaagaaagcactcactggcctccacccggggcccctgcccctcccaaggccatgaccctcactgcccgctcccccggctctcccctgccccagttctccaccttcatcaaggctcaagtgagtgagggcaaaggacgcctcatgcctgggcaggaccctgagaaaaccataggagacatgttccagaaccaggaccgcaaccaggacggcaagatcacagtcgacgagctcaagctgaagtcagatgaggacgaggagcgggtccacgaggagctctgaggggcagggagcctggccaggcctgagacacagaggcccactgcgagggggacagtggcggtgggactgacctgctgacagtcaccctccctctgctgggatgaggtccaggagccaactaaaacaatggcagaggagacatctctggtgttcccaccaccctagatgaaaatccacagcacagacctctaccgtgtttctcttccatccctaaaccacttccttaaaatgtttggatttgcaaagccaatttggggcctgtggagcctggggttggatagggccatggctggtcccccaccatacctcccctccacatcactgacacagctgagcttgttatccatctccccaaactttctctttctttgtacttcttgtcatccccactcccagccccttttcctctatgtgacagctccctaggacccctctgccttcctccccaatcctgactggctcctagggaaggggaaggctcctggagggcagccctacctctcccatgccctttgccctcctccctcgcctccagtggaggctgagctgaccctgggctgctggaggccagactgggctgtagttagcttttcatccctaaagaaggctcctttccctaaggaaccatagaagagaggaagaaaacaaagggcatgtgtgagggaagctgcttgggtgggtgttagggctatgaaatcttggatttggggctgaggggtgggagggagggcagagctctgcacactcaaaggctaaactggtgtcagtccttttttcctttgttccaaataaaagattaaaccaatggccttagggtgtcttttggaccaggttgaggggcaggggggaatggctaggggatgaagtggggattgtgggaggcctttagacccagagattggggaaaaagttaaaccaggctgtttcca

SEQ ID NO: 19866 - DNA, 1027 bp, Homo sapiens
cccgggtggagttaagcgagcagcaactgcagttgtggccgagtgatgtggacaagctgtcacccactgacaacctgccgcgggggagccgcgcccacatcaccctcggctgtgcagctgacgtagaggccgtgcagacgggccttgacctcttagagattctgcggcaggagaaggggggcagccgaggcgaggaggtgggcgagctaagccggggcaagctctattccttgggcaatgggcgctggatgctgaccctggccaagaacatggaggtcagggccatcttcacggggtactacgggaaaggcaaacctgtgcccacgcaaggtagccggaaggggggcgccttgcagtcctgcaccatcatatgagtgttctcaccaccacttatgcccctagaagggaaggggagagggaaacgtgccctctgtttgatccttgttttgtgacattttttttttttttttttttactcaaagttaacctacctgtaactttttaaaaacttgtaaaataactgaccctcccttcctgtccgccctcttcccctctaatgctcacgctcccaacacaaggtgggcagggaggcaccattcaggaacctggaccaaagctgacgaggctgggccaagccagggatggggccacagccagaaccccgagccctacttccaggttctggttagctcagccccagcccagcccagctgctctgcccagagctgggtgagtggggagacacctcagagccccgcaaaacccactgaccggaggcaaaaggcagtggggctgggggtagttttccatggtcacagagaactagtggtggctctgagaaggggaggacctctgggctttgattccatctccttgtcttttttctttgtttttagagacagggtcctgctatttcccaagctggagtgcagtggtgcgatcatggctcactgcagcctcgaactcctgggctcaagcaatcctcctgagtgatcccatttcttaatcagtgtagccccaagaaggc

SEQ ID NO: 19867 - DNA, 1066 bp, Homo sapiens
tcttggctcactgcaatctccgcctcctggattcaagcgattctcctgcctcagcctctcaagtagctgggattacaggcacccgccaccacgcctgactaattttttgtatgtttagtagagatgaggtttcactatgttggccagtctggtctcgaactcctgactttgtgatctgcccacctcggcctcccgaagtgctgagattacaggcgtgagccaccgtgccctgccccagattatcctttttatttgctcagtccccccagggagcagatggcttcagacagccacacaaaacactgttcctgcttaattctccatggggtcatggttaaagagaggaagctgggctgagctccctttactaattggtcctctacatcttgcgcacagaagggaacctggcccagtggccagtgactctcctctccctttatggcagcatttccaagcacctgccctgtgacagatactggctaggtactggggataacaaagacgaataaaataacagcttaccatccagtagtagacatggagacatccgtttcctctgactagcattgggatggtgctgaaaccctggaactatacattcagtttagaactatacattcagtttagaactctcagttatggacgttctgccttctgtttttttggtttttgtttttgtccaccagaaaacatctgctagtaactgccttctgtgttgatgctttctttcctcaccttacccagcgtgcttctgttcttcaaggttgaaaactaagcatggggaagagctgcaaggtggtcgtgtgtggccaggcgtctgtgggcaaaacttcaatcctggagcagcttctgtatgggaaccatgtagtgggtgagtgttgttggagggggaggaacagtggaagaagttgaaaaataaggaataggacttgatcacaacacacacaggctaaaagctgctcctggtggttttcccccctggaagaataaaacttacattgtaacagatcaactctacaacactgaacaaatacggagggagaaagccctatgtccaagataggaa

SEQ ID NO: 19868 - DNA, 1044 bp, Homo sapiens
gcacacacaaatatgctcctatactggcattaggcgtctcctcatccctcaccctgacctttctcctgtccttttcttggctggaagaagttggcctcctgggagtgtagttttctgttttaaatcccccacccctggctgggctcagtggctcacccctgtaatcccagcactttgggaggccaaggcgggtcgattacttgaggtcaggagttcacgaccagcctggccaacattgtgaaaccccatctctgccaaaaatacaaaagttagccgggcgtagtggcacatgcctgtaatcccagctacccggggaggctgaggcaggagaattgcttgaactcagaaggcggaggctgcagtgagccgagatcgtgccactgcactccagcctggtcaacagagcaagactccatctcgaagaaaaaaaaaaaaaattccccacccctaccaattgttttacttcctcttcctgctcagggagcagatgggcctcactggttgagatggaatagaataactgggctatgagtcaccagcccactttgtgacccagcaagacctttcccctctctgggcatcagtttctcatctgtaagatgaccagagttgcttagatgatctcctagatcctttccagttctcttgatttcgtaaagccaatggcttctccctctttaaggtgctatgccaaccagccctggaggctgggatctgccgctccctccagccaccagggggcaggagtgcactacctgctgtcagtcaccagagtggccgctcagtgcccagcccgccagcctcgctcttggaggctgctctttatcctgcctgtggttttcagctcagagctggacttctatttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggtgggcacacacccagcg

SEQ ID NO: 19869 - DNA, 1622 bp, Homo sapiens
ggttgacttaaaccacgtcttgtgagacaggcaggcaagtaggatggagtcttgtgagtagtcaggctcactggtttttgccaagggataaaccaagaacaagttgaaatgttgtaatcatcgggatcctgaaaacaagttgcttgtagtcagctgatttgattgcaagtagaaaccgaaagaaccccctcaacttacatgtaacagccagtggtaactagtgtctccatgatctcatcttaaacttttccaatctcatgacagtatttctctgcacttctggtgttgatccttacttcccaaaatgattgctttctattttttaggccttcagacttatcatctggtttatacacagtttttccccctttttgctatgtttatgatcccatgactttatcaagttatggtccctgtgccactttttaagagtgtggctgacaggggtagaatcaaattgaaatttggaatgaaaatgatagagaaaaactcttctgattttttgtcttattgtgcttttgaagaggatgattgttctggtttactcctagtttttggtcaaacaagtattgcctgggtattagagttggggagatgaggcaatggagaagttgattggactggtttttgttttgttttgttttgttttgttttttggagcagcttctcctttctgatgggagtaaagggtggtaggatgagttcggtagagagaggctaggaaatgtagacctgcgtgtgggaagatccttcttcatttcattgtataaactgtcatggtggaagtcattttaaatcttaccaattaaaccagcccatgaactctagtttggtttattatctgttgtttttccttcactttacttgattcttgagctgtgttctcaagaatcctacaactgtaaagcctatgtgaacttatttagaagattcctagtcagaaaatgggacattcagatatgtttttacaggcctgcccagctattgtgcttcttatccttttgaagacataaatactctttaaatcccatggcttggatcattctataagtggccatgctgaaagttctcatattctgaattttaaaggggctggaaacgtagatacctggagcttccccttctgtctttctccagacttcacagcattcaaagacagtggcagtgccttgcttcttccttggaaagagagcctctatctttcacattctcacgtagggaaaattctagtttgtagctgcctagaaattaaatgttcagagtatctgcagagtctcttcattattgcacagaaagaagagatattttagcttcctatctacatgcagaggtatttcctggcactttcatcattcattcagggaaacgtaggagagaaaatggcttccaccaagtaacagatttatacatgtcaccatcacttaattttttttccttttgctccttatttctaaaaccatttccccagatgctttactggggcaattatgctttctttacctcaaatttattttctgtgttttcatcccctattcttcttgtctttttatggatatatcttgtcttttcgtggtttgttttctttttcatccttattttctgaacctgtctcctggttcctc

SEQ ID NO: 19870 - DNA, 1049 bp, Homo sapiens
aggaagttaagagaaggtagtgaagaaggagagccagagaacatactttgctttctccatgaaagggggagaacaactttcataaaaaggcagatatggaggcagttccacattttctttggtgacatattttaaagttaaatttttttcacattaaggatgtatttcagaggatctaatagaaatcttccattataaatgttataccttttcccagttttcccaaaagctgggaaagataatctagttttatttttaggtttattagttttattgagatataatttacatgaaagaaaatacatacattttatgtgtaccatttgatgagtttcaagaaatgtacacctgtgtaaccactaccacaattaggaggataacctaagtttgataaatgtgctaatgtttttcaggaacacagtggttccactgtaccttccattttgaacaggatgcagacaaaccagactcccccaacctataacaaaaccaacaagtttacctatggctttcagaacatagtagatgcttatggaattggaacttaccgagagataaatccaggtaaaaaaaagcttgttatctttttcctctagagttttttttgtttgtttggttggtttggtttgttttgagacagagtctccctctgtcacccaggctggagtgcagcagcacgactgtagttcactgcagcctcaaactcctggcctcaagagatcctcccaactcagtctcctgtatagctaggaccacaggcgcacagcaccacacctggctaattttttattttatgatttttttttgactgggtctcattctgttgcctaggctgtagtgcaatggtgaaatcacggcttacagcagcctcaacctcgtgggctcaagtgattctcccgcctgaacctctggagtagctgggactacaggcatgtgtcaccatgcctggctaatttttaaaatttttttagagatgggttttgctatgttgcccaggctgataatttttaattttttttagagacggggtcttgttatgttgcccaagc

SEQ ID NO: 19871 - DNA, 1303 bp, Homo sapiens
cgcatgacctcctttgcacctgctaatgtctggctcccatactctcgtaggacttaatgcatgccagtggcctccctgcccgcctctttgcccccatcaccaggtggcaggaaactcactcattcattcaataaacttggtccagctgtctgaggctgccagaactggctgtgctgggtcctgggaggcggcaagaaaggtgcccaagggcttacccctgataggagagatatgttggctgaaggatacaatgtggggacaaggacaggaatatatgtgggttccgctctcctctgccgggagagaggggcaggaagggctcagggcagagcccagccttgaaaaatgagtgttgcttggacggacgcttggctaatgcttgtaatcctagcgttttgggaggctgaggcgtatggatcacctgcggtcaggagttaaagaccagcctggccaacatggcgaaaccccatctctactaaaagtacaaaaattagccaggcgtggtggcgggctcctgtaatcccagctactcggtaggctgaggcatgagaatctcttgaagccaggggccagagactgcagtgagccgagatcacaccacttcactccagcctgggtgacagagtgagactccgtctcaaaaaaaaaaaaaaaaaaaggaaagaaaattaaacacctcatgttctcactcatagtgggagttgaacaatgagaacaacatggacacaggaaggggaacatcacacaccggggcctttcgcggtgtgggggtcaaggggaggagtagcattgggacagatacttaatgcatgcggggctgaaaacctagatgatgggttgatgggtgcagcaaaccaccatggcacatgtatacctatgcaacaaacctgcatgttctgcacagaactgaactgaaagtataattaaaaaaaaaaaaaaaagctgggtgcggtggcccacacctgtaatcccagcactttgggaggccgagacgggcggatcacaaggtcagcagatcgagaccatcctggctaacacagtgaaactcagtctctactaaaaatacaaaaaattagccgggtgtggtggcgggcacctgtagtcccagctactagggaggctgaggcaggagaatggcatgaacctgggaggcagagcttgcagtgagctgagaatgcgccactgcactccagcctgggggacagagtgagactctgcctcaaaaaaaaaaaaaaaaagaaagaaaaaggagcgttgcttgtttcaggccacaggaaggggagagatagtgaaagtttttcag

SEQ ID NO: 19872 - DNA, 1056 bp, Homo sapiens
cttcccacccttcccaaatgtcacagtggttgacactcaattggtgctaaggccattttgtcaaatgaacagctttctcagcatgtggtccagtcaccactcaatcagaataccccaaatgtgaagcaaagggatctgcattttagcaagttttccaggtgatacaccctaatgagacactgggaatgaatgggtgagtgagctgcaggtagcagtgccacagacaggaggaggaaactcaagcatggcatgggtcttggaattttccatctgcctctgatgccctctggcactgctcgttctctggagtggtttcctggtggcttattctctggacacatgccagcccttggagtgactattgtgcttgcctgtttcttcaccttcatgctcccctcaccatcaccataggccttaccagttgaaccctttctgccaccccctctggggatactgtacttagggacactttttcccaaactggcccatactctcctccccaataaaaagatctcactgttcttctgggctccttccccaggcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgtaacccctgagggagactggcagagggagtggatgggggacggggaaggccattttgagggggctgttggaagtaccatggccccagaggagagaagtgggggctcagggtggtgggaagaagcaaggaggaactggttctcagtttgcccgctgagtcggaggaggaggagcctgggtaggaaggggaggatgggggggcaggttggatgtcagggtcttcctctcactccctccttccctctttttaccctttcctctttaccccaggacctggaggaacttgctttgtaccagatc

SEQ ID NO: 19873 - DNA, 1022 bp, Homo sapiens
gatggtgtaagtgtcctatatttatctttgtgttcttgagcagtaggtcctctgtcctctgtttccttgtcagtttaagatgtacagagggaacagtgggatttggatctgggaactaggactctgttacagacatgatgactctagtatagttcttttatttcttatttatttatttatttttgagaaagggtgtcactttttttgcccaagctggagtgtagtggcgggaatgctgctcactgcagccttgacctcccgaactcaagcgatccttcctcctcagcctcgcaggtagctgggactacaggagtccaccaccatgcccactgatttttgtattttttgtagagatggggtttcaccatgttgcccaggccggtctcaaactcctgagctcaagtaatccacccgcctcagcgtcccaaagtgctgggattacaggcgtgagtcactgcacggggactccagtatattccttttagaccctcagtttcatttacgacgtgaagtgaatgtgctaatgctactgtcagtgttagagtgagtttcaaataaaagagaactagcttaggccaggcaccttggctcacgcctgtaatcccagcactttgggaggccgacgtggacggatcatgaggtcaggagatcaagaccatcctggctaacaccgtgaaaccctgtctctactgaaaatacaaaaaattaactgggtgtggttgtgggcccctgtagtcccagctacttcggaggctgaggcaggagaatggcatgaacccaggaggcggagcttgcagtgagctgagattgcgccactgtactccagcctgggcgacagagcgagactctgtctcaaaaaaaaaaaaagagaactagcttcatcaggttacctggtttttcccatggctctgaacaagactttgcttatatttgtttgcatgtcttgagtagtgttatgggatatgcagttctcgctatgtaactgcaattgctatctttgctttgcatctctaacacctagt

SEQ ID NO: 19874 - DNA, 1050 bp, Homo sapiens
ctcttatccatgattttgtagcttcttgagagagttccctaggctctggccacatacaccactgcgttttgttgttgtggggacactggagtacccctggattcccctctcccatctcctgagactgatctctggagttaggctgtggtgtcttaaccttggctgtacacttcactagcagtggagcaagtgaatagataccaagtcctgtgagcagtgcttggcatatagcaagtacttcttaaatgttaactgttgctacttttaaatctcttacctctagtaagccgttccagatgcttcctgatggagataaacactgttctgtttctctttggtcatttctcatagctttctgtgatttttctctttataatggtggatcttggagacctgagggtggaaatattttttggacactgcactacctctaacacagggcctaaataggccctcagtgaataacaaatgtaattcttactcatttagaacattgatgatggcacctcagatcgcccctacagccatgctctggtggctggaattgaccgctacccccgcaaagtgacagctgccatgggcaagaagaagatcgccaagagatcaaagataaaatcttttgtgaaagtgtataactacaatcacctaatgcccacaaggtgagcatttcaagaactagaatttaaatttcttctccctgctctgttgaataatgagacagaccttgcagccattccaacaccaggaagggatatcatttccaaaatgttcatcttcaactcataaagtggctatggtttccagttttgcctttgatccatcttttaagtgttgggtaaagattgttttccatccacagtaaacacaggcatggggtctgatctgccctcttccactgttccaccctcaaggataaatacaataggtttcaaaaagtctgtgagtgcgtgaaagcaagtcttccccaattaattttactcacctgttgggccctttagtctggggacatacactgtcttagtacagtgttttgttttgttttgttttttt

SEQ ID NO: 19875 - DNA, 1932 bp, Homo sapiens
gctttgttcttgtgctctttgcaataaatcttgctgctgctcactctttgggtccgcatagcatttatctgctggtaacaccgaccgcagaggtctgcagcttcactcctgaagccagcgagaccacgaacccaccaggaggaatgaacaactccagacgggaggaacgaacaaactccagacatgccgccttaagagctgtaacactcaccgcaaaggtctgcagcttcactcctgaagccagcgagaccacgaatccaccagaaggaggtaactctgaacacgtccgaacatcagaaggaacaaactctggacacatcatctttaagaactgtaccactcaccgtgagggtccgcaacttcattcttgaagtcagtgagaccaagaacccaccaatttcggacacaagaacatccggcttctactgatggaaggccacgactcctcagtagaaagagggcccaggcaaagaaaatgagagagagtccttggggtggtgacactatcttgggaacatggagtgctaggaaacgataactggaagactaggatgaaatctgcaagttaaaaaatgacactacccatatatccttctcatcccattctccttttttcgagaccccgttaaagagatcttggttagggacctttggttttggaaaggcactgtttctcctttttgtcaaacactcaactttcaggccacactttttttttttttttcgagacaaagtctcgctttctcaaagaccagcccaggctggtcttgaactcctgagctcaagcgatcctcctgccttggcctcccaaagtgctgggattacaggcatgagccaccactcccggcctcagcttggataacttggcttgtacaggcctctggtggagacagtaaccaaagttcgggttgccaggtttgtttcattaaagggattttgttgaggctgaaagaaaaaaaaatcgatgtggaggaaaagctaacttgtgccaagacaaggtgagtcagtcacatggacttaacaataatgtcaattatgaaagctgaaggcctaggacccagctatctgactctactggctgtagacctaaggagcaggtagggttaaccatagctttcgtgtttacacacgttcaagattaatgctcttgctgaaagaatttttttacatgccagccaaagagagttccttatggagacctggatatggtccagctaagctagaatctcccacttcctgttttctcttagttggcccaccagctggaggagctccagaatatctaaattaatttccaattgtgtaatttgagaaaaagagacgaagattaatttccctaacgagtagggaagtgtgtttcttttttttcttttttttttgagactgagtctcgctctgtcgcccagcctgaagtgcagtggcacgatcgcggctagtgcactgcgaactctgtctcccgggttcacgccattctcctgcctcagcctcccgagtagctgggactacaggcacccgccatcacgcccagctaattttttgtgtttttagtagagatgggggtttcaccgcgttagccaggatgacctcgatctcctgacctcgtgatctgccttcctcggcctcccaaagtgctgggattataggcgtgagccaccgcacctggcaggaagtgtttcttaaagttggaaagtggtatttcagaatatccgcttttggcagactgagtcagtcacttcattttcctgattttttgcctaaggtcctggtgaattgacaaagattctgcccaaattttaacgaccccagtaattacatgtcatatgaatgaatacttgacgtcagcaggactgcgttttggtggtgaacttggttctaggtagaaacaaagaatggagaaaactgggggataattatcttagggtttcaaaaaag

SEQ ID NO: 19876 - DNA, 1045 bp, Homo sapiens
gggtgtaccctcccctgagctcagcctgtatttctatctgctggccacttaccagccagtcctttcatctacaatgccctttactcacctagaaagctcacatcaaaagtcgcctcctccagaatacctctcaagttctcctctctggtcccttgaccctttgcaggtaccttttttcttgtacaagtcacatgataatgtaaggggtttttttccccatctagagcctgcctggtgggctcatggtccatttgtggaaacatgcatttccctctcctccgcccccctccttcatgatccatgctttaagagcttccccaaggcatgcagagcaagctgagaagaggtagacaagcctgcagacctttcaaagaagtggggtggcttgggaagtaaaagaagatctggagataggagttcctaaaaagcagacaagagattaccgaggggttccccacagctccagcacacagcagctgcaaaaaaaatgcagtggaattactgagggacattatgggcttgatggaggacagggaatgcttgtgccaagccaccaaggatcatgctgtggcagttgtgaccagatagactatacttttgccaaggtgaaaggatttccctactaaatcctttactttccactttgtttaaaatgagtttaacaccaagaaaatagttgtctctatgtccttatttctaatcttcctgctcaaccatgaactgcactaaacacactcagacccatctaacctaaaattgagaaagggaggttctcactcctggagagagaattactgaaagggcggccctcatacagttcagggtcatacccccaatagctggttttatatttgaaagcagacactgggactctgacctttgcagagataaaagggatactttcctaacccagagaggccaaaggagcacaggacgcccaggccgagggcagtgaagcttgcagacccaggctgtgcaacccccacagcaggtctcctcacgggatagatagactattggccccaattcctcagccctacatgca

SEQ ID NO: 19877 - DNA, 1031 bp, Homo sapiens
gatccgcccgcctcagcctcccaaagtgctgggattacaggtgtgagccaccacgcccagcctgggactgtgcatttaagatcaccccaagtggctgggcacagtggcctctgcctcctgggttcaagcaaacaaaaagaaagagcctaggcaacctagtgaaaccctgttcgggctgcggcctatctgtaccccagctattccagaggctgaggcaggagggtggatggatgctgggaggtggatgctgcagtgagcagtgattgcaccactgcactccagcctgggtgacagagccagaccccgtcccaaataaataaaaataaaggaaccagtttgtagaaagcaggagagggtcccattgaacttcaagccttcaagctacagctgtggctggacaggttggaccagcaggctggagcagtcgccatcttggcagggatcattgaccctgatctatcatcgggaggaagaagagctgatcttatgcagggagggcaggtggactatgtgtggactctggtgatctgtttgggtgccaggtgttactcccagggccacccataactgtgaatgtgcaggaaccctgacttaggttcctggggaatgagagtttggttcccggtacccagggaaaccaccagcatcggcagaggtgatagctggggaggagcggggatttggacgagagacacaggatgagtaccgggggcagccctgtgatcaacaactgctgcaagaggggccgtttgttcgactcactagtcttctgtggctctatgcggtactaaagagcagaagacagaagatacaaaaaccacaaaaattagccgggcgtggtgctgcgcgtcaataatcccagctactcgggaggctgagacgggagaatcgcttgaatccgggaggtggaagtttcagcgagctgagatcacgccattgcagtccaacctgagcgtccgagcgagactatctcagaaagtaaagacagaattaaagtgcccagcgcagtggctcacgcctgtaatcccagc

SEQ ID NO: 19878 - DNA, 1050 bp, Homo sapiens
ggcacatgcctgtagtcccagctgctcgggaggctgaggcaggggaattgcttgaacccgggaggcggaggttgcagagagcctagatcgcgccattggactccaggctgggtaacaagagcggaacctccgtctgaaaaaaaaaaaaaaaaaaaaaaaaaaaaaattgggagaattttgctcccactgccgtcaaaatcccacgtgtatttcacacttaacagcgcagctccattagaactgaccacatttccagggctccctagatacctgtggctagcggctgccatactacaccgtgctgggctgtagaatggggatgacaagacagggcggcggagattgggttggcgtgaagcgagggaaacactcggccgcaggacaaaactaaaacagcaagggggcaccgaaagactcagtagtccacgtgaatatcttgattatgttgtagctgagataatgtagggtccacccctaccgggtctctgggttttctcttcgcgtgtgtgcggagacgagagatcgaagagataaagacagaagacaaagagataggaagaaagacagctgggcccgggggaccactgccaccaaagcgcggagacagacaggtagtggccccgagtgcctggaggcgctgctatttattgtagtcaaggcaagggggcagggtaaggagtgccagtcatctccaatgatcgataggtcacgcgagtcacgtgtccactggacagggggcctttccctttgtggtagccgaggtggagagggaggacagcaaacgtcagcgtttcttctatgcacttatcagaaagatcgaagactgtggtactcctactagttctgctactgctgtcttctaagaacttaaaaggaggagccaggtgtacaggctgaacatgaaagtgaacaaggagcgtgaccactgaagcacagcatcacagggagacagacgttggagcctccggatgactgcgggccggcctggctaatgtcagacctcccacaagaggtggtggagcggagcgttctctgtctcccctggagaga

SEQ ID NO: 19879 - DNA, 1038 bp, Homo sapiens
agaagttgagagctctacagcagggctgaacagggatagggttcagggcctcattaccaggcagggaattgagagcctcttcaccgggctgtgtagaaattggagcctctgtaccaggctgcatgaaaacatagtttagagcctctttttcaggctgcatcatctcattttctatctgcatagctggagagttgagagtttgaggaaaggtaggagggtacagctgtgatggctgttgataatatctttcagctggattttgctggttgggggaaataaattcattcagatcagttaaaagttcatcataaagcgataaccggggcatggtaggctctggcgtaggtggtggcaccaaaggaatatcagagtggaggtccatctgtagaactatggcctcaatctgtgcagtatcctcaggtgaaaaagaactaagcacttcctcagcctcctcagaggaaagagggatcagtctccatgttgtcctcctgagtctgtaaagagtctaggacagagcgaaccgaagcccagattgaccaaattgggggtggaataatatgcccgcctttatgagcaattttgaatgtctgccaatctcatcccaatccttaagttctaaagttccctcagtaggaaaccaagggcaaagaagatctacaacatcaaacagttcaattaacttatcagtagatacttttaaccactccttctttaaggagagtttttataaaatttaaataagctgagtacttagtacaggcctgtcccttggtgtccccgggatactctgagtgcccaagcttaccaccaagcttattgacctcaatcctcaggaatctgtcattgaaatcctctgctgtgtttcacgctcaaagtgcaacttcacacagcgagagagaaattctcgttgggcgccagatgtagggtccaaccctacagggcctttggggttttctcttgtgtgtggagatgatagatcatagaaataaagacacaaaacaaagagatagaataaaagacagctgggcccgggtgaac

SEQ ID NO: 19880 - DNA, 1026 bp, Homo sapiens
ggcttcaagggagcctgatttgtagaaaaggaaccaggcttcaagggagcctgtgactccaagggagtccgattagcagaaaaagaaccaggcttcaagggagcctgtgactccaagggaatccgattagcagaaaaggaaccaggcataagaaaactaggctgtggagggatagggctgagggcctcattaccgggccgagaattgaaagcctcctcatcaggctgtatagatatcagagcctctgtactctgggctatcgagctgcatggaaacataatttagagccctgctttcaggccacctgatctcatctgctatctgcatggctgcagcattgagagggtgaggaaaggcaggagggtctggctgcaatggctgctgatacatttcagctgcgttttgctagttgggggaaataagttcattcaggtcagttaaaagttcatcataaagtaataactggggtgcagtaggctctggcgtacgtggtagcaccaaaggaatgtcagagtggaagtctgcctgtaaaattatggtctcaatctgtgcagtatcctcaggggaaagagaactgagaacttcctcaacctcatcagaggagaggaaacagggatcagtctctgtattgtcctcctgagtctgtaaggagtctaggacagcaaaccaaagcccagattgaccaaatggtgggtggaataaaatgtccccctttatgggcaattttgaattgtctgccaatctcatcccaatccttaagttctaaagttccctcagtcagaaaccaagggcaaagaagatccacaacctcaaacagttcaattaacttatcagtagaaactttaacccttccttctttaaggagagtttttataaaatttaaataagctgagtacttagtactggcctgtcccatggtgtccccaggatactctgagtgctcaggcttaccaccaagcttgtcaaccgcaatcctcaggaatcttttgtcaaaatcctccactgagtcccatgctcaaagtgcaa

SEQ ID NO: 19881 - DNA, 1052 bp, Homo sapiens
gtttttcctcagttaaaataacaaacattaatactaaaaactaataattgataatatccatatataatctctatatcctatgtctaatataactttcttttatcctaactattttctttattatattggagcagcttatgccttcagtctctttcctcggcacctgggtggctttctgcccacactgactgagccaagtgaatggaaagtaagtcacactctggtgatatacacgtggtaaacgtgaatgcagtgatcttcataccatatctactgagccacgtgaatcaaaaaatagactcagcagagtgatgttcatgcggtaactggaagtcaatcatcttcataccacatctaactgagtcaagtgaatcgaaaattagtcagactctggagagcaaagtacatgtcataaatttaaatgacaggctctttatacccctctgactgagccaggtgaattgaaatgtagttagactctggatagtgacgtacatgtgacgaatatgaatgcagtgatattcataccgcatctgactaagccaagtgaattgaaaagtggtaagactcctaatagtgacatacacgccatgacattgaaggcagcaatcttcatactgcatgtgagtgagccaagtgaatcaaaaagaagtcagactctagatagtaacgtacacacagaaaacttgaatgcagcaatcatgttacaggaaaggggccccaatccagaccccaagagagggttcttgaatctcacacaagaaagaattcaggatgagccctcagtgcaaagtaaatgcaagttttttaagaaggcaaagtggtgaaaaaacagctactccatagacagaataggacattcccaaaagtaagaggaggaacacatctatcctaggtacaatgcttgtatatttggggagatgtgctctgctacaagggtttgtgataaaagattaatgttctcaattactgtattttgcaagaaccgatattatcatctttgaagcaaaattaggaatgcctttgttctccagatatcgacatatctggac

SEQ ID NO: 19882 - DNA, 1034 bp, Homo sapiens
agtcaaagtgctgtccttcactgggaccaagaccagcctgagcatgaaggtaggtgagatggtcagcctgttcttacatgtgatggccaagggaatggaagaggacagcaagtgagacagctcccttgtttttgtgccttaggatgtggatcaagagactggagaagatctaaacccaaatagacggcgaaatcttgtcggggagaccaatgaggagacctcaatgcggaatcctgatagacccactcacttgtcccttgtcagtgctcctgaagtagaggacgactcactggaacgcaagcgcctcacccgaatctctgacccagagaagtgggagatcaaacaggttggggcctttagttttcatgaccagatagtcattcagcatgtagcatggtgcttaggggtgtgccctggagcacgatggcctgggataacttttggccactgtattagtctgttttcacactcctgataaagacgtacctgagactgggcaatttactaaagaaagaggtttattggacttagaattccacttggttggggaggcctcacaattatggaggaaggtgaaaggcatatctcacatggcagtagacaagagagcttgtgcagggaaatgccctttttaaaaccatcagatctcatgagacttactcactatcgtgacaacagcgtgggaaagagctgcctccatgattcagttaccgtccactgggtccctcccacacacgtggaaattcaagatgagatttgggtggggacacagccaaaccatatcagccacttattagccgtgtaatccttagctaagctactctacctcatgcctcagtacccttttctataaaacaggaccagtgttggtggtgtgaggattaattaaaggtgaaagtcgttgggcgtgatggctcacacgtgtaatcccagcactttgggaagctgaggcgggcgggtcacgagctcaggagttcgagaccagcctgaccggtatggtgaaaccccatctccactaaaaatacaaaaaatta

SEQ ID NO: 19883 - DNA, 1031 bp, Homo sapiens
cagtaagccgagattgcaccactgcactccagcttgggcaacagagtgagactctatctcaaaaaaaaaaaaaaaaggcagatggacttgagtaatgttaaagagttaaaatggacaagacttggtgggtactagcaggtaaagggaagaagggtgagggaagtcaggcatgactgtcaggtttctggcttgggcagctggatggaagatggcactgaggagggaaacatgggaggaggcttgagtggaaagatggtgaatttctcccctattctattcctaataatgagagttctttctaagcagggcttctgtagttctgtagcaggtagaagcctttcaggaccagtaagatgctggcatgatgcgtgatattccggtgcccccagtgatgatttttccaagcaattgtgttttattagctgaacctttgggtggaagaacagtgacagtgccaagctgagactaataatcctccagatcacatagactgctacacacacgcaaactgtgaaattcctgtgtcatctcatggttcattttatgatcagtaaaaagaagcaatctccctcttgttccacatacatattccgcaaaatacaagcagctcattttttagtccagatgtctcggtaggggaaagaaaaatctcattttgcattggcacatgtgatgccaggaaatctctgctttcccagggtgctagaaaattaaaattgtagtaatcaacattggatctagaaaatgagatacacagtagctatttgcaccaaatgaaattggcttttattggctgtagctttttcctattccactcacctctcaggtaccatcccttttccaacttaaccattaagcagaaggtacctcccttctgctgttggaggctgagctgggattaagtgtcattttaaccgtctagagagagagatagccacatattcctttgggaagatatctgggttcagaagaccttttcacacctcagggctgagcctgggcacctcactccagctttgcccctcttgcct

SEQ ID NO: 19884 - DNA, 1035 bp, Homo sapiens
tgtggttagaggtgtgcgggtgcttcagtattggggtgtggctgtcataaacagactgcagtcttataggtgtcaggcaggagaggtaatagtataaaatgtaagctcagctgaggcctactagggaccaggttgactgtagagtggggcctatatccagaggcttgagtactatctctgtcccccctcagggtggtgtaccatgagctggtgctcaccaccaaggaatacatgcgtgaagttaccaccatcgaccctcggtggcttgtggagtttgccccagccttcttcaaggtctcagacccaactaagctaagcaaacagaagaagcaacagcgtcttgaacccttgtacaaccgctatgaggaacccaatgcctggagaatatctcgagctttccgacggcgctgaaaggcaagattgttcctttgcctctccagcagcagtagccagggcttggacttatcgatgacaggctggtcctgaggatacagctgtcccgtgactgactgtcttaactgagcattttctcaactcgactctcatttcttccctgctggtaaaatagaaacagggatttaaacctggctttggcaagagcctgcagcctccatcaccccaagtccttgggcccagttgggagctcatatctaacacagagacacattgcatcaacttcaagaaagggacaatttgtgcagctccaggatgggaaggtggagtgggtgagcatcttgtgcagggacatggtgagtgccctgatgccccagctagcaggagctactgtgctcatctaaagtgtttgccccacttcccaccccgtctccagcccctgtactttggcttgacctcgtggaaatatttattttcttaaggaaacaaaaatggttttctgtgactgttttcttttagccgaaaggttaggatattggcctgggctcagggtgagggagatttagtatctgtgctctggcacacatgatgagaatcccctgaatcccctgaaaccagaacgcagggcctctttgcgctcgg

SEQ ID NO: 19885 - DNA, 1031 bp, Homo sapiens
ctggcggaacatcaggcaggtcttgccaggccaggtttcggaacttacggaaagctggtctggatgtagtgcttgtagagaagcttctgagagattgggcacatcctgttacgttgctgcttctcctgtccttatgttattagtaagttctgaagtgatgtaaatgctagaactactgtagaactgtatgccagacactaagagagactatgtaacattccaggatataaaggaatgtatgttgtcactgggcagcaaaccacaccctaaagacaattcagaaagagtccgagggagaggaatataggccaggcaatctgctggctgcagatccctgccccttcattaagctgagtgcctcctgattctgtctgagtattcgcctttgtaagcccaggccagtaatcaaggggcagggcattgttgtgtgttaaccttgaaggccttctggggagagacagtacagggacctcaaatgaaaccaaaggggaaacggggactgggcacccacctccccaatctcgttttgtttttgtttttgttaagacaggatcttgccatcttgcctaggctggcatcaaactcctgagctcaagtgatcttcctgcctcagcctcctgagtagctgggactacaggtgcatgccaccacacctggctcccagtcctaattccagcctaaattttccccattcagaaacactcctggatatagtggcccagcctgtcctgactgagtgcccagcactgacaatgttgacacctggggagggagggttgggtttcaagctgaggttgaaaagggatgttgaatgggctaaggataagagacagcagggttcgttatcttttctggctcaggtggaggaaaaagaaggatccccattctgtgggtgttccttgaccatctctctacgctagagctgaggtcacttctctgctatgacaacatagctgggttctgaccttttgaccatcaggaaagcaatgtcagcagctgagctgagcctgctctgagggagaagggggggg

SEQ ID NO: 19886 - DNA, 1764 bp, Homo sapiens
cctagtcctgcagacaggacctgattttaaaaagaaaaaaaaagagtatctgctgaatgaaacctgtgatacgcgacaagattttcacgtgcttcaaatgccaaagcaatcagaaaaaaaaaaaagaaaaagagaaaaaaaagatgtcacataccattttctggccttggagataaatgagaggagagactgtggccattgtactacagtttttccgaggggatttgcctttcctctctcacccttccaccctgtttcaatcaagagtctgtagcaaggtagacctattcatacaggctccccctctgctctgtggtaccagattgttgctagttcccaggcatctgtggaggaggattttgggcgagggccctggctgaccatgaaatccacgctaggcctggatgagagagaccctagctgcttcctctgtacctacagcattgtcatggtgctgcgcaaggtaaggattctgggtgctgagacccaaaggaaagaccatttttctccctctctctgacctactgccctactccaccttaggaaggggctgtttgctccctcgtaccctatacaagtagcagcacgaagcccctttggttgtatcttccacttacctaccttttcactgtcatccataggattgggcccaggtggaaggagagagtgggttatggtatgcctctgcacttccaggccctgggtggggtggggtgagcacactgccaccctcaaatctccctagtggttaagggttgtgtgcagagacatgccagtacatgtgccaacatatccctgcctgtgactgttatgatggaacattgtgtaaacacatataaacaaaagaaagtgctggacacagtggctcacacctgtaatcccagcattttaggaggctgaggtggaaggatcacaaaggtcaggagttcgagaccagcctgggcaacaaagcgagaccctgtctctacaaaaaaatacaaaaaaaaaaaatcagctggatgtggtggcacatgtcttatagtcccagctactagggaggctgaggccagaggatcacttgatcttaggaggttgaggctacagtgaactatgatcgtgccactgccctccagccggggcaatagagcgagagcttgtctcctttaaaaaaaacccaaggccgggcgtggtggctcacacctataatcttgagaggtcaaggcgggcggatcacctgaggtcgcgagttcaagaccagcctgaccaacctggagaaaccctgtctctactaaaaatacaaaattagccggacgtgttggcacatgcctgtaattctagctactcaggaggctgaggcaggagaattgcttgaacctggaaggcagaagttgcggtgagccaagatgtgccattgcactctagcctgggcaataagagtgaaactccgactcaagaaaaaaacaaaaaccaaacaggtcaggcggggtgggtcacgcctgtaatcccagcactttgggaggctgaggcgggcagatcacttgaggtcaggagttcgagaccagcctggccaacatggtgaaaccccctctattgaaaatacaaaaattagccaggcttggtggcacacgcctgtaagtccagctactcaggaagctgaggctggagcatcgcttgaacccagaggcggaggttgcaatgagccaaggtcgtgccatggtactccagcctgggcgacagagcgagactccatctcaaaaataaaaaaataggccgggtgcggtggct

SEQ ID NO: 19887 - DNA, 1048 bp, Homo sapiens
cttggttcactgtcctgcaggccggggatgaaaggcctggacagggtccaccacccactctcccactgccacggccgtggttgactgtctttgcctccccttttcagaggaaaggttatcaggacaggacgcagggagccagaagaccatctgaaggaagcctgcttccaacgggcccagcctccagccaccgctcctggggcagcgccattgctcctggctctcaggctgccagtctcccacaccgacgctctactgcccgcatctcggccagctgggtcacccagcccctttcgactctcccctggcacgcagccttctccttcactcggcctgcctcgctgctgctgtaattcctcttgtctcctgggagaaatgagattgctttcccaggacttccacatcccacttctatcaggtttcaccaacagggaggaagccctgtcaagatctggtgtgtcctgttttttttttttttttttcccagagggcactggcatgtaggagaagcggatttaccactagtagatgttaatgaaatttcagcttctaggcccctaacttgcaggacctgcccaaggccctgaacttaattttgttttcatcatttggtatttttttgttaaaagagccaccgaccacctccccgctaccccagaactgcacgtgtttctggccctacaaacccagatcgtcccttggaatatacacagggcaatttgtgtaggatcacactgcgctaaaagtgaggcatggtgggctaggcgcactggctcacacctgtaatcccagcactttgggagaccaagacaggaggtcttaagtgattaagcccaggagttcgagatcagcttagacaacatagcaagatgctgcctctacaaacacacacaccccctattataatatgtcaaaaaaaaaaaaaaaaaaaggaaaagtgaggcatagaactgactttattgttttgactaggaaagagcaaagggtttggaatcaaaagtcccaacttccccaccttcttaatagtgtgtgaatctgagtgccttat

SEQ ID NO: 19888 - DNA, 1029 bp, Homo sapiens
atatgtgaaatttatttgaatagtgtaaaattccatataaatatacattaacttttttcagagattggggacattaagactgaaatttatttatttatttttgagacagagtctcgctctgtcgcccaggatggagtacagtggtgctatcttggctcactgcaagctccgcctcccgggttcatgccattctcctgcctcagcctcccaagtagctgggactacaggcgcccatcaccaccacagctggctaattttttgtatttttagtagagacagggtttagccaggatggtctcatctcctgacctcgtgatccgcccacctcggcctcccaaagtgctgggattacaggcttgagccaccgcgcctggccccaagactgaattttatatataatgtattaaaaataacattgctagtatccacataatgcttatctattcaaaaaattacaaaaaaactacaataattataggtattttataccacagaccagcaacaaggagccagagctgcccgatacctgttttgtaaataaagttttattgcaatgcagccaaacccatttgtttattgtctatggttgatttagtgctgcagcattagagttgaagagttttgacagcaaccttaatggccagctaagcctaaaatatttactatttggccttttgcagaacaagtttgccaatccctggtataaagcaagcttaagtcactaagtctgcatttgaatgtaattctcccaactcttacatctgtgttatttccgctttcttatttttctcatattctacaacaaatgaagttttgatgtgtctgataaacatttcttaaaactttcagagtgaagacaatgtagacctaaggcagacctatactccattttcttcaacagaatattcaagttctgtagattcttcacttttctgtgcaccatggtctacttatggagatgacattaaacaaccttctaattctcagatcagtataaagaacaggtaaattaattcatttctcaaggta

SEQ ID NO: 19889 - DNA, 1046 bp, Homo sapiens
gggccgggattggtggctcacgcctgtaatcccagcactttgggaagctgaggtgggcagatcacaaggtcaggagttcgagaccagcctgaccaacatggtcaggctgaaaatacaaaaaaaaattagccaggcgtggtggcacgcgcctgtagtcccagctacttgggaggctgaggcaggagaaccgcttgaacctgggaggcgaaggttgcagtgagcagagatcgcgccattgcactgcagcctggggaacagagcgagactccatctcaaaaataaataaataaataaataaacaaacaaaccaacaaatagatgtacaggttgagcatcccaatctgaaaatccgaaatccagactgatccaaaatccaaaactttttgagtgctgacatgatgctcaaaacaaatgctcattggagcatttcagattttggattagggacgttcaaccaaatatacaagtatacattatatatttggagtataatgtatatttccagaatccaagaaaaaaacctgaaatccaaaacacctctgatcccaagcattttggataaggaatactcaacctgtattacttcaaggaagaaattacccaaaaactgtaacaggtaaaaggtaccaatcttccacgtgcttgtggtttttacattttgtatttagtcagtatcagtcactaggtggatttctgggataaaaggaactccatccagtcatgctttgcaagcattagggatggctcccaaatctgttacatttaagcgacaactgcaaaattgctgtggtgtctaggatgaccatatcgcatttcacttttttatccaatattaatatagagtcacaaaaatagaatagagcatcaggttcatatggttttcaaattgcaaatgaggaagctgagcaggtgttgatggaataatgtataataagacaagacttgctttcaggagcagctatgataccaagcatgtctgtgacatcatagatgacagatttatatcttggtcacctaaaatgaaaaccatgtgttgtggagaaata

SEQ ID NO: 19890 - DNA, 1053 bp, Homo sapiens
tgctgttcccaggagtcgcgtttctgtgcgcgttttgggagacagtagtgggcgggaggcatggaagttccaagggttggtgaagatggttgagttgctgttatgtcctttctcaggagacgattgcctcgagctggagagttccatggctgagagtaggctccgggccccggacctaggtgggtaacaggacagaactagggacgtgaggtgaaaattgccccagggtctcttggagaagaccgaaaaatgttccccctgttggagttttcgatcactcagtgtttttatgtacttatttattcattttatttattgggatggggtcttgctgtgttggccaagctggtctcaaactcctggcctcaagcagttctcctgcctaggcctcccaaaatgctgggattacaggtgtgagccacttcaccaggcccacttagtggttttatgtgtgtgtgtgtatggacgcagcatcatagaccgttttgggattcatgataaaggtcaagtaagagtcatattatgaacaagattaacagacagatgtggagtcaggatagagtgacttattaaatatataaattaatacattcatagttgtttacaataaaatccttaagttaaacactgctacctaattaggtaagtattttagcacatggcacttccctccgtactgcccctttagttaatatcatctagttggccgggcgcggctgctcacgcctgtaatcccagcactttgggaggccaaggcgggcggatcacgaggtcaggagattgagaccatcctggctaacacagtgaaaccccatctctactaaaaatacaaaaaattaggcgggcgtggtgaggcgtgcctgtagtcccagctactcaggaggctgaggcaggaaaattgattgaacccaggaggcggaggttgcagcgagccgagattgcgccactgcactccaacctgggcgaccgagcgagactccgtctcaaaaaaaagaaaaaaaaaataccgtctacttttacttctggattgttaacagatatgccatcggcttg

SEQ ID NO: 19891 - DNA, 1043 bp, Homo sapiens
ggcccattcaggagccaacaagttcactgtccccttttcctcttatctgtctcgaatacacatgcatattcgccctaagctaggcggcaacactgccatgatgttaccctgctgactctggttaggggctgggcactggcaacagggcaggcagtgactcactcagcacagctagaaagcatcctcctgcctggcacccccgtgtgaatctcggccctcttttccctagtttactattcactgcagccccccaatgtctggtttggggatctgtctaatttctttttacttaaatggcttccctagatttagattctaaggaagaagtgaagaagtcagcaagccttgtttgcttattatcttgtttggaaggttccaatttcaccacatctgagcttctgagggtaagggcattggcttcacagctgtctgtgtgtgcccagggtctagtctgtgctattatagcacacagactgagctgtcagtgagggccacctggcttcaggactctcttttcaaacttcttactttgctcctctttattgttttctaggagtttccaggtgtctaggaaaatgccagaagaactcaccaggtgccaggaagcatcccttttccggaaagtccttttacttggatctgcctgctggcaagaatctccagtttttgacgggggccattcagcaactgggtggggtaggtaacctgctcttctcctgcgatgccatgtgcctttgcaggcttagagcaggagttggatggggattatatctatggtttccaagtattttcttttttgagacagagtcttgctctataacccaggctggagtgcagtggcatgatctcagctcactgcaacctctgcctcccgggttcaagcaattctcctgcctcaacctcccaggtagctgagatgacaggcacacaccaccacgtctggctaattttttgtattttagtagagatggggtttcaccttgttggccagggtggtcttgaactcctgacctcatgatctgccaacctcggcttcccaaagt

SEQ ID NO: 19892 - DNA, 1132 bp, Homo sapiens
ggagtttgagaccagcctgaccaacatggagaaaccctgtctctactaaaaatacaaaattagccgggtgtggcggcacatgcctgtaatcccaactatgcaggaggctgaggcaggagaatcacttaaactcaggtggcagaggttgcggtgagtcgagatcacgccattgcactccagcctgggcaacaagagcaagactccatctcaaaaaaaaaaaaaaaaaaaaaaacattagctgggggcagtggcacatgcctgtagtccagctactcaggaggctaagctgggaggattatctgagctcaggagtttgaggctatagtgagctatgattgcaccactacactccagcctggatgacagagcaagaccatgtctcaaaaataatgttaaaataaacaaacatattatctgttcactctagaaattttagagaacatggaactactccaagtgacaaccagcatttttaagtatttttctttcctcccttcctctcataatggcttaatttagatataattcacatgtcataaaattcatccgtttaaagtacacagctcagtggtttttagtatattcacagaaatgtgtaagttgtatgatcgcatagtcaattgtagaacattttcatcaccccaaaaaggaaaccctgtacccattatcagtcactccctatatgcttgggcaactccctatatccttgatactcctagcccttggtaatgcccatctaccttctgcctccatcctgcctttgtttttttgtgcttcttttttttttttttttttttaagagggggccacactcagtcacagaggctagaatgcaggagcgcggtcatggctcactacagcttcaacctccccagactcaggtgatcctcccgcctcagtctccctgtagctgggactacaggtgctcgccaccatgccctgctcatttttgtattttttgtggaggcagagtgtcgccatgttgccccagactggtcacgacctcctggattcaagtaatcctcccacctcagcctcccaaagtactgggattacaggcctgaggcactgctactggccctttttctttcttttttttgagacggagtcttgctcttgttgcccaggctgg

SEQ ID NO: 19893 - DNA, 1115 bp, Homo sapiens
ccggttcccaagggtcggtcccaccaaccttgcgccccttctttcctcaaagcgtggccgaatgcctaggcttccgggtatcagtggccccgcctcttaatccgaccggagccgtccctcgtgattcctgggtattgtagtcagtttcctgggaaagagtcgctcctagtggcagctcgcttcgccagaaaaactacaaaacccagaatgcagcgcaaattccccttgtccaataggaaccccccatgtagtggggcgcggagccctgctctcgcaactcaagatggcggacgagagtgagacagcagtgaagccgccggcacctccgctgccgcagatgatggaagggaacgggaacggccatgagcactgcagcgattgcgagaatgaggaggacaacagctacaaccgggggtaacgaaatcctcggagtccaattcccgtccagcctcccacaacctgggtctctggggtgcggggaagtcaccgggagcttagtctagccccaccctcatgttcttattggctaagtcactaggattctgcctggcgattggttattgcctttgtcatttaccaagggtgggtgctctggatattaagggccggagacgttcagtacttttattatataaaagttctatgcagtgttccactcgtgtgcttcaggccattcctgggaaaagagcatgttggacgatggttttcgatggtacaacacaggacagtctagtaacagtacagttcaaagggaacgttacttatagacgtgttgtttgaacaacgtgactagcaataaacgaatcataaaacatttcgcagcagttcaccctcagtgaggaaactcatcagactatacaaactgtatgtataattatattgtaaaatatcactaccagagaatcccaaaatataaactcaccttataaacctatgtaattaacggtatggtaatgctttgatttacatagtttccattgctccaaataatccataagtatcctgaacgatatattaatataattaagtcttcgaacatctttgccttgttacctttgcagagcagccccaggcttcaagaaatgagcgatgttgtttcttggagagtatttgga

SEQ ID NO: 19894 - DNA, 1072 bp, Homo sapiens
gcaaggaattttagaggctggaggttctagaactgaagttttaaaagcaattcctgcactgggaagcattgtgtcaggcactgactgaggcctgtaaactgtgacaccaccctgtttgcagattgccccaaggccacctttgtgtatctgagcctctggggatgttctaccagccccggtatttgctccacaggatcacatggtttcattccactgaagcatttttctagcaaaagcagctgccgggtgggacgctgactggggataaaatcctgggagtatgctgcttttcttctgaatgtaacccacagccgtgtctctctgggaagtactggtgtaatagtgtctgggtgggcagaccctggctgggccctggggtctgtccgcgaagtgctctaagtctagcagagaaagagcagtgagtgtgggatggcatcagtcacagttcagtgagaagcctgtgaggactgttgggctgcgtgggcagaaggtacagctagaaaggccaacctggcccaagggtagaaattcttgtcttctggggtggggagtttgaaacaagggtggagcatgaagggttgtgttttcttagggagtcagcctggggccatgtagatggttgattgatgtagcagtctgagtctgcctggactaggagggaaagggccagaagatacggaagaggcaggccctgtgcctgaggagatatgcacgggggtgcagggagccgccgaatgaccagggattctctcttgagggcctgatctgtccttgccatggatagatccagggtgatcagctcatctcactccatctcttctgtcttgcctccagactcccaagacagctgggctgcgaccaatggaaacaaaggacattccagtagtgcaccagctcctcaccaggtacttgaagcaatttcaccttacgcccgtcatgagccaggaggaggtggagcactggttctacccccaggagaatatcatcgacactttcgtggtggaggtgagtcagggagtggtgttccaggtctctaacacgttcccagagaggcacccccctgagtggccgg

SEQ ID NO: 19895 - DNA, 1452 bp, Homo sapiens
gaggaggcggaggagaactgagcagagcagagcatcgagccaaaggggagatgagtttgtctgtcctctgctgaggctacggccgggcctagggaactgggagcttgggtggaagcgacacccgtggaagtgggaggaggtggcgccgggactttaaccccttgtgggctctgcggcaggggatttaaccctttgtggatctggcccctcggaggcagcgtcatcggtagttttaaccccttcggggctgggtttcacgcactggacttaccctcatcaccttgctcaccaactcctttattggggtgctccgcttggaggtttgaggcccacctccgcccattacgtactgttcctgccgctgcacccccttggacccgctagctggccgcactgtgggcgcttaaccctttactgacttgagctccccagattgcagttggagtttgctgatagaaggactagctaaaggcgtcactgcaggaattacaaactgaagaggactctgttggactgttttttttttctttttcttttttttaagaaaaacccatttttttccttaaggacttactagccaaaatttcttaaacttcgaggactctactagccatggccgagccattcttgtcagaatatcaacaccagcctcaaactagcaactgtacaggtgctgctgctgtccaggaagagctgaaccctgagcgccccccaggcgcggaggagcgggtgcccgaggaggacagtaggtggcaatcgagagcgttcccccagttgggtggccgtccggggccggagggggaagggagcctggaatcccaaccacctcccttgcagacccaggcctgtccagaatctagctgcctgagagagggcgagaagggccagaatggggacgactcgtccgctggcggcgacttcccgccgccggcagaagtggaaccgacgcccgaggccgagctgctcgcccagccttgtcatgactccgaggccagtaagttgggggctcctgccgcagggggcgaagaggagtggggacagcagcagagacagctggggaagaaaaaacataggagacgcccgtccaagaagaagcggcattggaaaccgtactacaagctgacctgggaagagaagaaaaagttcgacgagaaacagagccttcgagcttcaaggatccgagccgagatgttcgccaagggccagccggtcgcgccctataacaccacgcagttcctcatggatgatcacgaccaggaggagccggatctcaaaaccggcctgtactccaagcgggccgccgccaaatccgacgacaccagcgatgacgacttcatggaagaagggggtgaggaggatgggggcagcgatgggatgggaggggacggcagcgagtttctgcagcgggacttctcggagacgtacgagcggtaccacacggagagcctgcag

SEQ ID NO: 19896 - DNA, 1068 bp, Homo sapiens
tttattcataacaatgaagtttatattactaggaaaaaatttcattccatgataaatgtgtggtatcatgtttttcttcaaaatattgaatttaaagaatgttcattgcaatactggcaactaagtccagatttgctttttaaccatggagtaatttctgagaaatatttgttttattttattttattttattttatttatgttatttatgttatttatgttatgttatgttatgttatgttatgttatgttatgttatgttatgttatttttttgaaacagagtcttgctcttgttgcccaggctggagtgcaatggtgtgatctctgcctcctgggttcaagcgattctcctgcctcaagctcctgagtagctgggattacaggcgccctccaccacgcccggcgaatttttgtatctttagtagagacagggtttcaccacgttggccaggttggtcttgaactcctgacctcatgatccgcctgcctcggcctcccaaagtgttgggattacaggtgtgagccaccgcacccggcctctgagaaatatttagattgtacgcctcaaatgggcagggactgtgtcttacacttttgtatttatgctacagcttacctaatacagtgccaggcctcgttaaacacttattgattgctcagacgataaagaacttgctttggaaggaggagaggatagtcatgtgcttctgaatgtattgaacttcttgaaatctctttcctcatcaattttagcagagtttctattgaaactcctagggtgtgtttatggaagacaaactgagatgtgctgtcccagccttaggccctggcagtacgccttgccttttcacggcacacccactacagcctttcccacactgtgacactggagctggtgagtcaaagtaagtataagtggggagcacttttcagtacagtagttttaaggaaagacttgggtctctgaaagccatgtttgcatccctgccatgtccctcactggctgctagcctcaggccactgactcttagcctctgtatctcggagcctcagtttgcttaactgt

SEQ ID NO: 19897 - DNA, 1049 bp, Homo sapiens
tgcatggactctgggattgtgtgtgtctccagacttcttatctgagagtgaagaatctttattccatatgacattggcaattgggtattccattacctgcacctaaagcattcctccctgtagtacagcaatctcacagggttgttgtgagcattaaataagataacaaatatgcaaaaattccaagcctagaacttggtttagtgtaggtgttcaatacatgctaatttcttccctctcctctattttaatctcttaactttagattttttttctactctaccaatctcacaagattgtgctaaaaaacaaatgagatcattgttatttattgccacaataatgctgtataacaaatagccacaaaacctgagtggcataccacaataaacatttctttagcccacaaacgggagacactgttaacttgggtaacaaaggggcggatgcacaggcctgtgaatctactaaaagccattgaattaaatgggtgaattttatggtatgtgaattacatctcaacaaagcagctaaaaagaaaaaaggaggatgattgcagagtagggagaggagggaagaattactaggtggtggtgataccatccatttcctataaggctgctggggccccaccatgcaggaccattcacaaccctgcttgttaaggttttctctgccatccttgaaaataatcactggttgcataacggacgctgtggggaaagattctgctgacagcaattcactctgtggctgactttgctggagcacaagcccccctatcccacaggcccagacaggagctgggatctcagtgcatacaaggaagtagaggcaccagatgagagatgggagcatcatcccagggctgcctccttggccagaaggtggcattaagggcttctgtcctgctgtgtatttggagaggcagaggcatgtgggaaagggagaaaacgttagcgtgtaacagcgacgaaggggctggagcatgggacctacagggaaggatgaaatgaaccggggttatgagctagagaagagcagcagga

SEQ ID NO: 19898 - DNA, 1027 bp, Homo sapiens
gtttttaggattcacatcggttacaggaccgggccatggtctgcccacctgaagctgaccacctggtcactgttcactctcccagccagtctgccggccaaagtccattgaacgcctactgtgtgccgagctcaggagctgtaagtagattaaggacggcacagagcccactctcaaaaatggactgattgcttttaatgtgtctcatcaaatgaaagatgaaattttagactctagatttacacggtgccagaaaagtgcagaaagctgacctgggaggagaagtgaaaaagaagaatggcaagggacccccggctggagagttgaagggcgatggcctgagccagtttcagaaagatttggtgccaatgctgagggccatggccaggaagaagaggaccacgttagagaggtaggttggaactgctttcagggatggggtttagcaagaaactgaggagcaattaagagggaaaaataaaggagtcagaaggaggaggggagaaagaacaagggctaatctgtgtaattatacaaatatacagcttccatttagcaggcctctctgaggggcaggatctgtgctgagcgctttgcataccctgcaaggtacattgttaatattcttattttatagacaggaaactgaggctcagagatattaagtgctttcgccaaggaatacagttggtaacattcaatcagactttaaatcctattctcttaaccactcgaacgtctactgagtgagtaaccaagggatgcttatgagggaacgtgccgtcaggggtgctggaaataggaaccaggctcagctttccctctggaaggctggtatttttggaaatagaaatgctttggagctaatggtttttcctgtaatggtttcagcctgtttggggttttcacgcttcagtttacagtctgagccactggtgtgtactcatttattcctttttacaggaaaaaaaaaaaccccaatgaatttttgatcaaattgagcttgactatttgaccagtgaatcag

SEQ ID NO: 19899 - DNA, 1021 bp, Homo sapiens
cattggtgtaagacactgagatgtagagttgtttgtcataaggcatcgtcacagaaaagtcagcacaccctcccctccccaccacctccatgccctgttggaaaagcatctcctggccgcttatccaggcactttgttgtcaaattcatgccctttgaagggtacctgcttccctgccagacatgctccccgcaaggagagcagaacaagctctccaacttcttccattgtgaaagcccatttatagcatcaaatgttgtctctgccccctaaggttcagtggctatatttttgtagccattgattgggactaggtgtggggaggagcacagtgagaataggcaactatgaatcagttaccctttaaaattgattatgctttaatgtatattttatccaacagaacaacagtttacaaatatttgaaaagcagtatatgaacataaaaggggtagtgtttattccctcactgctgcttacccctcagattcatggactccttgcaatctgagactcatagggactgcggaaagagagtgaattttgttgtgagatcgattacttcccagccacttcaactgcctggatctcagatctcagtttcttcttctgtaaaataagcacatctctgctgcagggttttctgaagtattaaggcgagcacaggaatggtaatatacatggcagacatgggatatactcaacaatcacatctttttaattttgtctctgctgtttattccgccctgtgaccttgggccagatttggagatgactctcagccttagttccttcctctgcaaaatgaggagcatcatacctatctcaggggagacacagagtcctgaacgagaatgcacctggagcacagtcagtgctgaaataattttctccgtcctttcttctctgccagcccctcctgtcttccatggccacatgcaaggcacagcttctccaaacagccttcccaaggcccccactccactcaggagtctcctttaggacaaagctcctctccaga

SEQ ID NO: 19900 - DNA, 1015 bp, Homo sapiens
cggatacttgatcctcatgtaaacacctggctccccggaggcccgaaacccccagagccgggctttgcagctccctgctattccgcctgccactctcagaattaatttgctctcccctgtcaatgagtcaggtccctgcttatcaagagagcaacagctgtgggccaggagccctaacctacctgaggggaggctgggggcctgatccctgcaattggggcctcctgtgtgcacccttgggtccttgtggtcttgaactcagagtcccaagagggcacaggggtgagcccagacaccatgtagtttactccaagactcactgtgtgacctcccagcacattgttgcccctcatctggccctcagcccctcatctgaggatggagagggctggatggcttggcttctaagatgtcttccagctcaaaactcccagattccttctcctgcccctctttcctctaccagatggatttggggtgttaaggttgggggctacagcagaggagtaggaagacccagccagaaagtgactccccagggagtgacttgggaggccagggcagggcaggaggctggggcagccagatctagcagcctcgtgtgtctgtaccatgtcctggccatgggagggactcgggagagggagaagacacactgggaggggcttgggggccaaggggaggaagtgcagaaaggaagaagggcctcttggccaggtcagtccaaggggtgcacagttggccagcccccaatatagtcaggcccattttgtaataaggaaattgaggcacagagaggctaataacctatcggaggtcgcagagcctggaggcagggtcacagcccagggacgataactctcacgatgctgggggctgagtccttctggagcccctaggaaggaggcagcatctgcacatcagaggagcttccaggaggaggcaccagttcctgtcatgtccacttccagagtgatcctcgtgtctgggcctacctgcccccactccccagcgc

SEQ ID NO: 19901 - DNA, 1120 bp, Homo sapiens
gagtggcccgtgccatgtccatccccacctccccaacccgtgtcagctttcacagcatcaagcagtccacagcagtctgagctggcaggtcatggagcagcccccaaagagctgtggctggggggatgacggccaggctccctgaccaccctgcctgtggaggtgacctgttaggtctcatgcccactcccccaggagcagctggcactgacagcctgggggggccgctctccccctgcagccgtgcaggactctagctcatgagtggaaagtcacctacaggactgggccgggcccagggcctctggcttccctgcccaatcctccctggagaagggacatgggaatgaattgaaatggggcgctggacacctacagcagcacgcatgtccctccaaggctgtcttctcccagagcacaagaaggccagcccactgggccctggggctgccctcggcaaccgtggggaggccatttgctgccctggggcatcatgggcaactcgtgacagcctctgactcaccacgatgacgcctctggacctcggtgatgccttccgacaccactgggaaccaagggccctcactcaggaaccctggagacagaagtcaggtgtcatcatcagacttgcggccacagcactagagtcacccccccaggcctccagaaccttactggcactgtggcactgccaccagcaatgccctgccttgctgccttcaccctgaacatttagtaccctgcaggccaggccagcttcccctcacttaaccaccccataccagtcacctcctgctccttttcctcttttgtgagaagatgggggctggagggggcagagtggcctgtgagcaagagccaggggtgtcccagtcccagcctctggggcagagcttgtagccctggatggcctctggggcaggaccactagctaagcaagccaggagaagacccctgcccaagtggctcttgggacaacgtgctgcttacactccaggtgtggaccggccgcagcccccactgacctgcccatgtccagagggactggacagccagggcagggctttggggggcactagaagatgagggtgtcggctgtgaggcgggtggctggtataaa

SEQ ID NO: 19902 - DNA, 1025 bp, Homo sapiens
ctcccgagtagctgggttgcgcaccaccatgcctggctaacttttgtatttttagtacagacggggtttcaccacgttggccaggctgctcttgaactcctgacgtcaggtgatccaccagccttgacctcccaaagtgctaggattacaggagccactgtacccagcctaggatatgatatcacttcttagagcaagatacaaaattgcatgtgcacaataattctaccaagtataggtatacaggggtagttatatataaatgagacttcaaggaaatacaacaaaatgcaatcgtgattgtgttagggtggtaagaaaacggtttttgctttgatgagctctgttttttaaaatcgttatattttctaataaaaatacatagtcttttgaaggaacataaaagattatgaagaaatgagttagatattgattcctattgaagattcagacaagtaaaattaaggggaaaaaaaacgggatgaaccagaagtcaggctggagttccaaccccagatccgacagcccaggctgatggggcctccagggcagtggtttccacccagcattctcaaaagagccactgaggtctcagtgccattttcaagatttcggaagcggcctgggcacggctggtccttcactgggatcaccacttggcaattatttacacctgagacgaataaaaaccagagtgctgagattacaggcatggtggcttacgcttgtaatcggctttgggaagccgaggtgggctgattgcttgagcccaggagtttcaaactatcctggacaacatagcatgacctcgtctctacaaaaaatacaaaaaatttgccaggtgtggtggcatgtgcctgtggtcccagctacttgggaggctgaagtaggagaatcccctgagccctgggaagtcgaggctgcactgagccgtgatggtgtcactgcactccagcctgggtgacaaagtgagaccctatctcacaaagaaaaaaaacaaaacaaaaaacccaaagcacactgtt

SEQ ID NO: 19903 - DNA, 1028 bp, Homo sapiens
ggggggcatgagtaattgcctgtaatataattgtgctcacgctgtcatggaggaccgtacaaagtgtcagaagcacagtgccaggaggcacagcaaagggtagtagaggtgacatttgagcccagccttgaaaactgtctaggatttctcagcatttcagcaaagtaaggcaatttctgtctaaaatatataggcaaagtttttataaaaatacgagaaattaattaaataacagattatgaccacaatgcagatttaaaaactaaggtatgatgagtgccgttgaccggttcatccagacagttcagagaacagaacatccatgtagatccttcttgtattacagaatacaaaggagcggaaaattttgcctcagtaactgccaggtcattctaattaaagtacctatacattgtaatataattcctccattaaggtaacagccaatcaggtggtacagagtctgtgccattcagtcaagaaattcactcccttaacctagactgtgctggaagttcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgtggcacctccacttcagttttaggaaggactgtttcgaggcagcttttcaaactttaatgaccatagaaatcacctgaagattgtgagaaactgcagatcctgatttagtaggcctgggtttaggcctgaggttct

SEQ ID NO: 19904 - DNA, 1064 bp, Homo sapiens
ctggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattacca

SEQ ID NO: 19905 - DNA, 1032 bp, Homo sapiens
ctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggttcaagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaa

SEQ ID NO: 19906 - DNA, 1050 bp, Homo sapiens
ccagctttgccccacaactattaggccctctgctaccccgacactcattaattcattgaatatttattgagcacctactatgtgctgtgcaccattctcagtgctggcagcacagccctgccctcgaggagtttaccttcttttatgctgcagtatcttgtctatctttcctctccagtgctgaaccaggagtgggagttctggttctagacctccttactttatttttcctcatctgtagaatgatattataatttgggctggttaaactgtaaggctcctttcagttccatgataacagaactgatgactgaatgactttcacaagaaacacgtggagtccagtgagcaccagcaatgaactttcgcaactgcagaaattagtgattgtagctgagttgacacaacagtagctgaacttattaattttactggaactttgaacccagtttgtgattatctcttgccgtgtcactgaatacattgagtacattggaattagattgacatattaaagttacttgaaaactcctgaacctacctgaacaatgaatgaatgaaaataatgaatgaatgaaaacaataaacattttacacttaaatgtttaatttagatgaactttatagaggagctaatagccaggcttctatttttgagatcccaatggttgtaaaggtgaccacatttgtcccctatgtagtccaagatcagtctcctgtcctggaccttatcgtatgtccaggacacaagaagcactacatttaacaagctccctaggtggttttgatgagcaggtaggcttaagaactgttaccttatctcaagaccattttttttcctgaacagcggagcttaagaactattaccttatctcaagaccatgtttttcctttatagattttgccctttaatgagcgaaatgtaaaggcaaagtgagtgaaatgaaaatgaccagattgttgccactacttttaagtaaagttaacaacaaacttacatgatgctgtgtaggttacacagcgttttcatgttcatcatggtcagaggca

SEQ ID NO: 19907 - DNA, 1066 bp, Homo sapiens
cactctcgctctcactgggggagggaaagaatggctttggtggctttgttcacatagctgatgcgtgccctgggaaggtgtccacagtgagccctgtgtgcaggactgtccacacggttcacaccttgtcaccatcaggcctttctggctcctgatagggtggagcaaaagtggaaaggaaaggaaagaggccttttctcacagccattatattaaatagtaggtcgattcacatcctcgtgctcctggccaccctcccctgtgcctcagtgacatgtagatgactgactgccaatacttgtcaccattccctggaagcagctacctaggggaaacaagatgtagtgctattgccgataacaagtaagattttccacactacagctgggtgtttctcttttctaaagtgaggccagtgttatttcccgggagtgttcagtcttgaccctagtcactgattttttctagttgttaatagagtggttggcttttaaggttcagagactgtggcttggcacctgcgcccaggctttgtgggcctttgccccttagaaagtagctgtaggcaaagatttgtgattttccaattacagtctcagctctagttttagtatctctaattctttggttcccttctcttccctgaaatatattagcacctgccagccaggccctcattttgcccagccagtgtgggcagatcccaccgtggagacatctgtagtgtgtatgtccttgtaacactctgttttcagggactacaacctttttccttctgtgaccagccccggattcaggctgtactaataccaggtatattgtggaatttagtataaaggccaatctgtcctgaagtccatctaatgtggtgaatcactgaaagtctcagaaagacctggttagtgtatgttctcatttaccacaggcctaccagccctgggcacagcagcttcatggcaagacataaaatgacactcaaaatccttcagatctggaaaccggctcagtattaaccctacctttggttgtcctgccctacctgctctgttagtttcttgttgcttga

SEQ ID NO: 19908 - DNA, 1046 bp, Homo sapiens
atctcggctcactgcaacctctgcctcccggttcaagcgattctgctgcctcagcctcccaagtagctgggactacaggtgcacagcactgtgcctggctaattttttgtagagacggggttttgtcatgttgtccaggctggtctcaaactcctgagttcaggtgatcttctggccttggcctccctaagtgctgggattacaggcatgagctaccgcaccaggcctgtgtttattattctgtacttatgaagcaaaagacagtatataaaatgcagattttacaatttaagcctaaatatacacatgatattgaaaactgtatctgtacgccatttgtcatatcatttcttcttttaacattgtgcacttagtacaaaggtatttagttcttattttaatgcagtggtttgcaaaattttgagatttgttatttttgtttatatttgatattgttaaagcagaatgctttttttccaaattaaatcttatacagtatcctaatatataaaatattaaagttgagcttctctgaccaaagtgggagaaatgaccaagtgaactgctgaaacagctccataagaccttagaaatataagaaagaacttaaaattactgatctagggtattattttgaccaggttatgttaaaaagaaaaaaaaccctgaaaaacaactgattcagattctctctagtgaaattgaagagtgagttcttggttattggtggtattccatgttgactccttaatattttaaaatatatttaaaattaaaaaataattttatgatgattacaaaaaaagcattgaaaaatagaaaaggtaatttatcatttggcatattcagaaatacttcccaaatatctagtcatgtagcttatgagctctcttgtttcttctgaaagacctgagtgaagaaagttggtgttgagcaaaaatgtgtaagagggtatggaaaatggtcaaggtgaatgtgagacattgaatccataggcgaagaattagaggaaatcattaataggtgttgttaggcatttaaggcct

SEQ ID NO: 19909 - DNA, 1044 bp, Homo sapiens
ggtggcacacacctgtagtcccagctactcaggaagctgaggcacaagaacttcttgaacccgggaggtggaagttgcagtgagctgagatcacgccaccgcactccagcctgggcgacagagcaaaactctgtctccaaaaaaaaatatacatacatatatatatatattttttgttgttgttgttgtttttttactttaacagtaaaattgctgtctttgctctctagggggaaaatgataattaagtttaagtcattgcatttgtgattctacaagtgagttaactgttttctttttttagacaacatgttgtgattttgttagtaaatgatcccttcctttgcactgatactattcaggttatctggaagagttcatgtaccactaagaatgaactattgacttaacagtttggcttaggctcctggttagaacaccaccactcctctctccaccttaccttctgtttgtcccagtgcaaaatttgtttgttcttctctggcttaggtgaagattgtccccagtggatggtccctatcacaatctctactagtgaagaccccaaccaggccaaactaaaaattctaatggacaagccagagatgaatgtggttttgaaaaatgtcaaaccagaccaatgggtgaaggtgagttcagaatcttacctaaacagatttctctcacttatacattttatggccggttttaaattctgcttcagtttagtagtttcaaagaaaaaaaaaaacctaaacttttctttgtgaaacttaggacgaattttcatatagtattgtccagacatttgtccttatgttagggaaggtagtggtagagaagcagatccaaaggcataggactaaggaggagaagaaaaaaaaaaaagtagactgagtgtaagcatatatgaaccaaaatatgtgtagtctcacaccttcaaactcccctgtcattgtaatgaaaggttaacttcaatgatgtgttgtcaccatatgtgtactactgtaatctaatgagagcagacatacataataatcggtt

SEQ ID NO: 19910 - DNA, 1641 bp, Homo sapiens
aaattctcatgcctgaagattatgcatccttcatatagaccagtgggtattttttcataacctgtaatattaacttcttattgctagtaatgatcctgcattctgggttgttttataccaggctttcttcgagagtcacccagctccttcagctgagcgtaccatccagcagtgttgtgaaaatattctgctgaatgctgcctggctaaagcgagatgctgagagcatccaccagtacctccttcagcggaaggcctcaccacccacagtgtgaatcctgaggtgccgccattggcggttctgctgcttcgctgcagggataaggtggagctaccgaacagctgattcatatgccaagaatttggagtcttctttcaaaccagtgggggttggacaatgaatgtagttaactggttcctgctcacactccagaattaaattctattgaaaaaggaaaatcagcaattcagcaaaaaataaataaaaaataaaaatgtaaatatgatagtaataaaatagagcataacgaaactgtgaaactttctgaagccttgtcagtggttaaaagtatttaacactctactgttaatgacagatgttctgtttttataacctaccaaaaggaaactagaggcttcttggtgaagagcatttttgtgaagtgggttctgcaaggagcctataaagccaagggtggtgtccatttctgggaatggttaaacacaaaaggctgatagctggtatcacatagttggagtcagtgcataattccaagtggctttttttttttttggcacggggactgatcaggaagatatattcctgcataactcaatctgaaccaaggattgtagtttagttttcctccttgccttcccttctgtgtgaccgaccccttggccaaaaaaaaacaaaaagcaaaaaacaaaaacctaccctgttctggtttttttcctccctttagttccacccccaacccccattccctggtgtccttcttagagatgaagaaataataaggaaacatctttcatagccacattaaataagagaaactgatatacattatttttttctttttaaagatgacttataagaaccctgaaatttatataggtgagacaatagaaataaaaagatcttcagccaggcctttctgaaggagttattctgctaaaaatggtcttagttgtctgaaaagccagctcttgaacctcttcacaacagtatcaacactggcttctcccggttcattttatgcgtgcgagaagtcagtggtaactgctgcagggcttaatacattagtggtaactggtttaaaaaacaaagactgtaagcctgtgtgtgccactgtttgcttcaacagtatatcctaataagcctcacctatttaatccaatgagttttaaatctaaatctcattcccttcttctttccctaccttttttttctttttttcttaaaaaaatattttgtgttattaacagaaattcatatttggtgtggcttaacggtatttcagaaggtcatcagattgtgagactgcttccttgaaacatttttgtgctattgttttaaaaaaataattaaaaaacagttggcgttaataaaaatgtcaatgtgaaactgatgtcctgattc

SEQ ID NO: 19911 - DNA, 1026 bp, Homo sapiens
cccctgtggctctccccacctatttcctagagctctgccctttcctagctaccttggtctgtactcatggccaggcctggcacccgactgcctcttaacccatttccactgatatttttccctctttgctcggttattcctctcttggggttttttctttttctttctttcttttttttttttcttctgacctggatgaatagagacctaatcactagggatctgcacccagaaaacagactgaggctcatctttgagatggggcctgtttgctgatgaaatcacaggggaaagttcctcgtttttcatattttaaaatttaaggggtccggagaaaatgaagctaagtccgctagagactggtcctttgtataaaaatgtgggatggattggttgaaacagcctagatgccagttaagtttctctttggtgtccatctcctgttgggggatggggtcagagggaaggattggatgatgcttgacatctttgagaaaggtaataggaattaagtctgagtaacactaaccatatgtgttcctttgtgttatataggcaaaatgtcaacatcaacaaagtgacaaggcttattttatacagactgcctttgaatgatttttttgttgtttttcatatgtgccaatttttacaactaacctgtttatcctttcctagaagagatttttccactagtataggctgataattccatttagggtattattcctgtttctgcttttgcaaattttgcaaaaagctttttatcttattcctaacattcttaacattctttagtggtacataattaataaaacttttaagaattatcttctgctgtgattgcagagcttgttagcagtaagaaaaatgtgtctgcttttgacttttcctgctaactttgctgtttgggcacggtttttggtggagaggtgtgtgtgtgctaaatttttaaacaaagggagtagtttttgaggcctgtggattacaaaaggttacaaaagaacatgcttttcagggatccactgt

SEQ ID NO: 19912 - DNA, 1031 bp, Homo sapiens
aaatttagataaacagttttattttctaccccccatcataacagccattcatttaacaaacattgagtaccagacattattaaaagttcttgggacacctcagtatacatagaagactgactactactaccatactctgaaaccttgcaattcgggggtctaacatgacaatttgggcactaagaatgatcttgatagggaaatctgtaattcctcattaagtgctaggctccacgagaaaagtggaagacttcctgttacactaagtaacatttttatagaagtcagtgaagtaaatattttgtggtttcctgaaatgcttatatcaaaaaaaaattagacattagttccccccctcgccgcccctctggtggttcagtgctctataaattatcctcagttgtggaaattcctaagatatttttatttacaaatttatcttcccttaacagcccactttccttgtggaactgtccagagtgctggcaaatccaggaaacagtcaggttgccagagttgcagctggtctacaaatcaagaactctttgacatctaaagatccagatatcaaggcacaatatcagcagaggtggcttgctattgatgctaatgctcgacgagaagtcaagaactatgtgagtaacgcttatctgtttggttatattgcccagagaacaagaaatcgctttctcagatcttttgctatttgcatgggatagagctaacagtgtgataggtttctgggacctcaactttacctaaagataaaaattgtctttgtcttaaatctttctcaacacagcttgtccattcccattgatggattggaattctttttagatgactgaggtaggctgcagcagtttgggaaactttaattacgtgccataattggtaaaatctgtttggcaaatgggagtagtgtacaaattggtgctacatttgtataaaaattagggaatttgttaataggtatttccaagctctccagaaattccgattcggtacttctggagtacagctcagggaat

SEQ ID NO: 19913 - DNA, 1068 bp, Homo sapiens
ggaggcctgggaggtcaaggctgcagtatcgttgtgccattgcactatcgttttgctactacactccaccctggacaactgactgaggccttgtattttcctttttttttttttgagcctgggcaatatggtgatgccctgtctcaacaaaagatagctgggcatgtcagcatatccacccctgtagttcagttactcaggagcctgaggcgggaggatagattgcaccgtagagattgaggctacagtgagctgtgatcgtgccactgcactccagtccgggcaacatagtgagaccctgtcttaagaaagaaagaaaaaaaagaattcagagacactaatataagtatggtggtgggcaaaatgtggtcaaatagtgttagaaatttgtatcttttgtctttttttttggtgcaggttttgcagacattgggtacagaaacttaccggcctagttctgcctcacagtgtgtggctggtattgcttgtgcagagatcccagtaaaccagtggccagaactcattcctcagctggtggccaatgtcacaaaccccaacagcacagagcacatgaaggagtcgacattggaagccatcggttatatttgccaagatatagtaagtgcttgcctaatgtatctggtttatatacctctgattgcctctagctgtgacatcaatgatattagtactaccttattgaatcacgaagaaagccaagctaaattgcacagttttgaaagtgagactgatttatttcccttaggcctgtgtcttcacattgctaatcatgccctaaagtaaagaaacttgaggatcgcaaactgaaaacagaagtctatgtttgaagagtcttagattctagacttacaaaatgaggatattctcatttggattatccctgacccagtcttttttcttaagatcccgaatgtaccatgaatgttgtggcgcattttcatttacaacattacggaaagttttgccaacatttgatgtagttggtttagccactggagacacagtattttagatgtagcccccccagcactgttgttcctgatgagg

SEQ ID NO: 19914 - DNA, 1057 bp, Homo sapiens
tagcctgtgcaacgtaacaaaaccctgtctctaaaaaaatttctgtggagaagaacaactgagttgttaaccagttttgtgagctcttgtgtttacagggcttataatggaaaaaaaataatgaaaaatgaaataaataaaaattatagcaattggtctgtttcataccaccttaggaaggtgtttttaagaaacaggatatatagccaggtgctttggcacatgcctgtaatcccagctacttgggaagctgaggtgggaggatcacttgagcctgggagttcaaggctcaagatttcaccactgtacttcagcctgggcaacagtgcaagactctgtctccaaaaaaaaaaaatatatatatatgtatatgtatgtgtatgtataatatatatgtaaacattttggctgaaaatgcaatgaataacataaaatttaccatcttaaatcatttttaaatgtatagttagttaagtagattcacattgctgtggaaacaatctccagaactttttcatcttgcaaaactgaaactgtacatactgaacaacaactcctcatttccccctttctcagccactggtaacgaccattttactttcagtttctatgtattttactactctaacgaaataccttacgtaagtggaatcatatttgtctttttgcgactggtttgttttacttagtatgatgtcctcgagattcatctaaggggtagcatttgtcaaaattggctttttaagggtgattaatattccattatatgtatatgccacattttgtttatctagtcttccatccatggccatttggtttgcatccaccttttggctattgtgggtaatgctgctatgaacatgggcatgcatgtgtatctttgagactctgctttcagttctttagggtaaataccgacaagtaaaattgccagggtcatggtctgaaagtatttctgtatatatgtttgttgacacttcagctgggtttttaccatttcttgactttggaaaggtctgaaaccccagagcaaatggcaattctaattgattagaaa

SEQ ID NO: 19915 - DNA, 1050 bp, Homo sapiens
attgccgtaggttattcaagccatttctactaaaaaatatatatacacaaacagttaagggagaaaaggtttttgatcagctttgctactttattgccataggttattcaagtgattgttttcccctgtagccattaaagcagctttgctattgctatacccaaaacctgacccttcaagaagatagaagtaatatcttcagtctgaatagtattagtgaatttagccgtaccatgggttccacacgcacctttaatgcaaaaaaaaagactgaggccaggcgcggtggcttacgcctgtaatcccaacactttacaggcgcatgtctgtaatccagctactcaggaggctgaggcaggagaattgcttgaacccgggaggcggaggttgtagtgagctgagatcacaccactgcactccagcctgggagactccatctcaaaaaaaaaaaggactggctgtggtggctcacacctataataccagcactttgggagaccgaggccagaggatcacttgagcccaggagttggagaccagtctgggcaacatggcgaaactccatgtccacaaagattagctgtgcgtgatggggcgagcctgtagtcctagctacgtgggaggctgaagtgggaggattgcttgagcctggtggttgaggctgcagtgagccgtgatcatggccactatacttgcaccagggcgacagagcaagaagactgtctcaaaaaaaaaaaaaagagaaaaatggccgggcgcagtggctcacacctttaatcctagcactttaggtggccgaggtgagtggattgtctgagctcaggagttcgagatgagcctggtcaacatagcaaaaccccgtctctactaaaaatacaaaaaattagccgggcatggtggcgggcacctgtagtcccagctacttggaaggctgaggcacgagaattgcttgaatcggggaggcagaggttgcagtgagccaagatcatgccactgcactccagcctgggcaacaggagcggaactctgtcccttccccgaaaaagagag

SEQ ID NO: 19916 - DNA, 1050 bp, Homo sapiens
gggactacaggcacgtgccaccacacccagctaatttttgtatttttagtagagatggggtttcaccatgttgaccaggctggtctcaaactcctgacctcaggtgatccacccaccttagcctcccaaagtgctgggattacaggcatgagccaccgcgcctggccgattttggactttacataactggaatcatacagcatacattctagttctgtattttgttctaaatgtttggaattcattctttttggatgtagttgaaattttttcattcttgttgtgtagtactaaatggaatcttcttccatctgaatcttgtttaacaaaggctatgctgtgatgaatgtttgtggaagagacaaaatataaaggtcttatattttatttccctggagtttaagttctaaagacattcaagagtagtcagaggacctttagagttaaaatgattctttggacaaaatcttaactagtgccatattctttcaccaggacgaaaatgatgatgacgatgactggaacccctgcaaagcagcaggggtgtgcctcatgcttctggccacctgctgtgaagatgacattgtcccacatgtcctccccttcattaaagaacacatcaagaacccagattggcggtaccgggatgcagcagtgatggcttttggttgtatcttggaaggaccagagcccagtcagctcaaaccactagttatacaggtgaaactgagggatttttggagtagaaagtaggatatttattgtttaaacttaaagcatatctttatttttcaaaacaaaactgtaaattgtcatctacaaagattatctctagatacttgtttacttttaatgagggtaaaatatatttcttaggtttttaattacataagtcagcatgatccagagacatgtgaaagaagccaaaagagaaaagtcatctttaatttcattgcccagaaataccactcttaactctgtatttatccttgaagctttttcctatgtgcatgtgtgtgcaacaggctcttcctgtgcagattgttttat

SEQ ID NO: 19917 - DNA, 1050 bp, Homo sapiens
tagtagagagaccgggtttcatcatgttggtcaggctggtcttgaactcctgacctcaagcaactcctgacctcaagtgatctgcctgcctcagcctcccagagtgctgggattacaggcatgagccatcatcatgcccggcctctatctgagtaatttattgcagactactaaaagcatttacaccaaattcttaatataaaactctaaactggagttttgaaagatattttcaaatattttgaaagatgtttcacaccatgtcctgtaaaattacagaagtatcttggtgacttttttgagttaagccatccatcagtatttctttctctggggtagtagttaacatgaattttaatctttgttttgctttgctaataactgttatattttcaggctatgcccaccctaatagaattaatgaaagaccccagtgtagttgttcgagatacagctgcatggactgtaggcagaatttgtgagctgcttcctgaagctgccatcaatgatgtctacttggctcccctgctacagtgtctgattgagggtctcagtgctgaacccagagtggcttcaaatgtgtgctgggtaagggattttcttgctggtgagaaaaggagcttgcctgcgccactggcaagaaagtagaaggtgtgggagagaaatcaatctgcctcactggaatgctttttctgattttctttctaatttattcaattaaaatgtgggggagattccaactgcaagagccagtgggaacacttgacttatggttactggttcctgaaccacttagaacagtcatggtaacccagtggggaaactatctggacttgggttgctttcttgaattgcttggggacaagaagttttgattaaggtagagagtttttggctgtaagaagtatcattgctgagtagagggcaagagggaaggaaggtaggcagcctaaatgctgagtcagtataggctaatgtaattggttaaggggaggaagttcaaataaggaaggaatggggctaaacgtctttctgtgaaaggaaacagaa

SEQ ID NO: 19918 - DNA, 1034 bp, Homo sapiens
ctctttgagattatatatgaagacatcttttttaaatgaatgaagaaaattggggtatttttttttttctgggacggagtttcggtcttgttgctcaggctggagtgcggtctcggcccactgcaacctccacctcccaggttcaaggaattctcgtgcctcagcctcctgagtagctaggattacaggcacaagccactacacctggctaatttttatatttttagtagaggtggggtttcaccatgttgaccaggctggtctcaaactgacctcaagtgatccgcctgcctcagcctcctaaattgctgggattataggcatgagccatcacgtctagccaggaaaattggggtattttcttcatagcacttcagacaacctgttaaattgttcacatgattttttaccatttcaaaccattttttcctctataattttagcccatttccaaaagggccattctaaattttaactgtctggagaccataatgaacatagccattggctcaaaggacttgaagatttcattcttggatattgtgttttcaaactcaaaccaggtctgcagacataccggttcctgagttcttatttttggcaagacattgtctatgttcttccctgtccttttcatttgaggctttaagattttcgctgtgttctttacagacctgatggacaccagaacaacctgaggagttctgcatatgaatctctgatggaaattgtgaaaaacagtgccaaggattgttatcctgctgtccagaaaacgactttggtcatcatggaacgactgcaacaggttcttcagatggaggtgagacctaagagtgcccctgactatgggtgggaattgggtagtacttttgacacctaggtctgttttccagactgttctgtctttttagtgtttaagtatatattttctcagaaagataataaagcttatacaaaaaacattgcaccttaacgttagcattgtttgtcatggtttactcatatatgtgttacactatatgtattatgggttt

SEQ ID NO: 19919 - DNA, 1064 bp, Homo sapiens
caaaattaaaaaatatcaagggacttaattgattttaaaaagaaaaggtatagtgttctgattgggagatttggaatcaactgatcttgaactcttactcatttcacagaatgttcttcggaaagtgcaacatcaagatgctttgcagatctctgatgtggttatggcctccctgttaaggatgttccaaagcacagctgggtctgggggagtacaagaggatgccctgatggcagttagcacactggtggaaggtcggtgagaaatactgtctggtcagggaatgtctttggaatgtaggcatttcagtggccttaaataattgtcacccaggctggagtgcagtggcacgatcttggcgcactgcagccttgaaatcgtgggctcacatgatccttccacttcagtgcccccacagtagctgggactaacagatgcacaccaccatgcccagctaatttttatatttttggtagagatggagtttcgccatgttgcccagactggtcttgaactcctgagtcaagtgatcctcctgcctcagcctcccagagtgctaggattatagatgtgagccactgggcccagcttaattttgtttgtgtgtgaagatagggtctcactatattgctcaggctggtctcaaactcctgggcctccttgtcagagcattaaagaatttttgactatagaaagcatagtccttttactggggcatgagtcacttcaaagttagattgaacttaagtgcacaccacttaaatttgtataactgccttgtcagtccatttaaatggggagccagtttgcaacggagattggcagaggtgttgttttttttttgttttttttttttgtttgttttttttttgagacttgttctgttgcccaggatggagtgcagtggcaccatcttggctcaccacagcctccacctcccaggttcaagcaattctcctgcctcagccttctgagtagctgggattataggcatgagccactgtgccctgctaaaagtttctattttctttcctggtacttgtcatcacctggtttggtttgta

SEQ ID NO: 19920 - DNA, 1026 bp, Homo sapiens
gtaagttataccctgcttctaagagctgaatagaacttctcacagaaaatgagaaaacatggagtaaggagttttgagagtatcgcggatggcaacagttcacttttttggcacagagatttctttgcagaacgcttcatgtcctgttttgagtgttcacatgatagtttattccagaccctcaaggtgtctgtattacaccccattaaactctgatgttggtcaacaattgcctctgtctagtgacctctactgagggttttatttatctttgaaatttgctaagaaacccatagcactggtttggaaggctcaaaacattatactggtatggggctaggagctcattctcagctgtgtttgttttgcacagggacttatgtacagcatttgggaaggatgtactgaaattagtagaagctaggccaatgatccatgaattgttaactgaagggcggagatcgaagactaacaaagcaaaaacccttgctacatgggcaacaaaagaactgaggaaactgaagaaccaagcttggtaagatcttgcctccactgtcctctttcttctacttcctggaggaggggggtatgttttctttaggccattctggcaagcactgccttctggcattttttttgtttgtactttttcccatgtaggtgcttctgagtcaggcagcctcagtttttccttgagccaaatgtttgactcctcatagtgatggagagcagaacttttaaaactggaattcactgaaattccctgagtattttgggtcctaataaaatcatcagtaatgccatttccccctaattctcttctgttttctattcctttcctcatgccctattctttctttacagcagtgcttttagacgttgcctagctctagagaagatttccaaagtcaaatgtttttttgtgtgtgtgtgtgtgtgtgtgtgttttctttttgagacagagtctcactgtcgcccaggctggagtgcaatggcacaatctcggttcactgcaactgctgcctc

SEQ ID NO: 19921 - DNA, 1896 bp, Homo sapiens
ttaagtggccctcctgcctcagcctcccaggtggttgggactgcaggcaagcacctccatgactggctaatttttttttatttttagagacaagatctcctgttgcccaggctgggtttgaactcctgacctcaagaagttctccctccttggcctcccaaagtgctgagattaaaggcttgagccactgcacccagactgaaatacagttttaatttctttcactcttaattagttatcttactccacagatctcagtaaaattggctctttgagtttccctcgcaccctctgatgtaggtgttaataagagcaggtcaatggcacataggacaagaagaaagagtgtcaatccttgaaatgttgacaaattccattcaggcctaggagcatgtaattgtaggagtcagcattattggctctgttgggtatatgtgatctcaaagattgacctttttttccatctgttttcagatctgttaccattgggatgataacctgaggacccccactggaaatctcccatcttttgaaaaacctggaagtgaggagtgtgcacggatgctgaatgtttgggaatgagaggatgagtgagtgaggcttgaaaacacaccacattgaaaatcctgccacagcagcagccgcagccgccaacagcagcgctgttagtgagctaagtaagcactgacttcgtagaaaaccataacatcggccatcttggaaaagagaaaaacaatggagttacttatttaaaaaaaaagaaagaaagttatctcttcccaggagaggctagaagtagcttttctgtcttttggccagtgccgagtggaatgcctggtttgggggaggaggagggactgggttcagctgtggtgctttgttgtaaaaggcagcctggcctttgctactgaggagaaagatggagcctgggtctcaagcccaccttcgctgtacctttgccacatggtactgtatgcttgccagctagaaggagggtcagggattttttacagtctgagaatgagtgtgtgtgagtgaggcggtatccacattttcaacttcaagtcattgcagtttctttttcccagaaaacaaggggttagatgttgcatttcataaaactaaccgaagttttgtttactgatgcagcacaagagatgtaaaaaaaaaaaaaaaaaaaaaaaaaaaaacacacacacagaggaaagacgctctttaggttttgttttgttttttttttttggttttgttttttgttttttttactctagggaaaacactgacgaatggtcagagctcctatcctgatcttttcatcaaggcgcctttcctaataatatggttcaactgtgaatgtagaagtgggggggaggggggagaaaaagaaaactctggcgttagaggatatagaaaaatataagtacaattgttacaaataacgcagacttcaaaaacaaaaaaatcacaacccaaacaaaccaaaatttaaatgatcagaattggcagcacaaagaaaacgccctctcctgacttgtattgtggcagtctgaacgcccccagaaaattgtgccaaagagtttagaaaaataaatatacaataaaagtaaacacatacacacaaaacagcaaacttcaggtaactattttggattgcaaacaggataaattaaatgttcaaacaatctgataaaataaccatttggaaactgcttggccttctgttcttttatttgattgactacaatgcggtattggtctcttgctgcacttcaaaagcaaccaacaaaacaaaaacaaaaaaaagtgtgtgttgtgtgaatacacacacacactaactagaagtcttgtgatgaaaatggcacttggaaaaggttttatttttccactgaagttgaa

SEQ ID NO: 19922 - DNA, 1055 bp, Homo sapiens
agcctgggcaacatagtgaaaccccatctctacaaaaaatacaaaaaagaagttagccaggtgtggtggtgcacacctgtggtcccagctactcaggaggctgaggtgggaggatcgctttagcccaggagatcgaagctttggtgagccaagatcaagccactgcactccagcctgggtgacatagccagaccctgtctccaaaaaaaaaaaaaaaaaaaaaaaaaatcaggagacatggtctcagccaaccctaagctatgacctcagttaagtcacttagcctccatccctcctctgaaaagtggggcaaatattaacaccctcaccaggttgtggtgagggtgatggggcattcatgtatagatgctttgccttcataatcatagatatttatgtggcactcggggtgtgccaggcactgttcttttcacctggcatacactagctcattttaattctcaaaacaaccctaagaggtgagtgtgggactgttatccccattttatggatcaggtgggtgaagtccagaagctcttgtcatgtatgcaaatggaagttctgatgctcctgaggggggctggcctccaaacagggggctgagtgttcttttaagtgtccctgtgtgttaatgacagagcaggggcattaacttgacctcgccaggggcaacagcccgcaacagctgcattgcggtggctgagaggagactttgcactcacagccacttggagagtgggcttgggatgtgtgacctggggcctctgctgtagtctggggtgatgactctccagacatggggaagtcctgggcctgtgcagaccctcccctctgtctctctctccagagggccctggtggagacgcacctgcgtcagatctgtggtttggagcagcagctgcggcaacagcaaggcctccaggatgcagccttctccaacctgagcccaccgccagcccccgcccctccctgcactgatttagacctgcactacctggcactgagagggggatctggcttgagtcatggtgagatctcagtgaccccgacttacc

SEQ ID NO: 19923 - DNA, 1035 bp, Homo sapiens
aggggatgggcacacggttggggacaggggtagagtgtgtgtgcacaggggccttcgtcctcaccgatctgcagtctcattgcccctgcaaacccaccattggccaagctgtgtgcagcgctcagccagggctgctcttgcagatggctccgtgtctggggagcgttgttttgcagccacccggaggtggcctgtcctatttgcgcttgcattctctctcccctcggatgggcatcgctggagagtggaaaacatctgctacatactcagtgtctctgccacttcctgggcccagtgctaccagcttaggtgcccaatccacccaccagctaccttcctccatggaccaggtgtgcgtgtcaggcaaagggtgaggcacggggtagagaaaaggcataaaatcccccctttccctggctctccctctaagttacatttgaaatcccagctcaccaactcttaaagctgtcccccatttccaatcctgcttctactcgctccagcttctgatggcctcttgggtttgtattctcctccatctgaaatagccccccttcccttaaaatgtccttgggtggacagtcctccaaagcctccccacagcccacagcagaacccgcttggcctggctctcctaggatggggcctctgcagcctcctctcatgcacacccacccctgccaactctccctgaacactaggctcttctctgcctgcctttgtaggcatgaggctgccttagaagggtgagattaggagtgctggctgtgctcttgggtaacaatgtcccccccatcacctgtgcgacccaagagaaacttcttttcatccctcagaacctgaattaatgatcacacctcccaccccgccaggagttttcttgtttccccttctgtgttcccatagaacctgctcatatacttctatttaacatgatatatataccatgattggtttccacttacagacttttagctcttagagcccagaattatgtatcactgatccagaccagacatacagtaggtacttatg

SEQ ID NO: 19924 - DNA, 1020 bp, Homo sapiens
cctgggagccctggtatccatggggaagcccactctcagagttctgagataccaggcttataggaggcacagtctgtgagtgggaagagactggagtgtagatgttgcccatttgtaggtggtaaaatcaattgtttttgatggaattgattttccctgagtggagtgctgggggaaggaggaggtccaggccggtagtggccattcgccgtgcctcagcgagcaggtgtgtgtgggtcctccaccactcacctcttggttagcgggagtgtgctgcccccacccccacccccgcacccccattctacacaaggcagaagaggcacgggtttttctgggagcgaatatcaagtgcctgagagcaactacaggactaactgtgtttgggttgggtgtagtataaataataataatggctaatatttcctgagcatctactaaatgcaaggaattgtgcttggtgtgtcatgtggattctctcttgcatcttcatgataaatgttattgtcgctgttttaccgatgagggttggattagaggggttaaacaacttgtcttaggctccacagctgggaacaagtggggctgggaagctgacttcgtgctcttcaccaccacaaaggatgtgtgtgcatcctggggcatgcctgcctcatgtgggggtgtcctgggctgaatttcctgggcacttctcagtggaactctctagcctcctggttcggaatgtcaactatgagatcccctcactgaagaagcagattgccaagtgccagcagctgcagcaagaatacagccgcaaggaggaggagtgccaggcaggggctgccgagatgcgggagcagttctaccactcctgcaagcagtatggcatcacggtgagcggcggcagcctcttcgcagccagaggacacctgggcccctgcttgtcttcctctgaccccgtctgacccctcagcctggttgcaccccctttgggccagtgtcttacttttcttcggtctttggatgttttcttcaatc

SEQ ID NO: 19925 - DNA, 1054 bp, Homo sapiens
gtgaaaccccatctctactaaaaatacaaaaattagcagggcgtggtggcaggcgcctgtaatcccagatacttgggaggctgaggcaggagaatcgcttgaatgcagaaggtggaggttgcagtgagcacagatcacgccactgcactctagcctgggcgacagagtgagactctgtctcaaaaaaaaaaaaagtgaaagtgtcctttgaatgtgttttctaccttctactgtgaaggttttcctaccctgatcatgatgtgaaaagtatggaatcttatcctgttgcttttgtgattcccatttcaggtttctctggaaacccccctggtaagtgtggaggaggcgggacactctgacccaagacgaaaggcctgtagctccagccaaagaaaataaaccttaggagggagaaggaaaaaaaaaatccatcagctgttcctgagaacagcctgcattggaatctacagagaggacaactaatgtgagtgaggaagtgactgtatgtggactgtggagaaagtaagtcacgtgggcccttgaggacctggactgggttaggaacagttgtactttcagaggtgaggtgtcgagaagggaaagtgaatgtggtctggagtgtgtccttggccttggctccacagggtgtgctttcctctggggccgtcagggagctcatcccttgtgttctgccagggtggggtacggggtttgacactgaggagggtaacctgctggctggagcggcagagcagtggccttgatttgtcttttggaagattttaaaaaccaaaaagcataaacattctggtccttcagcaatgctttctctgaagaaatacttaacggaaggacttctccagttcaccattctgctgagtttgattggggtacgggtggacgtggatacttacctgacctcacagcttcccccactccgggagatcatcctggggcccagttctgcctatactcagacccagttccacaacctgaggaataccttggatggctatggtatccaccccaagagcatagacctggacaattactt

SEQ ID NO: 19926 - DNA, 1080 bp, Homo sapiens
tggagacccactgagcaccaactacagccttgcccccaacactcccatcaatcagaatgtcagcctgcatcaggcgtccctggggggctgcagccaggacttcttactcttcagccccgaggtggaaagcctgcctgtggccagtagctccacgctgctcccgttggcccccagcaattctaccagcctcaactccaccttcggctccaccaacctgacagggctcttctttccaccccagctcaatggcacagccaatgacacagcaggcccagagctgcctgaccctttggggggtctgttagatgaagctatgttggatgagatcagccttatggacctggccattgaagaaggctttaaccctgtgcaggcctcccagctggaggaggaatttgactctgactcaggcctttccttagactcgagccatagcccttcttccctaagcagctctgaaggcagttcttcctcttcttcctcctcctcttcctcttcttcctctgcttcttcctctgcctcttcctccttttctgaggaaggtgcggttggctacagctctgactctgagaccctggatctggaagaggccgagggtgctgtgggctaccagcctgagtattccaagttctgccgcatgagctaccaggatccagctcagctctcatgcctgccctacctggagcacgtgggccacaaccacacatacaacatggcacccagtgccctggactcagccgacctgccaccacccagtgccctcaagaaaggcagcaaggagaagcaggctgacttcctggacaagcagatgagccgggatgagcaccgagcccgagccatgaagatccctttcaccaatgacaaaatcatcaacctgcctgtggaggagttcaatgaactgctgtccaaataccagttgagtgaagcccagctgagcctcatccgagacatccggcgccggggcaagaacaagatggcggcgcagaactgccgcaagcgcaagctggacaccatcctgaatctggagcgtgatgtggaggacctgcagcgtgacaaagcccggctgctgcgggagaaagt

SEQ ID NO: 19927 - DNA, 1045 bp, Homo sapiens
tctccctccgtgctccagccacccctgagctgaggctcccattgtctccatcagagcctgcatgtgtatgccgtcctcccctggtccggtgtttgtgttccccacccctcacagactgcctgagctcttctgtaagctggggtagggtgatggcagtgctccgggaactgggcctgcagccttcctcttctgggactgctgtgaggcagaggaatgatggagaatctagtgtagcagcctccaggcaggattcagcacaacactggggagtcacccttccctcgggcctctgcctaccaacaactgggcttatcactgggaaaacacaaaaaattacacaacccagcaacaacaaaagaactagtcctcttagaatttcttgcgctttgatttttttagggcttgtgccctgtttcacttatagggtctagaatgcttgtgttgagtaaaaaggagatgcccaatattcaaagctgctaaatgttctctttgccataaagactccgtgtaactgtgtgaacacttgggatttttctcctctgtcccgaggtcgtcgtctgctttcttttttgggtttctttctagaagattgagaagtgcatatgacaggctgagagcacctccccaaacacacaagctctcagccacaggcagcttctccacagccccagcttcgcacaggctcctggagggctgcctgggggaggcagacatgggagtgccaaggtggccagatggttccaggactacaatgtctttatttttaactgtttgccactgctgccctcacccctgcccggctctggagtaccgtctgccccagacaagtgggagtgaaatgggggtggggggaagcactgattcccagttagggggtgcctaactgagcagtagggatagaaggtgtgaacctgggagtgcttttataaattattttccttgtagattttatttttaatttatctctgtgacctgccagggagaggggagagagagagagatgctgttgagcacatgacaaaataaaataaaatggatgattcat

SEQ ID NO: 19928 - DNA, 1035 bp, Homo sapiens
agcaacaactttagaagctcacgctaaatatagtttagggcacaccatggtgaacaggtggacagcaagaagcctgtttccatattggtgtaccatatgtatacaaacacaggtactagattggtgtctgcttctgagtcattttcccagccaagtatagaaattttgtagcaaaacccatgtgcttcatgatcatgagtagttaagccttgtttttctatcaaagatccccgttaagtgaaagggacccacaaaccttcaacttgtcattttgtcaatataccaaaaataacctttctttttacctttactgtattacacagaagtcaatcatcttccttgcctcccgctctgaactttggagtggagaatgagccatttggggactatggggaaacttaccactatgtgtgaaactttacaagttctagtccttgttctgttcagttcgtgtctgcctgaattagccgagaaacagaatttagtacacgtattgtctctggagtagtgtgagaatctggtaccttgcagaagagggctgttttcaaaaattagctggatagaagtctttgtcttcccttttgaatacaccataccaacaaaggtcttaaagctgtttttttttttttttgagacggagtcttgccctgtcacccaggctggagtgtagtggcgcaatcttggctcactgcaagctccgccttctgggttcacgccattctcctgcctcagcctgccaagtagctgggactacaggcgcccgccactgcgcccagctaatttttttgtatttttagtagagatggggtttcaccatgttagccaggatggtcttgatctcctgacctcatgatccgcccgccttggcctcccaaagtgatgggattacaggcgtgagccatcgcgcccagcctgctgttttggttttttttttggagacaggatctagctttgtcacccacgctggagtgcagtggcgcgatcttggctcactgtaatactgcctctaggctcaagctattctcccacctcagc

SEQ ID NO: 19929 - DNA, 1056 bp, Homo sapiens
tcccaaagtgctggaattacaggcgtgacccaccacgcctgtccttattatgctgtcaaaaaccaaatataaatacttgcttcttgttgttgagatagagtcttgctctgtctctcagagtggagtgtagttcactgcagcctcaacctcctcccaggctcagtgatcctcccacctcagccttttcagtagctgggactacaggtatgcagaacaatgcctaactgatttctttctttttttttttttctttgagacggagtctcattgcccaggctgaagtacagtggtgcaatctcggctcactgcaacccccacctcccaggttcaagcgattctcctgcctcagcctccagagtagctgggattataggcgaatgccaccacaccctgctaatttttgtatttttagaagaaaccaggtttcaccatgttggtcaggctggtcttgaattcctgaccttgtgatctgcccgcctcagcctcccaaattaaatgctttttacatgatcctattttgaaatatttatgtatgacttgactgagatggctgacctcatatgtcatttctgagactaaacattacttccttacttggtatgatgtttagtttgttttgatacaaatacctcaaatctggaaaggatattgaggatattgacatcctgtatccaaaaagtttattcctgaataagtgcgtctgactactttataatgatttccaaggactgaaagtttatgagctctcttagtgacctcttccagtgtctgatcaccccgtcagttcaagtacagaatggtatttttaaattttaattagcttactctctatgtcccctttgccctcccatccgtgtctttccctcttatacatctcacatacaccataatgacaaatcttcttatttccagagacaagaaataaaggtcaaatttaattaatttacactgccaactcccaacgtcagtgacctttggtttgacacctcagtatgtcatgtgcctatttgccagtgctattcatcctgaaatcagacaccattctcaactgcactg

SEQ ID NO: 19930 - DNA, 1321 bp, Homo sapiens
atagggcaagcttgactgaagtgtttgtggttaaaggactttgctcaggatcctgtccttactggttgcgtttaagtatcccttccaccccaaagactatacctctcttgtcctcctctcagagagaaagcttaatacataatgtcacatttctctggcatagatacctaggtttctctgtcactgaatgctctacccacagaagtgcagttgcacttaaactgatgttagaaagaaatcatatttcctaaacctaatgctgtttaagtgaaacacatagttttcttacagtaaatttcttacagtaaaaattcagattttgtattgttggtgtatctttttttgttgttttgaatagatttcccttcatattttttttttatgtagttagaaatgtttttcctaggacatctcgtcctcagtcaagtaccagtgttaatagcctagtacctggggtcccagagttgatgccatgttgagaccagttgagtttactattccaaatgactgagagccagaatatgacgtagggtcttgccaggagggcaaggtgggaactatagacttaggcattggattgccacgtccctttccttttgctgttcaaatgcttagcagacctaaatgcctaggagcctttgtggaagaagaaatataactgagtcagttcaggttttcctcccttcagggggggaaatcctgttgaagaattatggcttgagggggaagagaatttagtgtcgttttcaggacggctgattttttttttttttttttttttaaacagtattggggaaagttctgggactggtctaatggctctgagtggaccctgagtcttccccattttcagtcatgatgtgctgcctgagccacatcctccacaataggtttgatcctctgcagaggaagcaagcagataccctaggcatccatcacaccccctaaccctgctgtgttactggcactgggctgtggcctccaatccctttcttcgtctcctttcatcatactttcccttcgtgccacataaatgtagggtggggttgcatcatatgcatgtttggcctgggcaaatccaaacatatattcagtcaaaatctgtgtcgatttctcaaaattaaaaacgctagggttatattttatagataagcatattatatttttccacagtggtgttttatccattatatgtaacactgatcagggaggtctgcacaaaaaaaaaaaatgctttaagagagttttaggggatactcaagagtgattttgactagattcagttttcgccttgggctctaactttagaagtaacccctga

SEQ ID NO: 19931 - DNA, 1057 bp, Homo sapiens
aatgacaaatgtctgagattggaaatcacattagatatgaaatgagtttctagtgcatcttctttctggatgcttctgaggttttgcttcatagagttcccattttagttgcctttgggggctgaaaactcagtgtggacatcttctcgcatattttggattggtgtttttatagtggtctgaacttctctgggacagagaacacgtgcaggttgaagttgagaaagtacccccaaactgattattctgttttcctgctatccaacatgtttccaggtttgtgtgagggaagagcagcatttgaaataaacttagagacatgattcatttttctaggacttgctcagacccagggatatgttctgctgtgattttggcagtgaagaagtcttttaaaggaggttgtccttaaagaagtacttcatctcgttagggtacttaattaattgtctttgctggtaggctaaaacccatgatgataaagaaatttagtcgttgcttctgtatgaaatttgttcgcgaaagcgtgtctcaaagtaggctctccctcattgggtcaatataaaactcttttgagataccagccacaggacagtggggtaaaagtagtagaagtgtgttaggtagaaaaggagaagctgccctgaaattgaaaatttgccataaagaatcacagagtagaaaatttcagccgggtgcggtggctcacacctgtaatcccagcactttgggaggccgaggcgggtggatcacctgaggtcaggagttcgagaccagcctagcctggcgaaaccccgtctctactaaaaatacaaaaattagccaggcatggtggcgcatgcctctagtcccagctactcgggaggctgaggcacaagaattgcttgaacctgggaggcagaggttgcagtgagccaagatcacgccactgcactccagcctgggtgacagagggagactttgtctcaaaaaagaaagaaaagaaaattcttaggtgttcctagttgactgtattagctttatcagccatgttttttttttcctctttacctagaaa

SEQ ID NO: 19932 - DNA, 1070 bp, Homo sapiens
taccacctgacacacaccatcgcaagggcaaggaggcaatgccagcaggaagctacgtagtccccaggtagtgacttcattctactaggagaacttggatggcccttcagattttgatcagaggagactatgtacttattactggatagaaggggggtcatcctactattaaaatttattgcagagcctgctttgtaagacctgcttactaccttgcagcacagtaggtttgcaataatacaacaggctggaacaaacttttgctctaaccatagttgactgacaaaatatatgttgattacaggtaagtcacagaaaagtaggtttggacctcatacttttaatacagttggaaaaaacctgattgcaacacactgaaatgtaactgtgtgcagaacaaacaccatcagaaatgcagtccttttgcattttgggaaatccaggttcccaggagcatggctggtcgtaagcaaactgcttttgactgaaatagagagcaaacagctcgatgattaagagaagttttgagtggattgtgcagatattttcaagaccccttaggacaagtctggttattagacaagtggcattttggtggctggaaggcatgtaagggatggtgtctgatatgggatggctggaaattttgcttatagtttagaggagggttgtggagaaaaatcccataatagaggaggcaggagaagaggggaagctctacattttctctttccctttctaccatgtctggttagtggattctagtcaatcctctctacatttccttatgaaaagaaggttaaggagaacttcaaattttttttttttcattttgagttaattttggttaaaaactcaatcactcattcaggacaggcacggtggctcacatctgcaatcctagcacttctggaggccgaatagggcagattacatgaggccaggagttcaagaccagcttggccgacatggtgaaaccctgcctgtactaaaaatacaaaaattagccaggtgtggtggtgcatgcctgtagtcccagctactcgggaggctgaggccagagaattgct

SEQ ID NO: 19933 - DNA, 1041 bp, Homo sapiens
aaggacgtctaactgctcactataatgatccagccttttatgaagaatgcaaaatggaatacctgaaggaaggaagaattcagaaaaactggaatttctacaaagagaaggctacagaaacttcccataagcctgtaggcaaatattcaaatgatattcaggaactctaatattcatggaagtcatttatagtataaatttccttaaataatggactcaagaatgtgtgtttgctttatcctaattatggaaatattaatttttatctgaaataaagatcttttatttcaaaaacgaaaataaaccccacacttcattagggcaggattaacatttgaattctacatgtatacatttcaatctcctttgaccttggtttcatcatctctaaagttaggagtatgtagtagttagcagttggtttcctcaccctgtagtagggattcctcaatccgggaagtgtatgtgttagctttgtggagcctcttcaggtctgtggtaggctttccagttggcatgggagtactttgagatctatggcttgctcttcctttttaggctagcagaaccctatactttctattggactggaagcccatttctctgatggttccagtggaaagcctttgtgaacaataaatcccaactaagtgttagggaacactgtatttatttacttttcctttgaagtctttgatgccatttagactggaaagttgtgaaaaatggaggtggaggtagtgggcaggtgactatctccttttctttagtgtgttccaagctgtaacttactagagtgctttggccaagagagcatctggtatgattggcatggattggaatgacctgtagactctcactctgtccccagagccatcatgaagctgaatggccaccagttggagaaccatgccctgaaggtctcctacatccccgatgagcagatagcacagggacctgagaatgggcgccgagggggctttggctctcggggtcagccccgccagggctcacctgtggcagcgggggccccagccaagc

SEQ ID NO: 19934 - DNA, 1482 bp, Homo sapiens
ttttgcgtttggtaatgtttatcaactttgtcaagttttaaattctgatgaatggattgatactactgtttctccttccttcaagtcccccaaccccatctcccacttaacacccaccacgtttgctgtattttccaggggatactcaggctccactggaggcaaagaaatgtaaggtcaccccaaccctcattcttcctctttatctttcttctgagtcctgtgtgacctgttctgtttattgcctgtgtctggacctgatgacctctcttccgtggaaggctgtctccttggaggtctcacacccactctcttgcctgttcttgctgcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctag

SEQ ID NO: 19935 - DNA, 1089 bp, Homo sapiens
tgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggc

SEQ ID NO: 19936 - DNA, 1076 bp, Homo sapiens
gtaggaagtataattgaccatgccctagacacctgaaaactaaatattcaaaacagctaggaaatgcgtaagcactgagtctctttctggttatcatacctcatgaccacagagttgcacaactccaggggtaccatttacaatgtcagcaatgtaaggtggtcctccctagagcacaaggtagatcatattgtgaaaggaggccccttggagatgtacaaatggataaccttgctctgtgctaacttttctcacccgaaagtttggaaattttcagttttcttctttagagaatctataagatttcttcagattttttttttttttaaatatacgttggggggtgcagccgtgagagagtgaggctgacaccgcgccctggcctgtgcatcccgccctctgaaaaaaaaattaattaattaaaataaaatatactttagagaggattttgactgttctcaccacaaagaaatgacaagtgtttgagatatggatatgctaattattttgatttcatcattacacaatgtatacgtctatcagaacatcacagtatactctataaatatgtacacttacatgtcaattaaaacaaaactaagactgctaggggcttacacggagggaattgagccagcatcaccacgatggtgttgttggagagtgagcagttcctgacggagctgaccagacttttccagaagtgctggacatcgggcagcatctatatcaccttgaagaagtatggtggtggaaccaaacccgttccaaagaaaggttctgtggagggctttgagccctcagacaagtgtctgttaagagctatcgatgggaaaaagaaggtcagcactgtggtgagctccaaccaagtgaataagtttcagatggcttattcaaacctaccgagtgctaacatggatgggctgaagaaaagggacaaaaagaacaaaagtaagaagaccaaagcagcagcacagtaaagggcacaaatttcctgctttcaccaattaaccactgaattgttattttttcctttggtttttacttttggccacatagctaggtttctggttccc

SEQ ID NO: 19937 - DNA, 1092 bp, Homo sapiens
ggtccataataatagatctggttgtaaggaaattaactatgatgagccattcagtttatcctagagcttttcccagtgaaaaattccctcattttcctagcaaaagcaaaaaagactatctgcagatatcttactgcatggcacatagctcgtactcagtgaggactagttaaggataaggtagtgcagaatagtggttgcacggccatagctgttaaggaaatgagaaaaacatttcctgtcaagaggctgtgaaattaggagtacacatgagaccctggccttctgtaactttagtagcttaggttccttgctttgtgtacttagtaagtatgaacaagataaaatatttcttctgtgataaataagtatcttattatattcttatgagttttaccccttagtgaattactttagagattcttgtggtttgaaccttatttgtgcaccttcagtgagctgaggtgcaaatattgggcttaaggttttgtctagagttggaagatgctgattgggaggtaaggggcctttcactactgggtctacttctcaaattcaccctttgcatgtggctatcaagtttgaaaaaccgtagaacagagtaaattgctgcttggcaggccaacagtacacttcctgtagtgtgttttgtttgtttgtttgtttttgagatggagtcttgctctattgcccaggctggagtgcagtggtgtgatctcggctcactgcaacctccgcctcccaggttcaagcgattctcctgcttcaacctcctgagtagttgggattacagatgcccacaaccacacctaacttttgtatttttagtagagatggggtttcgccatgttggtcaggctggtctcgaactcctgacctcatgatctgcacgccttggcctcccagagtgctgggattacaggcatgagccttttgtttgtttttatagagagacaggggtctcactttattgcccaggcagaggtgcagtggcatgatcatagctcactgcagccttaactcctaggcttaagtgatcctcccatctcagcctcccaagtagctgggactacaggcacgtggctttcaagc

SEQ ID NO: 19938 - DNA, 1033 bp, Homo sapiens
atgctttttcccacttaaccatgtatcttggagatctttccacatctttctatgggtctgcctcattctctttaatggccacaagggttaaggatacgtgtaatagattttgaccattccctgattgatggtgtttatgttatttccgaattcttgctattacaagcatgttggcagtgaataccctcagggctcatgtagtaacagcatgtctgcctgaaaagcgagactctgggtcagaaaggtaagcacatttccaacttgcctggatattgcgaacgtgtcctccaaatagacagtgtaaaagtgccagttttttcacaccaagccaacacggagcattaccacttaaaaaatgtaatattgacaataagagaaaactgctctgtgtgcagagtattttctcctggtcccccaaggacaggactcctgagttgaaagtgccttcagggaacacaggtttaagttagtaattttgtttcagccaaagaaaattgactagaaagcttggcttgtggctttgcccacatccagactggtctctagcttcactgccactccccagagtcatccagagcatggaaggcaccactcagggtgcagagcctgtgcccccacccttcaggtgcccgtgctccccattgttgggaacagccttgtttacacttgttgcctggcgtaattactaacactccccaaagtgtcctggttgcatgctaatttctttttttgagatggagtctcgctttgtcgcccaggctggagtgtagtggcatgatcttggctcactgcaacctctgcctcccaggttcaagcaattctactgcctcagcctcctgagtagctgggattacaggcacgtgccaccatgtctgtctaatttttgtatttttaatagagatggggtttcaccatgttggtcaggctggtctcaaactcctgaccttaagtgatgtacccacctcggcctgccaaagtgctgggattacagacatgagccactgccccccagcctggatgataattcctatgg

SEQ ID NO: 19939 - DNA, 1021 bp, Homo sapiens
ggcctggcagaatctgggagtaggacccttctatccattgttctgagaaggtagccaaaggctggtaggaaagtcgctcatctctccctgactacctcagccttccagccaaaggagccggccatcgctgtcatctccactctttggctttggggtaggttaggccacagttcccgttgcctggagcaactctgagctcctgagaaagtgctcactggaaggcctcaatgaagcggagaacctggcccgtctttgggatcctgggccttgcagctgagctgacatacaatgtgggtatggcattgcccacaatcccatctgcactggctccagcttagcctccaggtctctggactctctgcctccatctaattgctcaccccctcctcctgcaattgtctttggcagtctcttccaaggaggcacacccattaggtgacttcactggagtcagctcaggaccaagacatcttcctcccttctcctgtggctctgacatgctcacaaaccatcagagccagaagtgaccctaggatttagaagctcaacttctttgatgtatagatgggtaaagcatgtggccaggagcatcgattttagggagcttcctccaacccccccaaaattaactgccttctgtgacagaactgtggctgtctcctgggctgcggagtgtggctggagtgggcgcagttgcagggaggagtagttctagtttttcaaatgaatccctttgactgtcctttagtgtatgctaataggatatgtttgtgtgtgttatgtgtttggggactggggtgggaatatcatgaccttgtcctcaggggaattgctggcagtagggttggtgttgtcagtcttgtctgagatctaaggacaacagagtggagagttcattttctttaaggactttcccccatccagcgaaaaaccacacacacccagatttccttagaatacatttctagcatttctctgctggaactggtgggtttgggcgctctagagtggagggcatgtg

SEQ ID NO: 19940 - DNA, 1090 bp, Homo sapiens
agactttatgagaaagggatcaggtgtggcttttctatttcaaacacttaccatagtgcctggcacatagtaggtggtcaaaaaagatttgctacatgacacgggagacgcagacatgtagccagattattgcagcatggtaaatgtcacctgtaaagggggtctctataaaaggcttctagagtacagcctgaagggaggtcactctgatgaaatcactgaaacttctctggaggagatgtttgaatgaagaggaagagttcaccaggtgagggggtgtgggggaaacgacacaggccatggaagagcctggcatgttttgggggagttgtgagtcattccttgtgattggagaggctggaaacaaggttgcaaggtagagtccaaaacctttggtgcctactaaggagtgtgggttttgtcctagtaatgatagggagccattgaaggtttttaagtagggagaaacctagtcgtctcaggttgacctccgatatttccgtaggacttccgggttgtgggctttgttctgatggaatatgctgacagaaacacatcacttctaagatattcttaccccaaagcgcatatcttgaatctaattgtcaggaaaccctgaattaagagatttttacaaaattattgtggtaagaacagacagcatgagatctaccgtcttaacaagtttttaaatgtacatacagcactgttaactataagcacagtgttatacagccaatctgtagaaattattcattttaaataattcatttaaataattataattcgtaaataataataatttatttaaattcattaaattattcattttaaacaactggcctgtattcttcaaaaatgccagtgtcatgagagacaaagaaaggctgagaatctaaaggagacagaagagacagctgaatacaatgtgtggcccctgactggggaggaaggaggaaattactacagtagatgttattgggaccattagccaaatttgaatatgacaatgtattatgtaatggtgttgtgtcagtgttgcatttcctgaactctgtaattggattgcagttatgtaagagaatgtcct

SEQ ID NO: 19941 - DNA, 1090 bp, Homo sapiens
tcctggccgagatggtgggacattctaacctggggccccttacctgagtctaaaaatgaggcctgccctcttcactctgcactatttcctccctccccgcagggggcgctcagtacccacaattggacttactggcagtgtggtcagtaccttggcgttgggcctggtgagtcccgtgaactacagaaagggtgactcaggagaggaatgtcgtggctgtgtgaacttgggccacattaacctctccaagcctctattttctcatatgtaaaatgtggcaaaaaataatacctccctatagaactgttgagcatgaattataaggggcttaatgttgcaccttgcactagggttctcagcctttagtgtgtatgagaatctcctggagggcttgttaaaacccaagctgctgggccccaccctcagaattcccaattggacagggctagaggagagcccaagaatttatatgtcttggcattttgggatagatgattaaaaaaaaaagaaaaagaaaaaagggcctggtgtcatgtgcctctaatctgagctacttgggaagctgaggtggaaagatcgtttgaccccaggcgtccaagaccagcctgggcagtatagtgagacaccacctcaaaaaaaaaaaaaaaaaaaagaaagaaagaaagaaagaaaagaaaagaaaaataatttatatttccagtatgttagaggcagttgctccagggaccacatgatttaaatctggtaaacacatagtattaacagccattaatgtggggatggttgttgatgttgtcaggggcccatggacgatttatgccccagggggctggaggccacacccgggaggctcggatccagacactggagcctgacaactggatgaaggaggtgatgctgtttggccatggcacccggaagcgtgtccccctgggcaggctggagctgtgagcatccaagggcacagggctctcctccaggatccccacaccccaagaccatgtctatttgtatatcttttatttcctgtcttgtcctggcccctgccttgccacatactgtatggtccctgttagcctcctctaaatgc

SEQ ID NO: 19942 - DNA, 1073 bp, Homo sapiens
agcgggccgaggagattggcgacggtgtcgcccgtgttttcgttggcgggtgcctgggctggtgggaacagccgcccgaaggaagcaccatgatttcggccgcgcagttgttggatgagttaatgggccgggaccgaaacctagccccggacgagaagcgcagcaacgtgcggtgggaccacgagagcgtaagtcccgcgggccttggcctgagcccgggctccgtgggggaggggagcgggcgcgggctgtggccctcctggccgcggcgcgatgtggccagggccgcacccggggtcgagcgtctgacccggtgcccatggagccaggagggaggatgctgtccggacccggggatgggggtgatttggttttgttgttctagtatcaagggggtccgggagagcccttggcataattgaaaagcaccttgatgaggcggggaaacgcgggaaagaaggatagcagcgtcttattaaatctagcggctccgaggtttcacctcattatgaaatagggagaagggcacatttttctatagtttgggttgaacgtcgtatttagactaaaatttctgaccaggattcatggtaaaaatcgtggcggtattttatttaagtaattacagcatgacgcttatacggggaaatagaaatgtaaaagaagtcgtttacttgttagggtttaccgtgatgatttacaagtattgttcgttaacagtattctaagaagtcccttatagaggcagctgtcaaggttttttcttccacataaaactcatttgatgctcttagcccggggagtaaaggtaaatattataaccccagtttcactggtgagacttaaaaaggctcacccaaagtcttggcaactgaggaaactaatctttgtagttctgttagctttccacaatcctatgaaactggttctctgcacctactgtagcatttcaagtgttttgatctagttttgaacatgcagtgtaatgtttactttaggtcttatctggagaatagatacagaatttaattttactttgaggttataatctaacatgctaattttaaaacaat

SEQ ID NO: 19943 - DNA, 1029 bp, Homo sapiens
gtttttttggagacagagtcttgatctgttgtctaggccggagtgcagtggcgcgatctcagctcactgcaaacctccgcttcccaggttcaagcgatgctcgtgcctcagtctcccgagtagctggaactacaggcgtgtgcctccatgcttggctaatttttgtatttttagtagagacggcgtttcgccattttggccaggcaggtctcaaactcctggcttcaagtgatctgcctgcctcggcctcccaaagtgctaggattgcaggtgtgagccactgcagctggcttgtgttccttttttttaaccaataaaatttccaggtattcctggattttaaattaatatttgtatgtgtatggcatttgaggtattccagtaatatgtcctgtttcagaatacagtaagtctgcatttaacgtcgttaatgggttcttggaaactatgacttcagttgaaatgacatataacaaaagttttaccatagactagttaatataaagaagagttaggtttctgtggcacattctggttacagaaacataactaaaaagacccaaaacatttctgatatcaaacattgagataaatttgaggtatacatacatttaagaaagatgaataaaagcgaggtaattacccagtttttggtgaatcagtgagtgatggcaattttagtggtggtgagttaagtcaaggaataaatgtttacaacttgaacattgtcagaagcacctcctacctccattcagttccaacacaataataaagatggtaaactcaccacttttggactatgctgtttattttcatgcatttgtatgattatcatatgctttacagacttttattttacaataatttcattgtaatatacaatatattcattcctttccagcctccttattccagttcagggtggtgggtggccagagctgatcccggctgcccaggatgcaaggcaggaactaaccctggacaagatcccctcccatcacagggcatactcacacacccacactcacc

SEQ ID NO: 19944 - DNA, 1103 bp, Homo sapiens
ttcaagacagggtgtgatagtgttgcccaggctggagtgcagtaaatagcacaatcatggctcattgcagcctcgacctcccaggctcaagcaatccttctgcctcagcctcctgggtagctgggactgtgccaccatgcctggctactttctgtattttttatagacatggggttttgccatgttgcccaagccggtctcaaattcctgggctaaagttatcctcctgccttggcctcctaatgtgttgggattacaggtgtgagccaccatgcctgaccaacgctgccttttcttttcatgtgttatagttgtgcattaataatctccccagagctgggcacagtggttcacacctgtaatcccagcacgttgggaggccaagacgggcaaatcacttgaggtcaggagttcgagaccagcctgaccaacatggtgaaaccctgtctgtactaaaaatacaaaaactagctgggcatggtggcacatacctgtaattccagctactttggagactgaggcagaacaattgcttgaacctgggaggcggagcttgcagtgggctgagatggtgccactgtgctctagcctgggcaacagagtgagtgagactctgtttcaaaaaaatatatagtaataatccacctagtaacagtgaagttttgtgtgaaggaaaggtgatattttggaattttgatttacatggtttgatttgtagtgttataaaattaaatttgggatagagcagttttggaatatatctgaaggagttacaaaagtaccagtgggagagaattaaacattggttttatgttaatagtttttccccatactgtgggaacccaccaagagaattgcttggagccaggagtttgagaccaacctgggcaatgtagcaagtccccatctttccaaaatattttaaaacatttgccaggcatggtgcttgcacctgtagttgtagttacttgggaggctgatgtgttaaggatcttctaagcaaaaagatggtgccaaattgctttaaatgagtgttaactgtgatttagatggttatttccaaatcctaatttgtaaataggccctaatctatgaaagagatg

SEQ ID NO: 19945 - DNA, 1047 bp, Homo sapiens
gtctttattagcaaacataacactgattttgctaaccataagatttttctttgtttttatttttcttgaggccaagatttttcccttaaatagtagtaactgacaatatgtgattgaccaacagaagttgaagataattgaattactatcctttcaattaagcattttaattattaaatagaaatattatgtatggtatgtgcaagtttgcatgtttatctttgttttcaacttgttggtaatacgttttattgtcttcaataggccgctggcccaacaggcaaaaatgaagaaaaaattcaggttctaacagacaaaattgatgtacttctgcaacaggtgagaattgtgtgcattaatgtcaggaagtaatgtgaaacagacatgtaaccagcaaaaatacaaggatgggccaggcatggtaactcatgtgtataatcccagcactttgggaggccgaggcgggaggattgcttgagccggagaatttgagaccagtctgggcaacaaagtgagacccagtctttacaaaaattagccaggtgcaatggcgtgtacctgtggtcccagctacacacgaggctgagttaggagaattgcttaagcctacaagggcgaggctgtagttagacgtgtctgtgccactgcactccagcttgggcaacagagtgagacctcgtcttgtgtgtgtgtgtgtgtgtacatgtacatatatatgtatctgaaaggacagcaaatatgaaaagacgctcaacactattagtcgttagggaaatacagattaaaactgcaatcaaatacctatttgacacctatgagaatagctaaaattaaactgatcataccagctattggcaaggatgtgagccagctggaactggggtataatattgcacaaccactttggaaaaaatagtctcatttttttctttcatattcctgtagatgatattggagtctgttttgttgtcgttgttactgtttttttgacagtcttgctttgtcacccatgctggagtgcagtggtgcgatctcagctcactgcaa

SEQ ID NO: 19946 - DNA, 1026 bp, Homo sapiens
tagtcaatgtgcttagttccttaattagttttgtatatggacattattccttgaacctaagcaaggaatgtattcatactaaaataggtggctttctgaaaggtgatttaaattttgtaaggtaatgtgggtgttgaacattgaacagtgggtctcaacatttcttctggatgattcagtaagttagttgctgttaccttaaacatccctctctaaaagttgaccacttgtagtccaatattactgatttggggaaatggaaaagagcaattcacacacattagaaatcttttctaaatgttgagtactttcctgggatttgtttctcttcctcagatgttcttaaaataactgatttatcattttagacaattgaaagctttgctgcacaagaaaaacaaatggaagtttgtgaagtatgtggagcctttttaatagtaggagatgcccagtcccgggtagatgaccatttgatgggaaaacaacacatgggctatgccaaaattaaagctactgtagaagaattaaaagtaagtttttttgtttgttttgaggcagattcttgctctgtcacctagagtgcagtgacgcgatctcagctcactgccacctccacctcccaggtttaagcaattctcatgcctcagcctcctgagtagctgggagtacaggcatgtgccaccaggcctggctaatttttgtttgtttgtttgtttgtttatttttgagacagtctcgctttgttacccaggctgaagtacagtggcgtgatctcggctcaccgcaacctccacctctggggttcaagcaattctcatgcctcagcttcctgagtagctgggattacaggcacacactaccacgcccggctgatttttgtattttttttaatagagacggggttttttcctgttggccaggctggtcttgaactcctgcctcaggtgatccgtcctcctcagcctcccaaagtgctgagccactgcgctcggccagcgtaaatttcttctaaagatacattttagc

SEQ ID NO: 19947 - DNA, 1790 bp, Homo sapiens
atggcttaaatggagatatgaccctctcattgatattttcctatgtgtaattatttttgaagcattgtgagttctgtgaaattttgctatttattgaactatgaaagcacttgattttcttaactcttgagtgccagaaatttgggaagaatattcctgaggattagacaaataatgataccttgtgtatatacatggtgttggaatgtctacatttcccttaagggcatcaattccataagttggtctacagataacttcacattagttgaccattgtttaacaatgctttaaagttacatttgcataagaatccaacttgatttttctaggaaaagttaaggaaaagaaccgaagaacctgatcgtgatgagcgtctaaaaaaggagaagcaagaaagagaagaaagagaaaaagaacgggagagagaaagggaagaaagagaaaggaaaagacgaagggaagaggaagaaagagaaaaagaaagggctcgtgacagagaaagaagaaagagaagtcgttcacgaagtagacactcaagccgaacatcagacagaagatgcagcaggtctcgggaccacaaaaggtcacgaagtagagaaagaaggcggagcaggtatatataaaacaccctaagactgtccagctcataatgggtgtgcaataacaataataactactagtattattccttggaatggtacttgggaagctcttaagcatctttaagtgataggatgggttgcgagagcggaatcagtgaataaaatagttccatcttcggggcaacttctgtgccatttcccacctgtctaggaaatttcacccaacctttttacaaagttagagtacctgatggtctcttaagtgcttgtctcactgattccgagaaataaaatatgaaatcagccatactgttttaattataattacaaattgaagaagagtcttaaagagcacaacgataaccatcttagcactattggagatgaatttagaaagattttcaataatttttagttcttaagatttctaatgtaaatatgttttagagggtaagttttgcctagtcttgttaattaatagcatctactccaaggcctttacttattgtaatactggctgaagttgccttttggttttaaattattaagaagtagagatcgacgaagaagcagaagccatgatcgatcagaaagaaaacacagatctcgaagtcgggatcgaagaagatcaaaaagccgggatcgaaagtcatataagcacaggagcaaaagtcgggacagagaacaagatagaaaatccaaggagaaaggttagtttatatgagaattcagttcattaagaaacttttcacaccctaatcgccccactcacttttctccagacacaggcaaagatccatttcatacatactccttttcactttgaggaatgccattcagtaggagacaggcattctttccccctctcctacttagatttgtgaaaatgacagtttatctggtgttttcttagatgttaaaaacatctttcagttgataaacctgaaggtttttaatgtagcttcttttaagtgttatattacctttcggggttattaggtgtaggatttattatattaccttggttattggctccttttttttttacacactgcagtgtttcataatacgtcttataaagtgagtgtacattgttgcattaatcttcatttgtagcattcatttaagttagtaattaacatctaagtacctagaagttgaattgcttacatgtgtcttacccac

SEQ ID NO: 19948 - DNA, 3381 bp, Homo sapiens
tcaaatatatataaaaataatgttttgcattgaaaaatatgtagttgtagtttttaaaacatgcctgttataaacattcaactttttttcaccttttggggtctccatttttacccttctaacttaataattgaacctcatgtgaacatagttttgtatgctgtcttttatacctttcccagtgctttttgatgttttttacccacaatgaaatttacttaaatattatattctgcaatgtgcttaatagcttctcaccaattgagagaatttacccactattttaccttttgcttccttgaattccccttcctgccttctctctcatatattacaaattttatccctttggtaaattcaccaaaccgttgcttgcagtctgtgggaaatgattgtctctcatctctcagttgtttcactttttttcaaaatcatgtctttattgtattttactttaaaatccatggtcaatgtcttcttttatggcagaaaagaggggatctgatgataaaaaaagtagtgtgaagtccggtagtcgagaaaagcagagtgaagacacaaacactgaatcgaaggaaagtgatactaagaatgaggtcaatgggaccagtgaagacattaaatctgaaggtgacactcagtccaattaaaactgatctgataagacctcagatcagacagaggtaagtgtattgtttctcactttgattagggctttttgttactgtttgacagtgcagcgtaagtatgcacagatgaagatggaactaagccgagtaagaagacatacaaaagcctcttctgaaggaaaagacagtgtagtcctgcaaaacattttgaggtacattgttttgtctcagctattttgtagcagactcgtgcccccattagtgtgcctctttggaaattatcgcccacatttgtaatatagtcgccattgaaaagttaattatcctttttttagggattttgatgtcatttcttttttttttttaataaaaaggttgaactgtttttttttttctttttggtattaagtccatcttgtgttggtacattggcagagacatatgctttaaaaacttaaatatttcggaggcacatgttggactactttgttttaattaaactgctagtatttctttgtcaaggatgtttctagttttttgctttattgccttgcattctaatgcagtttgttctgtaactcgagagccagtagcattggattgatggaagtgtagggtttatgaattattgcagctgactaccatacctcacacagcgttggtgttgtgagcggcccatgaaaagccaaattaaaaatcaaggattcagtcaaactaagcaggtactcatgccaggtactcctttctctacccacatccatgtttgaatgctattgcctgtgatctttacgcttaactgttgtgtatcttttttgttctttacaagaagtgcagaggggttttttgtgtattgcgtgaaaacttataaaacaaatgttaacagaatggaattttttttcaactgtatgtagggctgcagtggtggccagaattagatatctttaaagaattttaaatacaataaacacttcatattattcgccttgttacactcaatgcaattctcaagtctataagaggtatgtgcttaatatttcctactgtgtaggagaatttgcagtcagccataggtatgtaggaatagtcactcactggctgatacatttaaagcagcagtgtgaatagcaaggacagacaccttcaatttgtgaaatcaaagaactgatgcactatatagaacgaatttgggtttttaaagaaatattaaaagttaggtactgtaagtgttcttaaaacctgtaaacttcattctgtgggctagtggtgtgggacaaaatattcctaatgaaaggaagtaccaattagttgatttgttggtggcattccccttttgggaaagcaatgtaaggttatgtctgtgtatgtcattcacacttaggcaagcatacacaggcacatggctttaagaaccacactgatgccttgataattaaaaagaatacaagcattccatgtacacatgttaattagcagttagtgactgggccaacactttctcataaaaattggccttttacatgttgtctaattatcatttttccccaaattttgcgttgtaggactactgttcgaagatttttggaagaatactgagaacggcataaagtgaagatcgacatttaaaaaatgaggtgaaagaaagctatagtggcatagaaaaagtataaagctcagttagtttttttattattattattattaaaagttaattcaggactgatgtgacctaccagatttcagaacatgtgttaatagtatatatgccactgaaaacttaggtcctgtatcatacttttttctttaagactttttaagaaatattacttaaacatgtggcttgctcagtgtttaattgcaagttttcaatcttggactttgaaaacaggattaaacgttagtattcgtgtgaatcagactaagtgggatttcatttttacaactctgctctacttagcctttggatttagaagtaaaaataaagtatctctgactttctgttacaaagttgattgtctctgtcattgaaaagttttagtattaatctttttctaataaagttattgactctgaactagtcccctgttttaaatacaagagttacactattactagaggtgttggtgtacagttttatctgatttgttctgtttaagactaatttttatagactttctaatgttttaaataatggtgcttcaattttaggtggttatgaataaatttgaattttgcttttaatagcaaagatgtgcagtgaactagaatatatttttacatccctgagagattcatttagtagaaaattccaagtatcctgacaagcactctttagctggctagctatgggatgatgtagaaaagcattcaagagctagtttttgttaagtcctgtatcaagattaacccagctgtgtcagtttataaatgtatttgtgtatagggtgtgtagtatatatggcaagggttttttccccccacttaagtgattatttttgtgtcacatctaggaaaaccggcagcatgtttctatctatagccagcttcttcgactgtataaaagtattctctccagctacgtatatacacacatacatatatatcatagcaattccttgtggtttataacttgcaaatactgctatcagtttataggtaaagaaacagtgtgttaaatgacttatccagggagggtcctgtggcttcatgtttatggagttgctaggtctctgcctcatggtccagtgcctgttaa

SEQ ID NO: 19949 - DNA, 1031 bp, Homo sapiens
ttgtttttggttttctgtaatgacaagtccatctgtaataaaagtgagttatttttagttttctaattaagcacagaaatttcaagaaactagacaggatatccttggaatgccttaccaaaagaaacacttcatttttcacgtgttctagaagcacaacttcttttaccattaggcaaataatggtactgtaccaaacatctagaactgcgggaccatgtgtcttgattagtaattttatattgggggggcatattaggcatggctgagactaaaatgtctaaagatagatgaattgtaattttgtcaaacttatctgtacttttcaataattctctaaagagaagggacaagttctcttttctgaatgtcttcaatctgtaattccagatttgaaatatgagagcagtcatctgataggtactgattaaatatcagtagcattaaaagcatttttaagtcagaaatgtagatgtcaaaaatttatgagttattgctgcttggcctaggagtgtaagaagatgtctgaccaaatataaacacacacacacacaccacacaaacaacacacacggaggccccatggcatactggaaaaagcaatgaagggtgggtactgggaggtctgagtttcacaccagtttcaataaacttttagttttctcacctataaaaagggttgaattagatcatatctaatgtctccttcaattaaaaaaaaattccacacttggctgggagcagtggcttacgcctgtaatcccagcactttgggaggctgaggcaggcagattacctgagctcaggaatttgagaccagcctggccaacacggtgaaaccccgtctctactgaaaatacaaaaattagccgggtgtagtggcacacgcctgtaatcccagctacttgggaggctgaggcaggagaattgcttgagcctgggagatggaggttgcagtgcgccgcgatcgtgccactgcactcctgctggccgacagagcgagactctctctcaaaaaaataaataaataa

SEQ ID NO: 19950 - DNA, 1035 bp, Homo sapiens
gtgatggtgttagaagagataatatgcatgtggccacccccacaaacctttaggaatgcagtgcataattaggactaaaggcactgatttggatgtggtgggtgataggtggtctgtgggagtaaatgagatgaatgagacactagaagtaggttggaaatagaatcctggggacaagaatcagtggagaaagaggtgactgtgaaggaatcaggatgcaagaagagtcagtaaagtttagccttcaagaagtcaacagaagggggagaatttgaattctgttttcaacctgtttggttggaggttctataggacatctgtggctatagtggtgatagctggtctctttgtaacatgattcctgtaaataccagtttgtggggttaaatctatattcacttaggttgtgaaagcccttttacttggtttttaatctattttaatccttttctctttgtagttctaattgtggagtggtaaatatatacaatcaagattcttgtctccaagaaacaaacccaaagccaataaaagctataatgaacttggttacaggtgttacttctctgaccttcaatcctactacagaaatcttggcaattgcttcagaaaaaatgaaagaagcagtcagattggtaaatatttcattacccctttattattgttattttttaaatttaagttgaaaacatgcaagagtaacaggaaaggagagcgttgaattatttttaaaacagtggcttcttttgatataggaattattagtattgtagcttttggatgtggttgttggaaggatgcacagtagccaccacatttgattatgtcacttctttcagtaaagctttgctgtccattctcaccattcctaaagtggtcctcattttcagaggtttcttttagtattaatgttaaggactatatttaaggcagacacttcattccttcacaattttctttcctcatttacctttttaaggcctgttgtcttaacagaacggaggcaattctcgggttttgaaagtaagttgaact

SEQ ID NO: 19951 - DNA, 1035 bp, Homo sapiens
gcagtggccacccttgtaagcagacctttctgttttttttgttttttttttttttgagaccaagtctcactctgttgcccaggctggactgcagtggtgtgatctcggctcactgcagcctccgcctcctgggttcaagcgattcttctgcctcagtctcctgagtagctgggattataggcatgcgccaccacgcccagctcatttttgtattttttttttttttttaagtagagacggggtttcaccattttggtcaggctggtctcgaactcccgacctcatggtccacctgcctcgggctcccaaagtgctgggattacaggagtgagccgccgtgcccagcccagaactttctaaggatagcagccttgggcctatgtaaactcttttctgcccaacatcagagctcactttcagtgtcaccccatctctgtgaagtttcctaatcttcaggcagagccaattttctcattcatttaacaattttttgctcaaggcaccaggtatacagaaggcatagaactttgaatagcagaattatgtttgctgctatgtgtgtactaccagattgtacgcactttacaaagtgtgttatttttattgtgctcacttggcaaaaagccttgcatctgccatcagctttgtattagaatatatcgtttacaaagatttacaaagagttctacaaaaagtttgagccaagtaacagttcttcagaggattaacttaaccaaagtaaacagttaataaagggcagaattgtgatttagattccacatttttttctagcagttcattggttttctggctgaattccacagagccctagattctgcacagggctttatatggcatgtagggcaaggaggaggctaagctccttaacttgtatcatgtagagcagtgtcattgttgtctgtggtatatatattgggattctgcatatgatttccttaagaaatgttttgttgcgctgggcacggtggctcagacctgtaatcccggcactttgggaggctgaggtgggtggat

SEQ ID NO: 19952 - DNA, 1027 bp, Homo sapiens
agtaaagaggcccagatttggaaaatttagatcacagctctactaactgctgtgacaccgaacacaccacttaaacagaaccttagtttacacatccttataagatggtcagagtagctaccattgaggagatgctttcccttaatggctgtgcttttttggatattagaatgaaccccaagcagaaatggattcagactgtgtcttcataggcaaacgaaacttcagcagttcttctgcttaattttttaattctgtaaacatggactaactgtcagctatgtgcctggacctggatcaggcactggtgaggccaaggtgagacgtggtctcaaacctgagggaactcactttcttgtagagaagacgggcacagttttgtgtggcacctttgcaatgcaagaaaatgcaaaacacacaaaacttaggagaagggagaaatgaattctgcgtggcttttgaagggtgaataggagttttcttttctagggaggtaagctttgtccattcggtgccagattcaagttttttgttgttgttgttttgtttttgtttttgtttttgttttgagacggggagtgacacccaggctggagtgcagtagctctcggcacactgcaacctccgcctaccgggttcaagcacttctccttcctcagcctcccgagtagctgggactacaggcacatgccaccacgccaggctaatttttgtatttttagtagagatggagtttcaccatgctggccaggctggtctcgacctcctgacctcaggtgatctacccacctcggcctcccaaagtgattgggattacaggcgggagccaccgggccccgcctcaagtggttcttttcctggattgaaagcaagctaaactttggggttcccccaagcaagtccttattcttccccttctctatcttttttgtttttttctccatttcccccagaacccggtgttttcatgcttagggatcttgtccttctcttaggaagatgttagcgcattcatactgagtgttcc

SEQ ID NO: 19953 - DNA, 1028 bp, Homo sapiens
tccagtgtccccaatttacctatatcaggatgcctctactagagacagaccagaatacttatctcccccttcataacttacccatttttccacatttatatatttttcatacaatttatctgtctagaatatagctctatactcatttttactgttcttagccattttgcaaagcccagcttccagttagccttttccaaaagtcttgtaagaccacctagccctaaataatcactcttgcctataagggcctatagctggggtgactgtgtaatttatcatccaaaccaggacatttttgaaagtgaaagggtgtgtcatcattaataaacaggacattgggaatatacctgtgctaccctgggtaaactgggacagatattattccatccatagctcatatgtttggcctgcacgtcccttcagcatttagcatttagtactctgcattggtgttaatgcccttctggatgtgctgggactcctcaataagtctgtcctccagactgttacattatgctcatacttccacatatccccagaacctaacattttgccatatattttagtagatactaaattatgtttgttaattaggatgctgatggaacccattatttagcagtttttcccttacatttttaggaggtggttttgccagataaatataatgtttaattttttttctaatttagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaaggtaagtctgttgtatacctcatgggatggtaaatttctaagattagggatttaatagcttacctcctgattgtttcacttatcttttatatatctaggattgagctagaaaagcatttttgctattttagtttctgtgtaataataattttttggcattggatggtgccctttttctgaagaa

SEQ ID NO: 19954 - DNA, 1034 bp, Homo sapiens
gatatgcattcataatttggagtggttttaatggtatagattacttgccttaataacttaatgttattaacgttaatgttaaactgttaatgtaatgtaaagttaatgttatgaagttattaataagaagcaggaacctatgtaggtggtaagatgggattcatactaatgttgctcgttgagtggagaattcttccttaaaatgcatccaaataggatcctcccctctacaaaggagaaagtatggggagaaagctgtgataaactacatgacacttttttttttttttgctttgttttcagactaccagtgagccttctgccccatctcaagatctcctcgacctaagtcccagtccccggatgcctagggccactctgggagaactcaacaccatgaataatcaactttcaggcttaagtaaataaacactcaggtcttttcagaccagcagaagagcttgatgttaaacagttctccttaattacgtgattaaataccacctaagaaggactgaagtcaggttgaatgtcagagcgctatgttaggagatgtgattacttcccggcaaatggttgagtcaaacccagtatagcaatgggatgtgtctgggcgaggaggtccttgaaactcatcctactcacttagaatctcatggaattcacctggcctgctttgtagaagttgttcagcccaatggccaatacttaaagtctactgtgaacctacacactattatcattgggtttttctgctatacctcagcatcaggtaagggagtatctctgatgcaagcggagaaattcagggattacaaggtatgaactgagtggttgtgaaatgtagaaggaaaaacacaggctttaaagtcagagaagtccaagttgaaatgccagttctgccacctctcagccacctaacttttgagagtctcactttataaaatgggaacaatgattgccttaaagggtggttgtcaaggttaacaaactaatgtttataaaatgcattgtagcaaagcttacaatgcatt

SEQ ID NO: 19955 - DNA, 1050 bp, Homo sapiens
aaaattagccgggagtggtggtgggcgcctataatcccagctactcaggaggctgaggcagaagaatcacttgaactcaggaggtggaggttgtggtgagccgagatcgtgccactgcactccagtctgggtgacaaagtgagactccatctcaaaaaaaaaaaaaaaaaaaaaagattatggactggagcttgaggtgaaggtagagctcagtatgtactgtaattttttacttttgtgctaggcagaacaagatgtaaaatcctttgcattctggatcagcttgggattttagaaaatccaatacaataatatttgttacccttacaacaacttcttctcatggcagggaaattctttctctctctacctaccataaatgatgctttttaatttctcttagagctaggaaatctcatgattttagggtgacagaaatatctaaattaatctcttttatttggtgggtttttcttttttttttctttttcttttttctttttttttgtttttactgtagaaaatccagcataactgactgacaaaatgttttaaagccaaacaagtccattttgtgttttagatttcagccttccaagttctgatgtaacaaacaacttaaaacccagtcttcatccacagatgaacttgctagccttggagaatacagagatacccccgtaagtatgtcagtaacactgcagaactaatatcatgacatttagattccttacaattaagaaaacctgatggctgggcgcagtgacttacatctgtaatcctagcactttgggaggccaaggcacatggatcacttgagcccaggagtttgagaccagcctgggcaacatggcaaaacctcatctctagtaaaaatacaaaaattagttgggcattgtggcatatgcctataattccaactacttgggaggctgaggcatgagaatcacttgaacctgggaggtagaggttgcagtgcagtgcagtgcaggcgatatagcacttggtacatagtaagccttcaataaattgtctctgtttatttttagt

SEQ ID NO: 19956 - DNA, 1065 bp, Homo sapiens
cagaaactctgattcagcagcaagaatctttaacatgcattccaggaggatcataatgcagtggttttcctatcatacattgagaaaccctatgatgaacatctataccaagattcgagggcgtatacctggtttaaatcatatgcctaagatcacttgtgagaggcaaaatcagccattaaaatgtcttataatgttgagattttttccatccctttgtttgcagtttaatttattcaccatcacagaaaaagtgggtgatgcagtttttcataacagaaagaatccttaaaaaacaataacaaagaagacaggataaaacataggtcattttttttttgagacagagtcttactttgtcacccagactggagtgccgtagttcgattttggccaactgcaacctccaccttccaggttcaagcgagtctcctgcctcagcctcccaagtagctgggattacaggcacccgccaccacacccatctaatttttttttttttttgtatttttagtagagacctggttttaccatgttggccaggctgtggtctcaaactcctgacctacggtgatctgcccacctcggcttcctgaagtgctgggattacaggcatgagccactgtgcccggctcataggccatatttatgacccatttactaacaggcaacaagctaagaagtatagaaatgcttactaattacttaacctatgaggtatgtgccaccatcattttcattttaaacaagaggaaaccaaggctgaggaagattaacttgccagtggttgtccagctagtactgagacaggattcaaatttaaatgggattcaaaatcaaattctgatttcagtaacttctctctttttgtttttagttttgtactttaattttatttctaaaattttcatatactaaaattgaccttttttgttttggtttggtgtacagttttatttattttaacatacgtatagattcaaataactacccccagtcaggatacagaatagttccgtcactcagcaaaactgccgtgtgctattcctttatagtcacaccctt

SEQ ID NO: 19957 - DNA, 1044 bp, Homo sapiens
atttttatatattctcataatctcttttaattgatatgttaggcaatttacatttaatttaattgtatgtagagtttaggtctactgttatatagttattctatgtgttcctttttttctgtttcctttttcctgctttcttttggattattagaatatttttagtgctccattttagtttattgtgattttgactgtatctttgtataatggtgtgtgtgtgtgtgtgtgtgtgtgtgtgtgtgtgtgtgaaataaagttgcttggtaaataatgtggtttaaagtagctgattcttttcctgttattttgctaattttgttagcaaaatatatatatgtatatatgtttatatatacatgtacacacacacatatatataaagagagtttgctttagtgattgcagtatacttatttttcagtctacctaaaatcaatgctttactacttgaaagtaaaaacctgggccgggcgcagtggctcacacctgtaatcccagcattttgggaggctgaggcgggcagatcatgagatcaggagatcgagaccatcctagctaatacggtgaaaccctgtctctactacaaatacaaaaaattagctgggcgtggtggcaggcacctgtaatcccagctactcagagactaaggcaggggaatcacttgaacccgggaggcggaggttgcagtgagccgagattacagccactgcactccagcctgagtgacagaaagagactctgtctcaaataaataaataaataaatacataaataaataaaaggaagtaaaaaccttatcaccatatagattccccttttctataatagttatcttatatattactcctctatacattgaaaagaaaccactaacagatgatgctgtaatttttgcttacaaccctgagatatattgcaaagaattcaagaagtggccgggcgtggtggctcatgcctgtaatcccaacactttgggaggacgaggtgggtggatcacttgaggccaggagtttgagaccagcgtggccaaaatggtgaaac

SEQ ID NO: 19958 - DNA, 1072 bp, Homo sapiens
gactgcaaactgggtggtttaaaaccacagaaatttattatctcacagttctggaggcaagaggtctgaaattcagcagagtcacactccctccacaactattacggggacatctgttccctgcctcttccagattccaatgacttgtgggtactccttggatttcttagcttttggtcatgtcactccaattcttgcctgtaccttcacctggctttttcctgtatgtgtcccaaatctccctctgcctttctaaggtgatttgtcattggatttatggcccacccagataatacaggatggtatcctcatcttaagatccttagttacatttgcaaagaccatttttccaattaagataacatttataacattcacatattctgagaattaggacatgagcatagcatttggggggccaccatttaacccactaatggaacttcttgaatgtggtttgtggctttatgtctttcaccaaacttgtgatgtttttagtctttcttttcttcagaactacagtctttctgctctcctgctggaaccctgatgacacaaatgttgacctgtgccattgtctcataggtgtttggggtcctgtttgtttgtttctttgttttactctttgcttctctctgtttagattggacactttctgtgatttatgttcaagttcaccgactgtttcctctgtcatttccattttgctattgagctcattctgttaagttttttttttaattcagttattgtagtttttagttctgaaatttcattttggttctttatatcttgtgtttttgctgagactttctatttttcaggtttttttttctaaagattgtttgcagttctttggagcatgtgtacaatagctgccttaaatatctctgagataatttcaacatctgtgtcctcttggcatcgatatctgttattgtcttctcatgcaagttgaagttttcatggttcttcatatgcctcataattttggattctatcttggacatttttaatgttttattaggagactcttggtcttaatttaaatcacatcaagaatgttattttg

SEQ ID NO: 19959 - DNA, 1050 bp, Homo sapiens
actatgcttatgtctgactaaatggcaggacagaaaggaaaaaagctgtgggtatcacagctcctattgaagaggaagattcttctgtgtttcaatttcctacaagtcccattgcctcggctgtcgctacagccactttggggttgcctgtggtttgggttgtgagaaaacagagagaagaggacaaaaaagggacaagagatttctacattctgagtgttaggattgtttccctttcctgcttcttgagtgagaatgagaacccttctcctagagctctgtctgttctcattgatgcctggggttcagactgcattgcatttggtcaggaaatatgaagaggcaaaaaacggtaaattcaccaacagttcagtgatacttgaattctggtcttctttcccaatcaggctgctcctattattcagagtcctcaaatacttgctctatgcattccgtccacctttaagtgacattcagtggagagacagagtgcagtacgtttgctccgctttatcctggaccggagacctcacagctttcttcttaacctgtgttctatactacttctcatcctttaagaaacgatggggtggtagctacactgatggaaagactaaaggctctggtcttagtgttccgtgcacactccacagtctcagggctcccaccacccatggcatcataacctgatgtgcactaaaaccaattgttttataaacagttattacaaaatgacactttatgcagtctgaaggtaccttttaggttttgtttttagactaggaaaattatcttactttttgcatttgtgttctcactgtagggtaatcattctgtgttatcacactatcctaggtttgcccaaaggaccagccaaaacctcacctcaagccacgcatatgataatgtaagtaacaaaactcttttctagcagtgcatctagtcagcagattattgtagccagaaaagaactcatggtcattaattcccatgttctgctcagtattgtgttgatgcgcagcccctgttagcaagatggtaaggatcaaa

SEQ ID NO: 19960 - DNA, 1025 bp, Homo sapiens
accaaatacatgtttacaaaatttgtgttaatgttatgaaagaatatggcaacttgaaagtttgtaacagaactaatttaaatgaggattagagaaagcttcaggtagcattaatgctgaggcctgcaattcttagttaagtgaaaagtttggaaatgagtattgtaggcccaaggaacaacctgtacaaagacccagaggacagagctctggcacattcaaggaaatggaaatgctaaaaccaagagtaaagaaagttaacagggagctcagtaccagatgaggaaaatgtaatttggaagcaaaaaggagcgagtacaactgtgaagaacagtgccaggggcagacaagtaagataagaactgaaaactagataatggattggagatcattgatgattttagtaaaagctactttgatggactgatgaagacagaacccaaatttcagtgcatttgaaaagcacatgagagattaagtagagacagtaagtacagataacttcttagaacttaaatatgaagcagtgatgaaaacaggtttggggccgggcacggtggctcacgcctataatcccagcactttgagaggccaaggcaggcggatcgcctgaagtcaggagtttgagaccagcctggccaacatggcaaaaccctgtctctactaaaaatacaaaaattagccaggcgtggtagcgggtgtctgtaattccaactattcgggaggatgaataggagaatcgtttgaacccaggaggtagaggctgcagtgagctgagatcccactattgcactctagcgtgggcaacaagagtgaaactccatctcaaaaaaaaaaaaaaaaaaggggttgttggtagctagaggatactaaggcatttactacaagaagagatggaattaaaggctgtactttgtataaaatgggagacatgggagatgctggagaatctgtgaatgttgaagaataggatctggcatagaaggagaggttgaagactcaggaagggaagaataactgaatgg

SEQ ID NO: 19961 - DNA, 1058 bp, Homo sapiens
tgtaataataaagtgcacaagaaatgtagtgcatttgaatcatcccgaaaccatcacccctctgcaaccccattccctctccccccaccttggaaaaattgtcttccatgaaacaagtccctggtaccaaaaaaggtgaggggttgctgctctagatctcagattttgatttaataagtagtttaaagaaaaaaataggtgcagatctctagactaacctgtgtgtgctaatttactttatcttagggatcctgcctttcagatgattacaattgccaaggaaacaggccttggcctgaaggtactaggaggaattaaccggaatgaaggcccattggtatatattcaggaaattattcctggaggagactgttataaggtaaaaatatgtcccatgcccaccaaaaatacaaacaaaaagacccaccagtggtaaagtttattttttcttctttattagtgaatttatatccactgtgaccatacctcagtgaaaaatacaaaggaattagaagataagactattgccctcaaggagctttaaactaagaaataaataggttcttcttctatgaaaataatagatatttctgactgtaagataaggttattatttttaaattacatgctgttcaacttttatcctgtatctgattgagagaaattatatttgatgacttgttatctttctactactttgagtttttattaagttggatcagtagaactttaattacattcatttagcctctactaaatgcaaaacaaaacagaaacagcaaacaaaatctaatttctgaattcgcagttcttgtagcttgagctaatgagttttatcactcattaaaaccagaaaatgtctttttttaggaattagaaagtcttactctcctcttcagtgtaagaaatatataatgagctccctttcactttggttggtaggaagctcagacccaaatttgaaggacaaccccagcagtttaacaaactagttactatatttaaattctcattcttcttggatttcatttgctgtttctgttttactaaagtgatta

SEQ ID NO: 19962 - DNA, 1035 bp, Homo sapiens
ttcgtcataggcacatatttttaaaattattttattaaataaggtatagtatattgataattatttaatttttattaaatagaaaatatttacaccaaaaggaaagaaaatttgttttgctaccttagtttttataatctcaacctctagaggaagccattgttgcaaatatattatttatcttttcatagatttttctctacacagaaaattatattttttaaaaataggcagggcatgatggctgacacctttaatcgcagtactttgggaggctgaggcaagaggattacttgagctcaggagtttaacatcagcctgggcaacatagcaggaccccatctctactatttaaaacataaaaacaaaaataaataaatatatgtatatgtggggacagggagtatgtgagaaatttctgtactttcccttcaattttgctatgaatccaaaactgcttcaaaaaataataaagccttaaaaaatttttttccagtatgtgtgtattttcacttctatgtaagtcacttcatccacacttttttttttacaacttgccttctttttttttctctctctctctctttataagaattatatctcaggcagcttttcaggttaatatacacagatctaccaaattcttttcaataactgtcctatacattaaatagttatttggccagttccctattgatggacattagactatttccagtttttaaaaataatttcatcttcagcagctttgtagatgtatctttgggcatttgtacagtatatacacagaatgaatgtctgaaaatataattgctttattaaaagatatagacacttaaaattttgcatatgttaccatattccctttgaaaaggttttgccaattcacattccttcctaaagtatatgagcatttcactactataagagtattttatatatttcttttcttacctttgaaaccgctatctttccacattttttagtgcaacaattgttttgatggaaaataaaaatttagttttaaaaatacat

SEQ ID NO: 19963 - DNA, 1045 bp, Homo sapiens
agtaaagatagaaagcctaaaaggccattttctgtagaagagataaagtaagttatcaagaaactattctagataaaaggaccaggcaagatggtttcacagagaaatttaaccaaacctttgacagtctcaaaactatataaattgtttcagggtataaaaaatgaaagaaattttccaaattcttttcatgaagcaagtatagcgttgatgtataaacttaataaaaatggcacaaaaaagaagatacagttagactagaaaagcaattagaggcatatgacttggaaaagaaaaaataaaactgtctttttttgcagatgatatggtagtaatctggaataccctagagagtgataaaagtaactcagtaagttgataagctagcaagatataaaattaagatgcaaaactaaattgcatccatatacacaaataataaccagttagaagttttaatagttaaagagaaaccaaaattatatagaaaaataggcaaaagacctgaacagataattcatcaaaaaagctataaaaatgtccattaaacaaatgaaaagatactcaatctctttctctcataataaaagaaatgccagttaaatctatactaccatagaacttctagcttctaaaatcattaagtcaaaccgtctaaagaatgatgacattcattgggggatgacggaggacatcccccaataaaaaataactccagaacctaaacatttaataataagcaactaccaaaggaactggagaatgaacatcatcagacaaattgctcctcctggaagagaagcagaatattaacatgtacctagaagtaagaagtaaaaattacatgaaatggtattctttttgtttgtttgtttttgttttagacaaagtcttgttccatccaggctgtagtgcagggacacgatctcagctcactgcaacctccacctcccgggtacaagcgattctcctgcctcagcctcccaagtagctgggattacaggtgtgcaccaccatgcccagctaattttagtatttttagtag

SEQ ID NO: 19964 - DNA, 1059 bp, Homo sapiens
tggagaacccccgactctacaaaaaatattagcatcaaattcaaggagtattacaaataacaaaagcaactctaaatttagcagtatgaagaaagcatacttcaaaattttttcagttttcatagccaatttatgtaacactatcaataattaagatctgcatattagcttatagtagaaaaataggtaaagtcattattttttatttatattatgaaaaagttcaatttcactataaactcttatacttatctagcttcataaactttccttttccttgtagtttgtagtttaactcatttacatgcactgatattagtgagaaaatgtaaatcacactgccattttcttttgtctggttactgaataatagatgcaccttccttttgtttaagaaaacctttaattggagttaaaagtacagaaaatcttcgtaaatctctttcataactcagccaagaagtattggcaaataacatagcatcagaaaatgtattgtcctccttttttcttttaacagttttataaactactgatgactcaatttacgtgcgtatactaaacagtgttagcaactgtatctatgatgcttttcataaaatcagcttgagaaaactaagcacaaatattttcaatatgtatcatacagtggaataaaacaataaagcagcctctttcttctttgaaaatgtcaatacattcaaatttggttgttgttgttgtttctaattttactttgagttctgggatacatgtgcagaacgtgcaggtttattacataggtatacatatcccatggtggtttgctgcacctatcaacccgacatctaggttttaagccttgcatgcagtaggtattatctttatgctctccctccccttgctccaccgcccgacaggccccagtgtgtgatgttcccctccctgtgtacatgtgttctcattgttcaactctcacttaagagtgagaatatgcagtatttggttttctgttcctgtgttagtttgctgagaatgatggtttccagcttcatccatgtatctgcaaaggacatgaag

SEQ ID NO: 19965 - DNA, 1028 bp, Homo sapiens
gggaatgggagcaggggagtctaggaatgggtttgctctttgattagagcattcaaggaagtattaaagtgaaggaatgtttgcctaaggcctagataattaatgggaagaaactgagtttgaattttttttaatgtgaggtgtactaaagtagtttccaatagatgattttccagtttcaatagcaaaatactgaatgcttttcagaaggcagtgcgaactttttgttgttgttgacacagagtttcactcttgtcgcccaggctggagtgcaatggcatgatctcagctcactgcaacctccgcctcccaggttcaagtgattctcctgcctcagcctcccaagtagctgcggttacagacacctgccaccacacccagctaattttttgtatttttgtagagacagggtttcaccatcttggccaggctggtcttgacctcctgacctcaggtgatccaccagtctcggccttccaaagtgctgggattacaggcatgagccaccacgcctggacagtgcaaacttttttatgcaatttttttttacataatacatactatattcagtgaagaggcttcaaaaatctataatagtcatatatttttacttcactgaattaaggtagaaaatcgagtaaattgaaataaatattcatacatttgttcacttacaaacataactggttatgtatatctctaatccaatcagtttctaagagaacataaagaaaatctgaataatttatgactatttaaacattaaaaagttaaatactttaaatatagcatgtgaaaatgaaactagtgttacaaatgcaaaataccaaagaaaatttgaaatctgttaaaagtcactaaactatttctcacattattcacttaaaccaattccacaagaaggctgaagttcccatcaccctttgataataccacaaggcgaagaggaaaacatatagtttacaaatcagcaatatttaggaatattacatatttgttatttgtgacctggtttttacattctgaaa

SEQ ID NO: 19966 - DNA, 1050 bp, Homo sapiens
gaggaagaacagaatcaactcttgtgtatatagatcctaagtaggtaccacgtaccatctgctgagactttctgattaaaatatttctgtcgaagattatacctttttttcagagcaacacaccttatagaaggggaataagactacagacaaagtttcctgtacagaaagtcatgactatgagtgaggatgatacaccataatgagcatgagagatgaaaaaagggagaaactaaagtaaaaccattagagtgaacctcaaccagcccaggcataaaaggagcatgaatgatgccttctgaaagtggatcattagtgcctgccaacctgttgcaatactgaagcactgcaactattttattatctgctggaattgtatttctaccaaaagatactaaagagggtgtgattgtttaattatgtacatatctggatatatattacagactccatgggcacagttttgttttgtcttgttttgttttaaacttggctaaaatgaatttattatcatgtttagagactgtggatgggaacgtagcttgtagggtaagaaatcctaaaaggttaacactaccgtgtacaattacttatagcctcaataaggaaaaagcgtgaaagtactcaagtaaatcaagggaagcttcacagaattctttgatgaacttacatgtttaaacaaatatacaaaagatggacaaagaaacaacctagaactaacaaaaacttttacacatagtgttagggaagttaaggccaggattaacttaaactttgaaaaataaaggtgagaagaactacatttaaagcagtaatgacaaagtagaagacttggtttttaaaggtaatataaaggggaagagtctaagtgttgtgttggacagactctttgggtggtttccatgattcctgtttcctgatgttcatgcctttgtgtgatcctctcccttggagtatgtttgagacctgtgatttgcttgtaactatacaatacagcaaagtcacaggttgtacatgactatattgcatgagattttagtgccaattttg

SEQ ID NO: 19967 - DNA, 1083 bp, Homo sapiens
aagtctttaatccatcttgaattaatttttgtataaggtgtaaggaagggatccagtttcagttttctacatatggctagccagttttcccaacaccgtttattaaatagggaatcctttctccattgcttgtttttgtcaggtttgtcaaaaatcagatggttgtagtgtatagcattatttttgagacctctgttctgttccattggtctatatatctcttttggtaccagtattatgctgttttggttactgtggccttgtagtatagtttgaagtcaggtagcatgatgcctccagttttgttttttttttgcttaggattgtcttggctgtatgggctcttttttggttccatatgaaatttaaagtagtttttttctaattctgtgaagaaagtcaatggtagcttgatggggatagcattgaatctataagttactttgtgcagtatggccattttcacagtattgattctcctatccatgagcatggaatgtttttccatttgtttgtgtcctctaatttccttgagcagtttgtagttttccttgaacaggcccttcacctccattgtaagttgtagtcttaggtattttattctctttgtagcaattgtgaatgggacttcacttacgttgcagctctctgtttgtctattattggtgtataggaatgcttgtgatttttgcacattgattttgtatcctgagactgctgaagttgcttatcagcttgaggagattttttggctgagacagtggggttttctaaatatacaatcatgtcatttgcaaacagagacaatttgacttcctctattcctattcgaataccctttatttctttctcttgcctgattttcctagccagaatttccaatattatgttgaatggggtggtgagagacggcatccttgtcttgtgccagttttcaaaggaaatgcttccagcttttgcccattcagtatgatattggctgtgggtctgtcataaatagcttttatgattttgagatatgatccatcaatacctagtttattgggagtttttagcatgaatgggtgttgaattttatggaag

SEQ ID NO: 19968 - DNA, 1050 bp, Homo sapiens
agcaaatgaagagtagatgactgggaagagaggaaactcatggagaagggaatttcaaagaaggagtgataaatgctgataacaaggggacaacatgtgaaaaaaggattggctgaaatcgtaaacatttgtgacttttagaagagaaatttcagtagattggtgagggcacaaatacaatttactcgaacaccattttgaatgtcaatttaatctttcttttatgattcatatggcatttcagtacctcttaggacctcttggtcatttcataaatattggttatgtaacactgcagtttaaaagatacaggattaagaaaaatggtataggatattgtatattgaaaatttgctaggagagtagattttaggtgctcttaccacacacacacacacacacacacacacacacacacacacacacacgaggtagctatagaaggtgatggctatattaatttgcttacttgtagtaatcatttcaccatgtatttgtataccaaaacatcatgttgtacactttaaatacatacaataaaaatgaattaaaagaaaaaaggtatgggaaattccactgaatctatactgatcctgtaacatatgttaaaagttacttgatttggacaaattcctgcttatgcccagatttctgtgactttctagtgagatgtgctctgatagctgtcatcgaagtgtggtttaactgtatgcatagttttgctaaattgagaagtgctatcataagagggaaaatgttagttaggccagcaatatttttattttattttctgctgatataaaaaaaaagtgttaaactttatttttgttattttgaaaagacctggaaagaatgaataagccggaaaaactgctcataacccaccatggagaggcaatcgtcatttacattttggcctaattacttttagtccttttctaacttgctaacacttttgtgtgttgtttgtttgtttgggtttgggtttttttggtgttttttgttttttgcataatgaaagaagcagcatatagtggctaacagcatggg

SEQ ID NO: 19969 - DNA, 1039 bp, Homo sapiens
aagtgattttactgctccttgcagggttgggggatggttaggaaggcatcctgaaagaggtgcagtacaaaacctcttttccatccacaagatgaaacattttcgagtttgtgttttttttcttaattgggcctcgaagtggccacaccttggggtttgctaattacaacatgctgcagtagttgctgcattgcctgagtgcagtacccgggttctgggtggtatccttgcccgtgtcttttcctacttcattccctaacagattagaaaccaccaccctagttcctccctacaaagatttgtaatagcaaattgtttaactgctcgtcatttgatgacattttttaaaattaaaaagcatctctccttgcagaaactgacagggcctttcaggagctcatagtgtatctgcttctgcagtgaccaggcccatatctctgccgaccatcaccttcagtttctttctcaggagaagcagccaaaaaattccagggcggtgtatgaggggacatttcagcttctaagaaggagagtctaccattgggacattaaaaccctcagggtcgatcatttataataataatagtgtgaacttgatcataacctgatgacttggactatcttttctacaagaatggagaaaaccctgacatcacagagcacaggttcccattgctctgtgatttatattcttcttaccctttctgttttttcctcctacaccttgtagttgggtggatatttatctatcaagaaaaatgcattccattaaagaatataattatttatatgtttaattaattgaaggactaatctggtcataggtatgaggtagctaccttcattactaggttgaagtgatacaattccacaaagcaaaagtatttataactttctttagcctgtttggggaaagagaggtggggaggaggccaaagatttgcagatgagagcaacgaggaggagcaggaaatgttacgtccagaggacatgaaacttagtggattaacattttttgtgttagggtgaaaatatgaaa

SEQ ID NO: 19970 - DNA, 1064 bp, Homo sapiens
ctcaaaaaaaaaaaaaaaaggctaaattgagaagaggtcaagggtgtgttggaacgaaggatggtgttgagtacagtcattgaaatgattgaccttggaatccaggccgcactgggaagtaagataaattaaggtgagaccagtagcctgggttgggactaatagaagctgagagcttggaggctgtgataaatgtaaagagcaaatgtaatgggaacacaggcatgaaaagcctggaagcatcaagtagagccattctagatggtaaggtctgaggtgtagcatataaaacagaaatggaagatgagattcacatctgtagttatcagccttaaatggaagctttatttctggtaacttcactggacagtataaaatagccatgtgaaaagtaaatgcagaaagcatctccattgtcaaaagaacacaaagactaagattgacatttaattatgactcaagcttaggtggaaccatagtctgttgcttattcttaccctttctcacaggaattcacaatgaacaactatttttctgttggacctgatgctctcatggctctcaattttcatgctcatcgtgagaaggcaccatctctgttttctagcagaattcttaataaggtgtgttggataaaataacatttcctgcttatcaccgaaggtacagtaaaaatcaatagttcaattatatttagcactcctagattcagatttaactaacttacagaaatatttacctgctctgttttgtgtagggttgtcaaattagatcttttttttttttaattagatctttaaatgtgctttatcaggccaggcacagtggctcatgcctgtaatcctagcacttttgggaggcggaggcaggtggatcacttgaggtcaggagttcaagaccagcctggccaacatggtgaaaccctgtctctactaaaaatacaaatttagccgggcatggtggcaggtgtctgtaatcccagccactcgggaggctgaggtaggagaatctcttgaaaccaggaggcaaaagttgcagtgagccgagatcataccactgcactc

SEQ ID NO: 19971 - DNA, 1039 bp, Homo sapiens
ggcatccagcctggtgtttttctgacacatggcccaggctttgtggtctttcatgacattaatctctgaaagatcagaatgtatcccccaaaataccattagctatctttgagggtctattatgaatctgtcatccatgaattgccataaacctaagtttgcctcacctcaggcccagaccatgttttcaaagagcaacttagtaatgtatacagtagtcagtacattttatgaaatactctattttgctaaattaacctcttgcagatctcctcaggtgatcttaaattctagtcttgagaaactttgtgagcagatctgttttcagcttctttatatacctttcatggtaagtaaccatggcagtgaggatggcagagttttgttttttttttttttaatgggccaatcatgttctgagtattatgaagtttatcctttcattcatgatcaaaattgttaaagacatcacattttataaatacactgttaaatccactttgctgtaggttatagtttacctgttatataattcgtagtgctaattgtagtagaagcaaatcaatttaggatgttggaacgaaaataatcacaataactaatacagctttttaattgtgaaaactacaattaaaaattataattttaataccaaccataatattacactgtatttagaacaggcttatgtaaaatgccctcatttatctaaataagttgattttttggttattgtaatctagtaaggtttttgcatcactactggtctgtcatgaagtttttctgctggcttattcacttatttagacttcatttagggaagctatttcagaataccatctcataaaatgtatcattatcttgtttttgcaaaattcacttactttttgggcacatttacccagcatttcaaataagtgtataggcatgtgccttgtttaagtacaatttataagacttcatgtttgcaagttacatattagggtagtgattgtttatattaccagggattctacactttaccaaaaaaaattgccat

SEQ ID NO: 19972 - DNA, 1034 bp, Homo sapiens
ttggagggcagggaaggcggaggagatggctccagctctaccctgttgactgtcttgcatgtgcggttgccagtatcctcctacctggctctgtaacatccctcctccccgctctcctgctctccccaggtgtaattacttcaagcctccaggatggcaatccagttccgttcgctcttccccttggcattgcctgggatgctggcgctcctcggctggtggtggtttttctctcgtaaaaaaggccatgtcagcagccatgatgagcagcaggtggaggctggtgctgtgcagctgagggctgaccctgccatcaaggaacctctccccgtggaagacgtctgtcccaaagtagtgtccacaccccccagtgtcacagagcctccagaaaaggaactgtccaccgtgagcaagctgcctgcagagcccccagcattgctccagacacacccaccttgccgaagatcagagtcctcgggcattcttcctaacaccacagacatgagattgcgaccaggaacacgcagagatgacagtacaaagctggagctagccctgacaggtggtgaagccaaatcgattcctctagagtgccccctttcatccccaaagggtgtactattctccagcaaatcagctgaggtgtgtaagcaagattcccccttcagcagggtgccaaggaaggtccagccaggctaccccgtagtccccgcagagaagcgtagctctggggagagggcaagagagacaggtggggccgaagggactggtgatgccgtgttgggggaaaaggtgcttgaagaagctctgttgtctcgggagcatgtcttggaattggagaacagcaagggccccagcctggcctctttagagggggaagaagataaggggaagagcagctcatcccaggtggtggggccagtgcaggaggaagagtatgtagcagagaagttgccaagtaggttcatcgagtcggctcacacagagctggcaaaggacgatgcggcgccagcacccccagtcgcagacgccaa

SEQ ID NO: 19973 - DNA, 1034 bp, Homo sapiens
gagcatagaactttaagtcgaccctgatttatttatcgattatctcccttcaataaaacttctgtgtttttgtgttcaggtcacagtggcagagggaaccctgcccctcctcgtgggatgggcgaggagcttgtaaatgatatgtcagtgtgtgtttcagttaaaatgagtttctctgctttctggctgtccctccttgctaacgctcgccagagaaatattccgtggaggtgttaaaacaagactagtggaaagaaatggtaacttaaaaagaaagaaaatccatggcagtgaagaacagatttcatattagtactgtcataatattctctaatgtatcatataaataaaaatctgtttagaccagaattttaataagtcaccaaaggaaggttttgaatcctacagtttatgtatccccctttgcgatgtaaatgttcacatctcaagtgaagtagagtggggagacgcttcggagactagaggctgttaattagtgaggtatattttgatcagggcaagaagactggttcattctatatcttcgtatttctctggatgattatttcattttgtaaaatatgtaagagttcccccccagccccttatctttttaaaaattaaaatggtcatgctcttctaaaaagatgacttaatttgaaggctttggagacatgaggatgatggggatccatcactccctgttctttgctccctttggactggagtgttggctgtctggaagagttttgcttgagctcgtgggttattttcttctatgtggaggaaccaagagactctttagcatctttcagcaagagcgaggtctgggtgtactcaccatctgtcttaattatccttgtgtataagaaaacattcccatcttttcccaattgccatttccttccttaacttttagaggccagaacctcatctgttgatgcagggagatctcacttctttaacctatttctagttgccttcagtcacagcggggtggccaggggcgagtcacttaagcctccccaaggctc

SEQ ID NO: 19974 - DNA, 1040 bp, Homo sapiens
cccccagaccccttggggcatcccctgtatgtgggtccctttcacttcatgtccactgggtggaatttaccaggtattgctgggaacggggaacaagatcatgattataagtggatcctggacaggggatggagtgcgtgtgaatgttagtgtgtagaggacggaaagggaaggagagaaggggtggccaggaggagggaaatagcagtagattacattgactaattatagggaaaaagccatatttgctgctccattaagtgatcactaggctatgaagcagtttattgtaattaatgcagaaacagcaagtaagtgtttgagtttggagtggagggtcttcaggaccccctccctccttcagttctctgtgctcactgtctccctcccctccctcaaattcattatccttggagagaaagagtcttgggggagcatctctttgggaagggctgtttagcacagtcttggaccagttttctactggtttattttgacaaagaaggaagatcttttacctgacctccttcagaagattctgtaggggtttttatgttttctaaggctgaaggaggagggacaaacccatgtcatcattgctattcttgccacaatcattttaatttcagcacatgaaagtggcaggttacacatccaagtccatcgagttatgggccgtgtggagttgtgattgctttccttgatgatttcttgttcaaatcagcagtgctcttaattttccagatgaagtaaaaagaaaattggagactcccctcccgcctggcgtctcttcatccaaggttttctgagcatgactctgatttggagggttaatattaattaggagccagtttagacctcagttgcttgatgaggtagcttcaactgttgtcacgaatgtggctcctttttgcttgtgcctgcttttggtgaaagtttctgggtttaaaagccaaaggaagaaatatgcagagaaagatagaggaggggacaattactaaagaagtgcaaagcattctcttagaacttgagggaggaac

SEQ ID NO: 19975 - DNA, 1031 bp, Homo sapiens
agtaggtgttttgaattctgtgggatggaactgaatgtttaaaaacagttacaggaacgtctccccaagtaggtattcctgagaatttctgtgtacatggaactctattttcttagcaagcatcattatatttttagaaatgttttcttttctccttgcccgtcagttagccaagcctcctaccactcactttctgttgtgtagttctgattttccgaacaggtgtttagatgatgaggggttatattaagaaagtactaaagaatacgtcttatcacgtgaatcagtatctttttattcaacatggatggagtgggagtggagaccaatctgttttatattcctgcaatctgatgagggtaagaaaaagttcatgctgttcatattagctagccagcctctttctgtctttccctcccttccttctttcttctttattttttctttctttcttttgtctaatacctaattccttatctcatttttgggattttgagagaataattttcatgtggggcgacagaactagtggttgtagtttcacttgtttttttgacattaaggaaacaacaaatagtctttttttttttttcctcagactgagcacacattttaagtgttttagggggaagctctgaaggcagtttgtggtgatttttaaaaaaatgtttttaaagctttagtctctcctggaagctttgtgtgtccctgcattttcctcgacggtcgctaataagaactgctggtctaaatcagtgtctctgagagtcattgattcactaattgctcatcatcgagtcctggcttccccctcctgctgagagcacttttgttttctgctattctgcaaggacttggacagatttctggagtgtttaagaggtaaccaataaaagagtttggcgtgcccctgttggtaattgtgcttctcggaggtgaccacgtcattggtatccgggctccataaacaaggggctgccttaccagtgacctttcccgcctaaaaccgaaggccccaaggtcgcttgtct

SEQ ID NO: 19976 - DNA, 1040 bp, Homo sapiens
tcgttaggactgggggcagcagcagatgagggaagacttgtctcctctggcccatggagtgtccctgtttttcagctcagccagcatcccatactcaattctgccggcgagagctgtgggcctgttttgcaggttgtgtcgtttcagcgggtaactggtatgtgtgtgcatgcgtgcaaaagaaaacatcaaaatgtttggggagtgttttaggaaaatagcaaggagcagattgccaagattcgcttatatgtttctttttctttccttttcgctgtgtacatgtgtgatcagcatcccggagtgttctgaaatacagctttggctttcttaccccaactattcttccgtatagcagagaggatacaattcaccaccaataataccgagcaataaataacccagagaagatgaatagccttgtgtggtggtaaattaaagttgatttattgcacataatatatacaggtgctcctaatgtaattaagcagcgaggcttttaatgttgcagaatctgaaagaagacccaagaaaattgggtcttaataaggcttattgaaataacagctaaacatgctgcttagtaccattaggggatgctgaaagatggatcgactctgctgctttttcttatgtgtggagatgacacacctgacctgttgtcagcaggtcccgcacttgaattgttttctctacggtaggactggattgttttgagctgtcaatataccctggccttgtcctgcttgtggccagaagtttaagtggctgcctattgaataggttttttttgagtgaaggacgggggagctggaactgaagaccccactgtctacagccataccaccctgaatgtgcccgatctcatctgaagaccccagcctcattctcccccgccattctaactaaccaggccaggcaggagaggatttgttcatggagtgaactcactgattgagcctttaccatgggcagagtgctgtgctggagattgggagtcagggatggaaacaaaagctagacagtccccctcctcagga

SEQ ID NO: 19977 - DNA, 1034 bp, Homo sapiens
gtattgggttttctctcttctcctgaaaggctcttgttgacagcagacagcttctcagagcctctggtcaccgacctgttcttcccttcctttctcctgtgctgttttcaagacagaaagcccagctgtggcaactgcaggtctttggattagtttgacacctggggggttcccaggtgaaaatgagggctgcagggcagggagcaaagcccacttgggagttatgtgttgtgttggtgagaaacaggttgagaaagaagcagctgctgagaataatctagtgtatattggggcggggagcatattggtggggggagagggactgtgttggtcgtgagtgaccctgagtgatgggtaccgggggttcattctctcaatctcatgacttttgtgaaagtttgcaaaggtcagaagccagaaagaaagatcaaaagccaaaaagaaagggagcagctgaccccaagattcccacccccaaggcattacccccttgaatcaggtgtaggtctgtttcctcatctgttccacacagattgagtctacaaagacccaggtctcatatcctgcaggaaagtggagaagaaaaaatgtgagactgattttttttcagagttttgactgagagagtccgttttcccatggacttctggacatccatgcctgagaagcaccttgggttttccctgctcccaagtcggactgagctcagggaatctccagggaaatgcgggggtccgctgggcacttgggccctcccaaagatccaggttccccattccagtggaagcctttgccctcctgtccctgcagcctccttggttggtgccgcctccctgggacaggtgctcctgcgtccctggcagggccaggattgggctccagagggcctgcatctgcctgtgctgcgctgccaagctccgtggaggagcagttgcctaggtcagcgtcctgtggcctcaccaggggagacttgtcttagttgccaggatgggcagagaagaggggatggagcagacacactgtctgccgctgtg

SEQ ID NO: 19978 - DNA, 1024 bp, Homo sapiens
cgctgttgtaggcactggggatggagcagtgaacttaacaaaatgctgagatgtgtgtatagtagtcaattagcgataagtgctgtgactgaataaaacagtaaaggcatggagactgaaacggggtgaaacggggagtgttattttaggtaggattgtcagacaaggcccttgtgagtgctcttcagggacagtgctccaggttgggagcacagtgatggcaaaggcctagaggcagaagctggcatgtgtgaggagtagcagggaggtccaggtagactatttggggctagtggaaggagctgaggctggacagacaggaagatcagatcctgtaagactctcataaggacttgggcatttattcggtgtgcaaggggaagccacagtggggttctgagcagagaggacttcagagcagagtttgacaagagaggacttctgtgtaggaggcccaccagttactgcatggcatagaaacagcagagggcacgggtaacggtgaagagggcaggtgggagctgctgcacttatccaagggccagggtggtggtgaggacggtggtgagaagtggttagattccagctatgtcttgaaggttgagctatgggatctgctgaagactgggatgtaggaagttctgggaaaggactattaagagtaaggccaaggcttttggcctgagcaaataaaagccttttcctatgatgggagaagactgtgaggaatagctttggaggtgaaagtcagcgtttggaaacctttccacattcccagttttcttcttctcttactcgttttctttgggaaagagttggaggaatgactccatctactttactgcttcttttttcggggtaatacaggacttgaatagtagttaaatcacctgtgttaccaatggtctttaaaccaaaactgcattactcaatcaggaaatatatacaggtaacctgcctttccttcattctgagacttatttcttgttcataatgcttgtgaaatctgaatgcatttaaataa

SEQ ID NO: 19979 - DNA, 1025 bp, Homo sapiens
aagatgatatgttgctagggcccagccctagcaacgtatcatcttttgaggagtgttcctcatactttgagattggttttatagagggctgttccttatactttgcgattggttttatagagggcaactctgttcacccacaaaagtctcttgatgccattgctggccagaacttgggtgggagaatgggaactgttcagcagagcaggtgaacaggtggtcctgccatcccagtggcaggggccccttcctttctcccgccactcccggaggaatgaccctgcatcttatgcactctctccgattccccaaatcccctaggtcccactgcttgggtttggggagtggggcacatctctgctgagagccagcccatcaagctgtctgggtctcatggtggcatatctttgttccaactcaatatgggcattttaatctttatttatttttaaaatttaattttattgaattcagctttaatattattgaattcagctacaagggagatagaatagggtgattgatagttaagagcatgggtcttaaagtcagaaagacaaaggctccaagtccagttaccaacttctgtaattctgtaattctggggggcggacttacctgtctgagtcttagtttcttcaactataaaatggatgtcccagtactgcctccctgccaaggttgtctgagtgagtcctcaataaaagctggtagtgagattaatagcacttgatggcaaagtttgtacccagtcatgggtaggggaattgcatctgccatccagtggctgaggtcaagtgatgacaccccaaactataggatcctggcagctacagcaggcattgctgcttccctttcggaaatcccaattgttgaggccctggctgaagccctgtcgagcccttggtgaccccactaccatttcctttatggttggcttactctgctttcttttgcaatgaatatagtttaaaatttctttatgagtgttctcctatttgctgccttagcctgtcacccactat

SEQ ID NO: 19980 - DNA, 1029 bp, Homo sapiens
ccaaatgtccattgatacacgaatggataaacaaaatgtgatagacatatgattaaatagtattcagccttgaaaaggaaggcaattccgatagatgctacaatgtggatggaccttgaagacgtgctaagtgaaatcagcctgttacaaaaggagattatggctcctcctatatgaggttcctagagcagtcaaatccatagagctccccaccccttatgacatcactcagcaactttatttattaggtcacaagggggtggggagctctgtgacaaaaagagctctgtgacagaaagagtggcgattttatgttatggatattttaccactgtaaaaacataataggctgggcatggtagctcacgtctataatcccagccctttgggaggctgaagtgggcagatcacttgaggtcaggagttcgagaccagcatggccaacacggagaaaccctgtctctactaaaaagtaaagaaattagctgggtgtggtggcgcacgcctgtaatcccagctactcaggaggctgagggatgagaattgcttgagcctgggaggcaggggttgtagtgagccgaattggcaccactgcactccagcctgggcaacagagtgagattctgtctgaaacaacaacagcagcagcaacaacaacaacaacaaacaacaacaacaacaacaaacaacaacaacaacaaaacataataaatgaaggctgatgggaagccttatgtgggtggggttaatgtctctcttaagccagacaggtgagaactgccctctagatgtcctttgaaaatatagcactgcccaggctggtctgtcaatattagccagctaacgtggtccttaggtcccaggccacttcccaggtaaggggctccatccccgtgctgacctgcattttccttctaggtggggatttcaggtctagaagcagctcccacctgaaacctatgttcttggttgctttatgtgataattattgtgttctattttaagccactcctctgagtttggtaaccg

SEQ ID NO: 19981 - DNA, 1037 bp, Homo sapiens
tgctttgctctactgatggttggtagcattgtttacctctggtggtgggaatgacagggtgctgtttgtaccattttcggttcttttgttgagagtgacgtcacagttgtcctgcagcaagccagggttatgccaccctgtcagctatgccagaatggcagcaggtgtcactggacacataccattccttctttacaccatctatcaacctacagtggggaaaggggcaagaatacagcataatgagaggggcagccagttgtagctcggggaccttggattctaagcagcatgaccttgggaagggtcttgagtctttgagcctgtttgtcctcttaggaataaagcaggttggacagaccttacttaataggcatgcttaaatctgccagggaaagggaccctcctgttgatgaataattcattctggttttgttcctagaaagtattccatggggcacacactttctcagctgctcttggttttgcaaaggaagatactgacatgttcagattaagaaatcgtaaagcttctgaactactaaggaagggaaaagaggggcccagggcccacatgtgtgccaggtgctgatctgagggttttttgtgactcatctcatttaatggtcacgctgttcctgtgagtaaaagctgtcatcccattttatagatgaagaaacagaggcacagagaggttaccttaatttgcccaaggtcacacagaatcctggtgttcaggcctcatgccttctgttcttaactccatatcctgtgtccctgggaaaggaaggggccatagtctggagtggtttccaggagaaaagagccagagtaatctctgctcttcatttcttaacaagaatagaagacagaataaagggcacagggataaaggattgttaaccagactggcaaatcagtagactaattaaaaatcaaacaccttaaaacactgtcgctgggttaattgtaaaccaacaatgaaacgttaaaatttgcccagcccatgagtttgaatgattaactgagtgagttaa

SEQ ID NO: 19982 - DNA, 1049 bp, Homo sapiens
aggctgctgtcccatctgtggcctctgttgctctctcatgttcttttctgcccagagaccaggtctgggggtgttatcaggagttagtcctaagactggaatgagactcctgggattcaatgatggccagttgaccacaagatgtttctgttaggttttaagttgagattctgctacgcctgctttgatggctaggtaacactcctcagcaccaggtgatggatttaacctctgtgagctgtgtttctaacctgactgggcccagggatcatgctgggaaagttatggaccctttacccagagacttgcgctacaacacagccacatacagctttgcactgagggtcaggatgcacagatccctggtgctcagacatgaatggccttattagagtgaagaaaccctgtgttgaagtcaccaaacagctggactttaaatgttaatgttaatatttcactgtgacttatatagcattttattttttccagagttccttacaagacaatctgatttgatccgcaggagaatcctgtaaggtcaattatatagtcgctcttttatatatgacgcatgcagtaggctcagtatcttccctgagtgttgctgttttcttgttaatttgctaaatgggcttttaaaaaggagataaatgtaaatttcagccccgtaaaatagatacatctcaaatgctcgtgactcaaattaattaattaaaaaacagaataaaacaccactccagccacaaaacatggcaaggttgtaatgtttattccattcagccagttgatggggtaaaattacgagattggtctgtgataaaaatgtttttaactccaacttagacgtttacagaaaggagagacttgggcagtttgtttatttagaacattgattactgcttctgccatgttcctccaatcacaaacacttgggaaaattttggaaaactgcaagaactaagtaaaaatccccccaacgccactatttaccattcagagataactgctatgaacatttcggtacatttttttctgtcctttttcatggc

SEQ ID NO: 19983 - DNA, 1023 bp, Homo sapiens
tctgtagtctcggccattccttctaacatggtttctcagcctgtctgtgatgtttcccaaatgtcatagtgaaggactcagaggttccccaagatgatagatcgggggtggctatttacttctgtttacagggaactttgacatgctcaacttttgtgtagaaaccattttccctggtagttgctacccagataaatggaaatgttttgggaaaagagcaatttgggagctctgagcttgtcaccaaggttgtgtgttcctaaatcctgcagcctgtacttgggctggtttcttttaccctgagcacagccggtgtgaagagcctcaggcatttctcagcgtgggaataggcactgaggagattccagccaggaggagaagctgggagaaaggttgcgctggaggagacagaacccttgtgtggatggtgttctcagggttacgatttcacatttgttgtttcagcttgtgttatttcagccagtgtcctaggcctgttttatagaacggagaacgtgaggctcggaactgttaggagacttgacccaacctcatctgagaaaccagggtcagttatttagcatgtctcagtttacataggtgtgcttgaaaatgggaacttcctattattgttgtatttgcatcatttctgtaggcagaatgaccttgggcctgtgctttagtcatgggaccctgagaccatcgtgccaccatttctagggccctacccctcaccgtgagtcatctgtgcatcttcagaagaattccaccctgggtgggcaactcgggctcccactgctggagtgacaggcacagatggaaagactgagttcataccaaccccaccatcctgtctggctctttctttcccacctctttctgaggtttattaagaatctgctttggctgcctttctcatgctggggctttagaggggcctcttttgtatgcagaaatgcacgacttcctcgcagattcaaaaacagtgaaggtttcttacttaattttgcttaataccactgt

SEQ ID NO: 19984 - DNA, 1029 bp, Homo sapiens
acacccatgcatgtgcatatacatgtgtgtgcaccctcacgtgtccatagaaaccttgcatagtattgatgggaattcgaggacctccatttagtcccactgaaagtcaggacacaacatcccagccccatccccttcctgccctcctcagtagccatggagatggcaaggaaaccgagagaagaatgtgtgactctagggttctctgcctctcgtgtccctcaccagaatgcaaattgtggagcaggccacagtccatttggcagtcatgctggcagcattctcaaagtaaatcacttccatttcccccagcatgcccctggcgggagaggtcactgtgcacagccctgtcgcccccatagctgtgcccccttctcctaaagccgagacactggtgagcagctaaccaagggttgcccatgtttccactggccttttcacgtttggaaggttttgattaaaacagtttctttcagtgtttgctgaggagtgggatccatcactgtatctgagctggtccctggagaggatgttttagtaacttggacactttggtgcattgtctgggacctggaatttctcatccttttttaaaaaaaggtgttttaaaggccttttggggactgtgtagatttatagctgaatggctgcctctgtgtttagggctctggctaggcaggtttatggctataaggcaacggtggagggtgtatgaagagatattttcatttcaccagttattggggaatgaacaatctgttgacttctgttatttggaatgaagacatgttgtttgttgaattctctgggaccacatgaacgtttggaatatagacagggctgctgtatacccgcccgactctaaacagtgtataaatgagaccatggggttcagattatagtatggctctccagagtttcttcaaattgagaactctactagtgtatgttggtagatcacgttagtgtttctttacagacatttaattacttggctggggtaagggaaaaaaaggaatgaaaaatcta

SEQ ID NO: 19985 - DNA, 2378 bp, Homo sapiens
tgcatctttgagtaattgtggacatcgcgtgggagcccaggtctgggacagtctcctcctgacaggtttgggtcttccctgctgaagggctgacatgggagagagctgctgaggcgtcctgagaagacacagtgcccgtgctaagctccatcacttgtttcctcccacgatgggtgtcgtgcttgccatgggtacaaaggcacagccacccactggccaggctgaaggttctgtgctgttggtttgcccagggtgataggcagctatgaccctgtccccaggtgtgtctgtttgtgaactactgtctgggatgagggccatgacctttattcagcctcaaaatggagatgttcttgtctctggtattaatttctgcctggataggagaccgtgcaacaaagagaagccagcctcctccagcccagccttgcattctgagtggctctgagctgcccttccaggttggttttgaaaaggcctcccccatggccctttctggtattgtcagctggggatggattcattctggctgggtctaaagaatagccaagtgtgttgatgactgtgtacgttatagcacttctctcttccagactgatgtaaagcagtaagggggatttgtccatcacccagccccaccctgcctagggagagggattggaaataattaaatgagacaggtccggcttgcataatggaaagctctggagggtgagccctctttgctatctttctgcttttaaaacaagtccaggggtagtgtttgcaaacatgaagtgggatttctttttcgagccataacctgccttggaatctcatgggcctatttgtgtcagaaaagtcggtgctgcccagatgggcttttagagtattccagacaggcttctacttgccaacacatagcacatctctgcacgtccccaacccttggtttctttctgtctctctctctctctttcttcctttctgtatttctgtttctctctctgttgtttttcattaacacttatcattgtgacccagtatgcctccagtaagacacactgcaagctttggccatgcccacagtggccaccattgctgcccttagaacagttgtccttttgtctgagaagcagtcacaaaccatcttccctggcatggcactcgctgggtctgaagctgcccagttaattttgcagtaatgtttgtggactctggcaggatgtgcagacttatcaagtgttttattaaaagaccaaagaggcttttgaatgtatcaaagccataatgctcttcaatgctcatattttagtagcttttttttcatacataggttctgtgcattatttgtgtctgtctgcagaatggcttatttctcatttggctggtggcttgtgttactgtgtgtgtccccttgggcaggactcaccacctctcaggattctggcataacttatttgaatccagaatgatcaaagtcagggagactctgctgctgggccttgggagcactacaatgattaaatccagtggttgtgaaaggaggtaacaggtaaattgacagactgcctctccccttcggtactttatactctggttgaaggaaacagaatgaatgtgcacacacacacacacacacacacacacacacttgcatgaagtatattcacacacatgtgtacaccccctgtgcacacacatttctaactgtatgaaattgtttttgactctctttaaccaactgcaatttaatgaggtgtatgcgagtgcaaagtgtgggatactaggccaggccatttactcacattatctcatttaatttttctctggggggctggtagtggtattctccatgttgtagactgttaagtggggtcttgatgggattgtctcttggactcaaggtcacagctctccaggaggtagagctgggtgtggactccccctccaggcttgtctgataacagcatctgaactctgcaccctgtgccaactgctgatcagtccccaagatggactgacgatgggcaagatgcaaaggacaggaagatattgtgcccttcagtgtgccccggagtgctggggacctggacattcatcacctcattttacctgtgcagcagatattggtatcctccagtctatttggcgaaggtagacagtcagggccagggaggctgagtgtcagcagaggtcacccaggtaagacagtgtaagagccagaattcataccctacttccttttcctccaagtctagaactttcctttcacagcttccatgcaaggtgtaccactctctttttaggtctccttgccgtcattcctctctcctctccctcatcccatcctgcccgaggtggcagcttctccaactgtttatttcaggtggcaatca

SEQ ID NO: 19986 - DNA, 1119 bp, Homo sapiens
atttgtaaggatggaactccctgcaatgtcttgaggttgttagcgtgtgaccatgagtactagtacacagtgcccattcattggaaattctgtagccaccgaagaaaactcacctcaaagtgaagtgatgctcttttgatggtaaacaccattgttttgctgcacagtaattaggcatgaatggcaaacagttcacatcagtgattgtaattaattagtataaacattttttttttccagccaaatctcagtccgccttctttctcttatcatgtggttgtctggtgttggtaatcagtgtccacactgcccctggggcaagttccttgaaggcaggaatggcagtttcttctttgtaccccctgccccactcctggtctggcaaatgggggctcaggaagtgctggtgctgcaggacagctgttccttcattcactcaaaagttctcgttaatatgcatgcctctaaagcaatggccttattttcattggatttatttttcttgttcttgctcttcacctctcattttcccatatgagagactccggggctgcactcaacagattctgtctgtctgtcttcttctcaaggctggagatctctaagcacccacttttccctggcccatgtgctggtggccctgagtttctagacttagcttgccctctgacccaaggatggtggcccaagttggcagaggtggtgggaggaagcaaggctgtggtggtggttgggtggaggaatcagagcatagggggtcctctgaccatgaagatgaaggagttttcactgtttatagaatctgcattggctgtcctgcccgcctcttcttcctgaatttggcactggttatgattttaggagcacggagaagactcctccaagaattagaaacaaacaaattccatttcctctctctttggctgtaaagcctttaactgaggaccacgtgttttattccacaattgggtgaaatgccctcagttgctgaaacccattccatgtcagatggtatctcctgcccattcattgtgaccctcccgttttgaagaatttatccctccaggcccagtttttctgtaactggcacagattcacaggtgggagcccaggcaggct

SEQ ID NO: 19987 - DNA, 1025 bp, Homo sapiens
tggcccagaagaaactggagctggtgtccctctttccgtgccttgtcccactgcctccttatggaggaggctgtattcctgggctcatagccattctcaggtttctgcggtgtgcatttctctagtggttcccagcattggggttgggtttttaggtggacgcagtcacatgtgggcatttgaagggctgccctctctggaatcaggcagtctgtccttgggatgagatgctagctggccctttggcttcttccttagagatgtttatgctcatggcctcggccactctccctcttcctccaggtttccgccggcagcccaggcctctccctgtctgactcccccactccctttctgctgggcatttccatttgaatgttccaggctcatctcaccttcgccctcctcacactgacctcactgactccagtctggtctcctgccctgagtccctgtctaggagaagaatggcgtttctgacagctcttcctgactcactcgttgagaccgatgcttatctgctaagcgattcctgtgttcactccttctctcttctgtctgctgtccccatcacaagcaagactgaaccccttctgcttcctgatgtgattccttgtcacggtccctcttgctccaacctgtgttgccctttgctaccagacgcgacttcctgaaatcctgttttcagcagacgatcctctgttcccaacttgcagtggctccctacttcctgccacagtgaatctacagtcctctcaactcagttcacgtccgtgggcccttccagagtgacaggcaccatgatcagtgctgccacctccctttcgagaaaggatttgagacctgtgtggaacaactcggaaagggaggctcagacactgcaggcggcttctctaaggtgacacgccaagttgttgggtgtactgggttgaatggtgttctctcccaaattcgtgttcacctggaacctcagaatgtgaccttatttgtaaatagggtctttgcagatataattaggtaacatg

SEQ ID NO: 19988 - DNA, 1034 bp, Homo sapiens
gggaaaatcaatttaatttctgtggctccgtgacaaggaggggtggcaagcaggaaggtcaggcctgttttgaaagccacagttcagttaagaaaataaaacactccctctaaggaatttttaaaaatacagtattttaggagggggaaaatggaagtgggtcaagatgagggatttagtcggaggagcagagcagacccatggcaatcccagtctgaccggagcctagggcctgagggttgcaggtctcccataggaattttttttttttttgagactgcgtttgtttcattcttgttgcccaggctggagtgcaatggcgcaggttgctcactgcaacccccgcctcctggattcaagcaattgtcctgcctcagcctcccaagtagctaggattacaggcacctgccaccacgcccggctatttgttttgcatttttagtagaaatggagtttcaccatgttggccaggctggtctcaaactcctgacctcaggtgatccgcagaggcataagccaccatgcccggcctaggaattttgttgtatgtctgttgagttgagttgctcaggacttgttgcagtaggggacactttcattaggtttctgtttcccgaggcatgatttaaggcacatttctccgtccctctggttgatgctggggaaggcttggcttctggcagtttttgattgctcagatcaagcctatgtgattcatgggattttacaggttggaggctgagaggtatttgtaggtctggatgaggatttgcactcaacctggttgtggcatgtcgtagtcaaactatggcctcacctgatttagaggacgaggaggactctgcagaaagcacttccttggctgttggtagagattagatatttgcgggcagagagttgggtcaacccaagccttcatcaacatcccacagggacctcccttgaggtgactttcattcattagatggaggatggcattgcaggtcctgtgccaggcactggggagataggctttgtctttttttttttttttt

SEQ ID NO: 19989 - DNA, 1030 bp, Homo sapiens
gctgctcaggaggctgaggccggagaatggcgtgaaactgggaggcggagcttgcagtgagccaagattgcgccactgcactccagcctgggcaacagagcgagactctatctcaaaaaaaaaaaaaaaaaacaagcagtggctggcacattgtactcaaacgcaatacatgtagcatttattgttgttactactgaaagttgtgggactgacatctcttgaagaagagatagcaagaatcctggcttctgagaggatcctcaggcacacagcacactgcttgctgaggtcttgagctgtcatcagtgccgggggatgcagtcggtgtggtagagtggctgcccagaacgcgggtctcttgggcctcatccgggcatcctgtgagctctgttgtaaagagcagctgaggatggcgagcgctggggagatgctgtagggggcccgagaggagtcattagctgacctctctctccttgagacagaatcttttcccttctgcttttgttcttataactgaccctctgacagtttttcctcccttgaaagcagaggccttgagtctcctccagctgtcagtttgcgtgttcccctgggcataaactccaacacaggctgcccgataccagctctcaccttcgtttctgccctggagaaaggctgctttcaagttggtaaaagcctcaggagaccatggctggctccaagagcctctttgtgctctgaaatccagaacagccctggccttgttggctcagaggagccttccagaaaaacagaagtcctcgacttctgcctcatcttctagctcctgttcttttctattttaaagcccttaagaaaggaggtgcgaagtccatggtctgtaagcataaaggatttttaaactaaacaagaaaaccaattatttttcttaactgctttagtccttcaaatctttcactgtaatggagatttagaacccatcacagttgggctattatttctgtgtaaacagtgtcatgccctattgcaccaagcaaacagtcaattt

SEQ ID NO: 19990 - DNA, 1048 bp, Homo sapiens
aacgcagagcacaattagaatacagttatatatcctcatagttattgaagcttggattaacatgacataaagttttgtctagggagtcttttgctatggctcagggagcattttttgtgacagtaataggctacagttaatatacttgaatgatactagaatctgtgttataaggcagaacaaaaggggtttatctgaagctgaattacaaaggtggaattatcactgcgaatgatccacagagatctggggcttaattattgtcgcttgtgtcatttcggcataatatgggtagttactggagcagagtagaagtgcgggagggccagcctgtcaatcacccggtggatgccaggattcccaccccttacacttagcgccacgccagccgtgtgccctacagagccacaggaatggatccctttggccatctgtggctatgtggtactttcagttttcttaatgttttaatgactcccctgtcctacctccagcccaatccccctctccccacttaggtcctttgccctcttggccctgtcgaaccttccaggaggctgatgaacggtctcatacactgatggcattttctcagcccggtgaggccgccaccaccttccagagcctaattgttttgacaagcgaaggaggcaagctaatgtgctctgtcagccatttggtcacatttggtcaaagccaggtgtctggctgcaaataggtgcactcaggtaaaccacatccccgtgtgctccgggaggacagagcacgcaggaggcgggagtgttgcgggcagcccttccccatccctggctccagcgcattcattctcctcccaggctccagtcaagtctgagggtgaagggtgggaacaagacagttcagcacctgaacagggcagggcacccaagggcttttagaaatgctgttagatttatagggaccatcatcctcttcttactatttttattatcatttttcattatccacctgctaggtgtacaattacaacttgttttgttggtggctaaattcagctgtcctcctcacc

SEQ ID NO: 19991 - DNA, 1034 bp, Homo sapiens
tcaccagtctggcgtcatcttggttgcttgctttttgttttgttttgtttttgagacagagtttcactcttgtcgcccaggctggagtgcaatggtgtgatcttggctcactgcaacctccgcctcccgggttcaagtgactctcctgcctcagcctcctgagtagctgggattacacacatctgccaccatgcccggctaatttttgtatttttagtagagatggtgtttcaccatgttggccaggctggtctcgaacacctgacctcaggtgatgcacccacctcggcctcccaaagtgctgggattacaggcgtgagccaccatgcccagctggttgcttgctttttgctccttcttcaactccaaacccaaggcattgccaagcaaatgcagtccccccatgattaattcagttgtctctaccacatgacaccttcacaaggtcttttctgctttttcaaaactttcccatcctttacgattagtgtcattcctgaagatttttggccaaatggcagtttctccattccttctgttgtagcacctgattgtgccacaatcagtcactgcatttgcccattggtttaaatgtctgtttcagcttgcctcttcacctggggcatgggaggcagaaagggtgcatttttcatgtgtgctgggcctgccacgtatttgttgtcagtttgttcttaattgcgctgtttgtcacaccaccgttctgccccacgaggtttccccatctactccttcctctgtcttggtcccataggactttcagccttttgtgtggctgggttttctgcaggcctctttgggggctggtatggatggccttgggtggggagggtgcctgggcccctgaggccctcttgatgaggtgggatgttgtgaatggtggccccatccccagggagccctctcgtttcttcctaccctgatattttataacaagatgctcataagcctttggttccactggcgtgagctcctaaataatgttgcactcctcttgtttttttttttgtttgttt

SEQ ID NO: 19992 - DNA, 1049 bp, Homo sapiens
gatagtagtatacatgatatactaacctggaaattgtttgccatattgtaatgttacaggttaacaaaaggacaaattccatatactatatgatttaaactatattgaaatagtcatagttttttctttctttagaaaaaaaatactccaggcctggagcagtggctcacacctataatctcagcgctttgaaaggctgctgcaggaggatcacttgagcccaggagttcaagaccagtctgagcaacatagtgggaccctgtctctaaaaaaataaaataaaataactgggcatgatggtacatgcctgtagtcccagctactcaggaagctgaggcaggaggattgcttgagctcaggaggtcgagactgcagtgagccgtgatggtgccactgcactctagcctgggtgacagagtgagaccctgtctcaaaaaataaaaagcagacactaaagggaactatataaaatgttaactgtatacaacggtgtggagtggaaagaccactgtttttttttctttctacttttttgcattttcaaatattttttgataagcaactattacttctgtaatggaaactaccccctcaccccccgacatgcatataatgttttgtgtactttcttaaaattcctaaggcagcctgtattctatatttgttttgcaggtggaagatgcaatgctgatgtttgataaaactaccaacaggcacagaggtaagattaccccagtgtaagagggttgcgttcaccctctcctggcctctctgtctgtcatccccagtcccactgacaaaagatacagtgaagagtccagagtcaagcaggtagaggtgaccatccattgaagatctttattcacggagagtcccagtagcacaaagagttccagtactggatagctgaaaaaccatttccttctggcctaggaactcctgtttagttatgcagccatccctgacacacatattcagatgtacctctctaatcctgcctttctgggtcccttgctaacctcggcactaagcgatccaagtggaaatta

SEQ ID NO: 19993 - DNA, 1059 bp, Homo sapiens
cagaggcaaaggaacaggagacacggggagagaaataaagattagtgtgatggatgactcttctgccagcagttagcagttgcttattaaatgcaatgctaatggctttggagaggaataacagccctgagacccactggaagggggtgggatggttttgtgagccccagcgagcaccatcagtggcaggcctcttgaactaagagggtcctttcccagagtggctgtggtttatcccagttcctgggctggaaaggtgcagtggttggggatccagccagagggaggagcatccaggcaggtggccggagagcttgggttcttcctggagcttgctcagtctctgtcccgaaaagcagctggccaaagtttaaggtctttgtaatttgcgtaatcggtttatttattaaaatggtgccagtaagatgtaacttaagctgtgatagaagataatgcttttctaaggaggaagaacagcccttaatgttttgaatacctgccagacactcacttttgaaattgacctctgaagtccagattgactcttttatgtacgatgtataaagatgcctaagaattgcactgtcattatttgtttattggtgtctattactcaaaaaaaaaaagagggcatagaaaaaagtttcacaaaggtgtaggttacattttaaaataatttaaagcattgcttcacttgtaggtgtgggatgtcagacataatgtatgcatgtccttcctaatgagagtctaacattctgactttatttacctagggaagaacgttgggactgtataagctgtacatgtgactttgtaggatggaggaataagtgtatttgacaaaaacgatcagaccctctggccagaaagggcacagtccaagaagaagggttgttggagggagtagaaagtatgataaggatgtgtagaatcacagctggtgatgacacttttgctgatgtgacaggagggcagcctgcaaaagattggctcccacgctgccctcgtttggggtctggagcaggatttgctgcctgtcttccctgctggcattttacc

SEQ ID NO: 19994 - DNA, 1200 bp, Homo sapiens
gagatacagagacggagggaatctttttattatatactcatttactttttgaattttttttttttttttgagacggagtctggctctgttgcccaggctggagtgcagtggcgcaatcttggctcgctgcaatactttttgaatttttgtaccttatgcacttattacctattcatttacttctttagtgtgagcttttaaaatttattccaatttgaattgtcaatgcagtgatagaacaacgtgaaagagactttttgaaagaaagaaaatttaccagccgggcacagtggctcacggctgtaatcccagcactttcggaggccaaggtgggcagatcacttgaggtcaggagttcaagaccagcctagccaacagggtgaaaccccatctctactgaaaatacaaaaattagccaggaacggtggcacgtgcctgtaatcccagctactcaggaggctgaggcaggaaaattgcttgaacctggagacagaggttgctttttgtttccataaacagatgatctgatggatagatgaggattttcttagtagtttctgctcttcccagacaacgtgctattattagaatagccagactggccctggtctgaaaagaagcctggtttgcgccagttcatccaagaccagaggggaggagggccagaacagggaggtcctccatcccaggagctcaaagtgcttcgtaattcaagtttaaaaaaagttaaaagcatttttctaccccaagttatgactagtaaacacgtggggaccttacacagcgtggcaaatgcagaatcttcctctgcattcccattgtttatggcttaggagtcaaggcaacacccggttaatgatgcttgtgaagtgtctgggccatgtggcaaagggataagagcttaggtccagattcccactgcaggactcactttccagagcaaccactaatcaattgctgtgtgaccctggacaagttactaaatctctctgaacctcagttttctcatctattaaatggtgttaatgttattaactcatggacttgggaagtttaagtgagatagtttatctgtgtgaaacatctgatgcttggaaggctatctgtaaatgttaactttgtcattatcatattaattattgttattttactactaagaatactgtgactgtcattacttcgggaatggaggctcaggct

SEQ ID NO: 19995 - DNA, 1038 bp, Homo sapiens
gtggaccgtggggtgggcggtgagtgaattgaacagacaaagattctttgggcaaaggttatctgcgctgaagatgaaactcccatatgtcctttgctatgaattggaactgggtggatggatggaccagacagatggatagcagtgaaccagctaccatatttatagctaggagcacgtgcccttctcaactccagacatccccacccctgtatcccaccttgttctgttccagacacatcagagcagagccccctttagttgcagcagctatggcagccgactgcccaaagatggaaacttctgtgtgtgtgttttgtctagagatctccttttatccacaaagggcatcaccgatggggggaccagtaaatagagctgtctgaagtagcaggccgttgaaattctagtattgtgacttaatgaactcttgtctttaattcctatgacttggagaagacagccattctctccccataatggagctcgttaacccatctctgtactgactggtgcttttattattattatgacgactggagaacataagtctgaatgttagaataacaggtttcccaagtgcctggcagagaagggggtgtataatgatgatgatctttcgtgggaataacagcggccaccggcttatctggcgcaggcattattacatctgagtcgcctgaagtgccatttgtgaagacctggtatttattgtcctagattattggggtgggggagggtgaggcagcagaggggacacttatcatcccgtcagggctcgacagccgaggggcagctgctgggtgcgaaggccacagtcagcgggaggcccctgtgtgtaactggagattccggggcgattatgcccaatttatcacgcacctcatgaaaatacaatccaccaccaaaatgactgcttttggaaactgtcttgtctcttttgagccgagactggagacaaccagacaaggttcggtggtaatgaataaagaaacattactttctgaacacaatcttctgtcaccagtcacttttcaa

SEQ ID NO: 19996 - DNA, 1023 bp, Homo sapiens
tcattggcacttctgagagtggatgctgatctgtccatgtgttccctttgggtttccccaggatggccaggctgtagcctcccgctgtggggcagagtgaaaccccctgccccaggagaggtacatctgtgcttgaggctctggggcttcatgctcttgtcccacggccactgtgtcctgggcccttccatgttccaggtgcaatgctagttctggcagtactgcagggaacaaggcaggccaaatcccagccctcctgagctcatgttctgcggggagaaggaacatacatcacacgatttcaggtactgctgagggctaagaagaagagaaaatagggagctgttggcgagggggcctgggcctactctgtttaggtgggtagctgggagtggcctccctgaggaataggccttggacttgggaggcagagaactgtgagaaaggcattccaaggagcagataacagcaagtgtgcaggacctggcatgggaaggaactgattgatgtgttggtaggacaggtggagggctggggcctccaagagggacagtggtagagatgactgagagaggcagacaagcgctggatggtaaatgacttgtgagccaggcaaggcagatgggaaccctcaggaggaggtcagaagggcagaggcatatggctggtgctctagaaagatcccagtggctccctgaattaaggaaggacggggatgcatgtttggaagcagggtggccagtggaagtttattggagaagtgcagtggagagctgatggcgtcttgggtgagggttgtacagtggaggtggggagaggcagtgggatttaaaatttatatttggagacaagttatggtagattctgatggattggaaatgggttatgaggtgaggggagagagaaaaattagagtgaactctaggttcttgggttgagctcttgagggatggtagtgctattcaatagtatggggactgctttggtggaaggaacacattttaagaagaaaatcagttgttc

SEQ ID NO: 19997 - DNA, 1052 bp, Homo sapiens
gaaaattaacattccctcccttgccatcaattaatttctgccctcttgatcagctgcttccttccctctctttggctctttaaagttcctttttctgccacagcagcctcaagaggaagggaggttggattactggaagtttgggaagtcgtgtaggcctcccagatcagtggccaccagagggtgccatatcatgcatagcatttgcacactcacaaactcctttcttcggattgagtaggagggtgagaattcccttctttgttggttccagaaaaatagaagctcagcaggtgtttctggaaccagtcctttggagcaaaaacattttggttggccacgagagcctccagcctcaagagaagagggagggcaaatctgtgtttcaattgcagctgtaactttaatattttcttccttttgtcaaaacatttcttgcttctaaaacatgcgttcagacatgcattgtatattggtctgatatgtgttcaccaactttaaattcaataatagagcttttagtgtggataagatcaaagcaatctgcttagcatgtggcgctacaggcctgattcaatatttgacttgctaattttttcccagggcactaaaataatattgttcgtattgttccttgccatcatatgcatctgaaatgaaaatactctttttttgcgtactgtatgttggaggcatcaactcagacattaaaatggtaggagggagataagtgtgacagaataacacaggtcccctcataggctttctcagctccccagatgtccgtgcaagtttacagttggtacttttctcttggtaggttactacttgctattttttttttttaattgagacagagtcttgctttgttgccctggctggaatgcagtggcacgatctcggctcactgcaacctccgcctcccgggctcaagcaattctcctgcctcagcctcccaagtagctgggactacaggcatgtgccagcacacccagctaatttttgtatttttagtagagacggggtttcaccatgttggccaggctgatctc

SEQ ID NO: 19998 - DNA, 1048 bp, Homo sapiens
cctggtcctcaggcccctcctgtgtcctgcgaagggcctgtcctggagacagcctgtgccctccgtcaccacagccttaggctcaggccaccaggatgtttctttggcctctggcagccccagctggggtgcccctagtccacccaacacatgcacaacacacatgtactcaacacacacatctacatatacccaacacatgtacacaatacgtacactcaatatacaacacacacacccaatacatacatacactcaacacacacatccacatacacccaacacaggtacacaatacgtacactcaacaaacacaacacacacaacacatacatacactcaacacacatccacatacgcccaacacatatacacaacacataacacacatgtactcaacacacacatccatacacccaacacatgtacacaacacattcaatacacacacacacacatccaatacatacactcaacacacacatccacatacacccaacacacatacacccaacaaacacacattacacacatacacctgacacacatacacttaacacatacccaacacacatacacttaacacatacacacccaacacacacaccccttgtatctgtgcttgcccatctcccgcaagcccagccaccaagaagaggcctggccctgggaactcagtatcaggggcctgtctgccaggtcatatggaaaatgtatttggcgggtgaggggtgactggtgaggctggatggcctaatggaacaggagggggatggcgaggagcagcagaagggggccaggaggacggctgtgcaggatgctggtgcaagctccatcccttccctaccaggaggctcccaaggggctaggccaggttttggcaaggccctggtgtttcagatgtagggcacagaggcagtggggtggcgactatggagctgctgcccgtgctgtgtgagggacagattgggcagccctgctccttcagcccctcttctcacaccctccctctccagggtggagatgaaattccagccctcagcagtgt

SEQ ID NO: 19999 - DNA, 1325 bp, Homo sapiens
acaaaagttccagagcctccctcgaaggttctctactactgtattctgtacataatgtaccatcccatgtggaatctgtgagtgtcctcttaagtagcgtgggctagccaatctgccgttcatggtgtattgtaaactccgaattccatatgtaataggatgcaagtctaagcgtttcatgtggacataaatgtatctaaataaaactttccctagcactgtggctgacctcacccttacttttatactttagtatgaaactgatgagaactttggtagtgagtattttttttatatatatacatatatatgtactatctatatatatatctcaagcatctttcaggtctttgtgtgtggctttcttaaagccctgttgtaaaaaattactatgtggatggcagtctctcacatcacagatgtggaaagtataattttatatttgtattttcaaataaataagtttgtgaaaggtttccatcctctactgtggtccagaaatcaatgtgtttgtctgacaaaaaaaaaaataaaataaaataaactgttttgaacagagttgtttggtgttctttcacttgcagaggaggtctggggtctgggagagctgttgttttgcttgggcgggagaggatatcatcaaatcgcacctgccaccctcacccctcagcatgaatgctggccgtgggcctccagcagcgaagaagtccctgccttgtccccagggagcttgtggcaccatttttatgaagtggcaagagagcactaagatggaagagcagacgggagaggggtgtagattaacagcagaaggtacacagaacccatgagtggacagggaataaaccccaaaggtcctgcggatcagaggacccagatggtggaaggagctaaggggccctcccgggtgctgccctcagttatcaacagtgctgggagaaggcgccaaaccgcattccacgacccctgagtaggggtctgaataggtatcagacctctgccctcaaggagttttaagttttgcctactggaaatcattacaatcacaaaactaaagatgtagagatagatcatctacaatactttccacccctctctctaccaaacaaacgagaggatacaaaagaattgagacccagtacattgagggcaagtcccaatacctggtgatgacggctacagcatgctctgaatcagtggattcctcagctttgaagccctggagagaaacaccaggccaagaggagtgcaagggatgaagcgtggatgaaggacagtggcccttagctgcttcctcaaggcccccaggaaagctgtattctcca

SEQ ID NO: 20000 - DNA, 1018 bp, Homo sapiens
ggaagagtgaaaaaaatcaggaggagctccttgagaaaccagctggcaacatgtctcttacgaagagtacatgaaaacatggagacattttataacaaggctggaaacagcagttacactaacatttgtatatgctagaatttcaaccattggctgaagatgatggagacagtgcatttcaaaagaaaatgaacagaatgaaatagacgaaaatggatttatgctcgtgtttcggtgatagaactatgactagattttttttttattttccccttcttttgtatttttcaagagttctttgatgaggtgttttacttttaaaatggaaaataagtatgggtcttcaaattagaaaatccatcaagagtttttgatctaacctcaaaatgaaaagtttttcatggaagtcatttttccagaatttatttcattccactgaaaagtctattggcttggaagttctggatgtgagggcgatctggctgcaacgtctgtcaccccattgatcgtcagggttgattcggctgatctggctggctaggtgggtgtccacttcctccctcagcactccatgtgcgtccctccggaggctgaagaggatgaccatccccgacagaggaggaccgatcttcggtcaagggcatatgagtagctgtgctcccttgctagaacctccaaacaagctctcaggttatgccactggaagtatattaacacatctttgctccctgaaaatgcccatgcttcctgagctttcatctccaaacaggagggatattgagtgggggcagaagcaattatggtatatacagccaactacagactgctgtttacacaggaacaccccaagaaagtcaggataaagccttgcaccagatgacctgatttacctaaaatactgcctctctttatgggcagtcccaggcagatctttcaggagtacccgtcttttgtgttgcagacacagatatgagaggacccagaaacggaggaggaataagagtttgagtatgagaac

SEQ ID NO: 20001 - DNA, 1105 bp, Homo sapiens
ttcacatttcatcagggatgagtgtctccagggccaaagctcatctactttcttccctgatgaaagaggcagtccaggtggcatctgtgaacaacacattcctgcacaggtaggtgcacagtgctcatctggaagactaatcctgcagggcttcctggaggagatgagcctccacttttcggggcccaggatgggaaagtatgtgagcatgtgtcactgaagggactgtggaaagcagatggaaattgtggaattctctcggaacaatgcagccattattagaactgtgcccataggagcatcaatatccctgctccttgtatcctgttctccagtcttctggggaccccctttgactgaacccaaccaaatggcagatgacaaggcagacccaggatgcagtctgtagggttcagtccccctccccactgggaacagcaggaaagggcaaggtggtgacaatctaagggaggcaaatggataataaccagcatggtagggaatcttctttgttgctgtggcactgtcgatctctgttccctgaactctagtgtcctccagactagatttaaggtgtggttccccgctaaattattctctcacctcctttcagtctttgctcaaacatccttttatcagagaggctttctgacatcctgtgcaagatagcacctctcccccatcgctgttatccttacccagtttaattccacgtagcatctgccaacgcttgacatatttgttttttgtttactttctggcctgtgacaactagaatataagctctgtgagagcatttttctcttaactgcttatcttcaagtaaacagaacagtgcctgtcctgtaggaagtgtttgatacatacagattgctcaaatgaaaaaagaagggtgcgagcaagcctggacaggcctggtgccccagggcagccttgccttttctgaagagaatggctgccttaggcacggctctccttgctgcccaagccttgccaccttgaaaggcgtgagagggtcactcccaggtgtattcaagcaagagtgcctgagccactcttgcttggcagtatgggaggatgaaatagtgtgttcataaagtgcatt

SEQ ID NO: 20002 - DNA, 1097 bp, Homo sapiens
catgagaaatgctcatgacataggttaattaggaaaatcaacaaaatacaagaatacacatgtacacacctttcaattttaactttgaaaataataatgtataggtaaatacttattcatgatcattcacatatctatcttgtaaacaaattatagatatattctgctttctaaaaatccaatctgtacttttcagctgctgaattggggataatttgttatgtagcaatatgtgatcagttacattttctatttgtctcacctatttttctccttttctttgtggctttcttttgtgttgtttttggttttggtttggagttgtttttttttttctctttgagacaaggtgtcgctccttcacccaggctgaagtgcactggcatgatcgcagcacactgtagcctcaacctcctgtgttcaagccatcttcccacctcagcctcccaagtagctaggactacagggatgtgccaaaatgcctggctaatttttttactttttgtagacatgtggtttgagacccagactggtctgaaactcctgggctcaagcaatctgcccatctcggctttccagtgtgctgggattacaggcgtgagccactgcgactagactttcttttgaatagatcaattttttaatcattctgttgtttttctctgtcattttggaaactataaattattttcttatgtttttagcagttactcaaagacaacatatgcattaatatatcgatgtctataattaatacctatatatatagaccttaaaaacacttttaaactccacttatccccttccaacttgtacattttatgggattgtattataattcatattattattgcattccacaattattttagctcactttttaattcttcattcattattgcatctcaaaagtatataattactttcattatttttcttttgtgaggtttatttcttttttcttctcttttccctttcaccttctctccccttcttccttttgtcttcattcctttcttcctctctctctgcatattgtcatcccatccaattgttttaatatcatttctcaaaagactcttttttctccattaaat

SEQ ID NO: 20003 - DNA, 1049 bp, Homo sapiens
tcaccatataggcaagtcaggtcttgaactcctgacctcaggtgatctgcccacctcggcctcccaaagtgctgggattataggcgtgagccaccacgcccagccttaaacagttttttgaaagataatttataggccgggtgcagtgtctcattcctgtaaacccagcactttgggaggccgaggcgggcggatcacctgaagtcaggagccatggcgaaaccccgtctgtactaaaaatacaaaaaattagccgagcatggtggcaggtacctgtaatcccagctactcaggaggatgaggcaggagaatcgcttgaacccaggaggcggaggttgcagtgagccgagatcgtgccactgcactccattctgggcgacaaaagtgaaactccttctcaaaaaaaaaaaaggaaatttatattcaagttcttattctttcaattacttataaattaaatggcttatgggttgactgttttcttatttatttatttattttaagatggagttgcgctctgtcacccaggctggagtgcagtggcatgatctcagctcactgcaacctctgcctgctgggttcaagcaattctcctgcctcagcctcctgagtagctgggactacgggcatgtgccacaatgcccggctaattttttgtttttttagcagagatggagtttcaccatgctggccaggctggtctcgaactcctgaccttgtgatcttcccgcctcggcctcccaaagtgctgggattacaggcatgagctacagcgcccggcctattgttttctttttctttgttttatttattttttggatgtgcggtctttattctttccaataaaagttttaaaaaaaatgcttttcataagatttcctttaaatgagtatatttcctttaaatgagtgtagtcagctggatttttttttttcatggaggtactaagtgtcccatttcgctgatgaccagcatggttactgaaagccctttggaccctagcagaatatgccaccctgaaatatgccactttggcataaggattattt

SEQ ID NO: 20004 - DNA, 1115 bp, Homo sapiens
ctgtaatcccaggcgtgaatttgggaagctgaggtgagcagatcacttgaggtcaggagttcaagaccggcctggccaacaaggtgaaaccccgtctctactaaaaatacaaaaattagctgggcatggtggcgagtgactgtaatcccagctactcaagaggctgaggcaggacagtcgcttgagcccaggaggcagaggttgcagtgtgccaagatcgcatcactgcactccagcctgggtgacagagtgagactttatctaaaaaaaaaaaaaaaaaatcaagtggctgggcacagtggtttatgcctgtaatcccagtgctttgggaggctggggcaggaggatcccttgagcctaggaattcgaggttgcagcgagctatgattgtgccactgtgctccagcctgggcgtcagagtgagaccttatctctaaacagattaagagagacatcaggtggggggcggcgacggatagcattaggagatatacctaatataaatgacgagttaatgggtacagcacaccaaaatggcacatgtatacatatgtaacctgcacgttgtgcacatgtaccctagaactttaattaaaagatcaggaattatgaactgtttatagtaattttgctataatttgtcatctttcagttaaagaattttgttatccaaaggagaacattttgttattaaaaagcattgtttttctacaattgccaatacatccaaacaggtaaaactaattaagagtgttttgttgtttcagaacaccgaaaagctttggaggatttcactcttgataatattctttctcatatttattattttcgctgtcgtgactacacagagttactggcacaagtttatcttcttccagatttcctttcagaacactcaaaggtatgagtcagactactgaaatgtaactaaccaagtattttttgaggtgtttgataagcatgaaaaaataaccagtacagtagcataaaatcaaagtcaaagccaattgagaaaatctcttccttccttgacctacaatttatttatatttatatttgttttgtgtatgtatatgtatatatagtttatgctcagagtaagaaattgaaataat

SEQ ID NO: 20005 - DNA, 1076 bp, Homo sapiens
agttttataacaaagtcaagactgtataaaatgttaatgtctagaaatgtcaaaatagcgtttgcctgacaaataatatagacatgcagttttgagtaaagttacgtttggttggtttccattaaaaaattctggtcataagtgtcagttttcctggaaaataacaagcataattaatggactttgtggttgagcgcggtagctcgtgcctgtaatcccagcactttgggaggccgaggcaggtggatcatgaggtcaggagtttgagaccaccctcgccaacatggtgaaaccctgtctctactaaaaaaaaaaaaaaaaaaaaaaaaccaaaaattagcccggtgtggtggcatgcccctgtaatcccacctactcgggaggctgaggtaggagaatcacttgaacccaggaggcggaggttacagtgggtggagaacgcgccatcacactccagcctgggcagcagcaagactccgtctcaaggcaaaaaaaaaaaaaaaggactttgtttgataaagaaatgccacctttgttaattgcagtgtcttctttgtttaaatatactttggatgtttttcaggttaactcttccaacatccctggttttcttctcctttgagtctttgattattatgtggtatgtaatcacagattcagatggattgaaacataaccggtgtaaacaacctagatgctttgaggtagagctaaataactcttgaagatttgaaatgtgaggagagaagtaaatatcggctcagaagggaagagatttttttttttaaagttttacctcactcctctttaactgcttgtttgccattacttcccaccctgaatccacatcccaccactgacacaaatacacacatttgtctgggagtaagatgtaaggtcaaactgcttaacttgatttctttgtctttaccttaattagagagaccttagcacatacctgtaatacatcataagtaaataaagaacttcctcagtaaagtcattttaaagcatacttttttctttgaatttccaattttttttgccatatgctgaaaagcatagtgccctgtgtt

SEQ ID NO: 20006 - DNA, 1041 bp, Homo sapiens
accaactttgggtaccagtcttttatttatttatttatatctttgagacggagtctcgctctgtcgcccaggttggagtgccatggcgcgatcttggctcactgcaacctgtgcctcctgggttcaagagattctcctgcctcagcctcccgagtagctggaactacaggcgcgtgccaccatgcccggctaattttttatatttttagtagagatgggtttcactgtgttagccaggatggtctcgatctcctgacctcgtgatccacccgcctcagcctcccaaagtgctgggattatacgcgtgagccaccacgcccagctaggtaccagtcttttaaatctttgccaaattgatatggagaaagtcctttaaaaatatgttttttggattattggcataattttttaaacagccttaatgacatatatgattcatccttgcagtgtgcacaattcagtgattttcagtgtatccacagagttttgcaaacatcaccactgtataattttagaatatttccgtcatcctaaaaaagaaaccccaacctcacagtgaatttcagaatatttaaaatgtctgctccttcagtgtcacgtttcaaatctcatgcaaatttttcttgcggtcaactataactttgtaccctatggagaaagtaattctggttctgggaaacacacagttccagattattaaaaaaaaaaaaacaaaaaaaaacaaaaaacctcttttcagctgggtgcaatagctcacccctgtaattccagcactttgggaggccaaggtgggtggatcacctgaggtcaggagttcacaaccagcctggccaacatggtgaaaccccatctctactaaaaatacaaaaaaattagccagttgtggtggcaggtgcctgtaatcccagctactcaggaggctgaggcaggagaattgcttgaacccaggaggcggaggttgcagcaagccaggaccgcgccattgcactccagcctgggcaacaagagcgaaactctgtctcaaaaaaaaaaaaaaaaaaa

SEQ ID NO: 20007 - DNA, 2217 bp, Homo sapiens
ctgtctaaaacagaattcagtcctccaaccctctttacggcccccaaaacaaacaaaaccaaaacctgatactctttctggtgggtccatccctgacttctcctttccctgacttctcctttcacctctcacattcagtcacatcttgttaattctacctcgtaaatacctcttaaatatgtctttcttcattcccactgtcattgtcatctcttgccagtcttacccttctgcaatatattttccccagtgtagccaaaatgtttaattgtcacactgcttaaacatttttaccctttacccagagttagccaaactctaaggttaagggcacagtcttctactctgccaagtctgctcaagacttctgatcctattgtaaggggttagggtgcaactacaaatttcaaatgaagatgctatgcaaaacctcacttctaacatcaactgcaagtttgggggtttccccaaaccaccctcagattcagtaatgcactagaaaaactcatagaactcactgaaagctattatacttagagatacagttcattacaaagacaagctacaaattagtcaaaggaagagagatgcctagggtatagtctaagagggttgcagatatgaaacttccattgttctcagggaatataccttccataccctcccagcatgaatgtgtggatgtatggaaatacacacaaggtattgcccacccaagaagttcacctaaactttagtgtgtctggagtttgtgttttgttttttaaagagatggggtctcactatattccctacgctggattcaaactcctggctcaaatgatcttcttacctcagcagagttttcattgagatttattgattgtttgcatggttgaactcagtttccagtctcccctctccagaggttaggctgatactatgtggttcaagggacccatcatgaatagtaagaatactcatattactccagaaattccaggggcttagaggttacctcccaggagctgggggcaacatctggacctctctttggacaagttttttactccacatccttcatcacctatctctcttttgccctctagataaaatccaaaggtaagggcttataatcttacttcattagttttatttctggaatcactatccacccacttcatcccagctctacccctccagaaactacacttcagctatattaaactaatgtatttctttgaaggtattgtgttatcttttgcctctgcacctttgcacatagtatatttttccctctgcttggaatactatgttcccccaatagccactcccaacacaatccaatttcttacccgttttttagttctctgtttaacacctcttccttgaggaagcctttgcttaccgtcctcacactcatcatgagttaggggtcccttctacgttcctttccataatacccaatgccattcctcttgtaagtacttggtttaatttattattttttgtcagcaaatatttatatctccgtcactagaccagaggtctccaaagtcaattgcacctaaaatacttcatttcggcaaaggaagaaaacattatcatctgtttatttgtgtataacatacgaaattaagtgctataaatatttgacatgtttattgagattggcaacttgttctgtatgacgactgatttcatgtgaagcatggtaagtgtggtattctgagggagtgcaaattccacagcttatgggggttgaccgtggcatcctttctccaatttttaggccattacaaactattacagtttatctgtgcctgagtaaatagatttatggattatatttcctggttttaacaaaattagccctcatgaaatggaaaattggctttaaaagttcctgtgaagatggctgggcttggtggctcattcctgtaatcccaacactttgggaggctgaggcaggcagattgcttgagtcttggagttcgagaccagactgggcaacatggcaaggccccgtctctacaaaacttagttcagctactcaggaggctgagatgggaggactgcttgagcccaggaggttgaggttgcagtgaaccatgatcatgtcactgcactccagcctgggtaacagagtgagaccttgtttcaaaaaaaaaaagtttctatgacaaaatcatgagttaaacataatattgataatgcaagtgtaagaaacataaaagt

SEQ ID NO: 20008 - DNA, 1057 bp, Homo sapiens
acaaaaacagttttgtgtctaataaaaaccctttgcccaggatattctctcatcttggattgataagtatctttctgtaagagttaacagtgtaaacttgcagagggtcagcattgtctacacccaaaataacaattgtacaagtatgaatagtagacacctgttcctgtttctcttgctgctgtgtactatattcagtgagacctcgtttaggcattgttttatatttattacctcttttaatcatcataaaaatatatgataaagatttttatcattaacctgttttgcagatgaaaaagctgaggcacacagaatttaaagaacaagttttcaccatcagcagtgtcaccaggacattaacctaggcagtcagacttgggagattataattatgatgttcattttatgattctcatgctacattacaaacatttcctacggggaaaaatttcaatgcaaatgtagaaattgaattttgattactgccatttgcttagctcaggcttttatcacttcttgccttgattaccttagtagcctcccaacaaatttccctgacactggtcttttttccttttaatctagcttcactggattttccagcattattgaacttactatggttctcttttaaaattatttatttatttatttatttggagatggagtttcgctcttgttgctcaggctggagtgcaatggcacgatctcagctcaccgcaacctccgcctcctgggttcaagtgattctcctgccttaggctcccgagtagctgggattacaggcatgcaccaccacgctgggctaattttgtatttttagtagagatggggtttctccatgtcggtcagactggtctcgaactcccgacctcaggtgatccgcccacctcggcctcccaaagtgctgggattacaggtgtgagccaccacgcccagcctaaaatttatacttatttatttatttagagacagagtctcactctgttacccaggctggagtgcagtggtgcgatcttggctcactgcagcctccacctcctaggttcaaagg

SEQ ID NO: 20009 - DNA, 1049 bp, Homo sapiens
gttataatcaggacagctcagaagaagagaactaaattagagagaaacccagaatggaaaataagggagagtttaatgcttagaataaagagttagaaaagaggaggtgggctataggaatctttaataagaagattatagggctgggtgcagtggctcatgactgtaatcccaacactttggaggatgaagcaggaagattgcttgaaccctggagtttgagaccagcctgggcaacatagcaagtccccggctttacaaaaaaaattaaccaggcatggtagtgcctgcctgtactcctagctacatggcaggctgaggaaggaggatcccttaagctctgaacttggaggctgcagtgaaccattcaaccaccattgaaccccagcttgggtgacagagtgagaccttgtccccccacctcaaaaaaatcatagatatgcccaaacattttgctcttaatagcataattaagatatttttattttcaatgcaaatttgtaatcttaaattgaaaaactttatgaacattgaattatccgtggaactcaaaggaaaaaggatcactgtaattttatattttacaggagaaaagatttcttgaacttttttgctttgatctatattttgtcatttcattgagagtagaaaaagaatgcatcactttttataaacaaaatatttttcttttctaaatatgacaccagtatgaaacttacccaaggtgtttaagtgtttaaaatgtaaactgaagatttgattgttattaaagtatcattttacctgttggctgagaggattcagcatagtgcgagggagtgggaacaagtacctataagtatacatagggcaattaataactgttgaaagaatgataatatcctgtttctcaaataaacagaattttaccttactacacaaagaatttaattcaatttagtctatggagtttcctactagaatataagctccagactttcttttgctcaccatcctatcctcagtacctaggatactgaatgcttaggacatagaaggttttcagaaag

SEQ ID NO: 20010 - DNA, 1034 bp, Homo sapiens
cctgacctcgtgatccgcctgcctcagcctcccaaagtgctgggattacaggcatgagccaccatgcctagccttacccattttttaaattgggttatttatcttttattatttgaattgtaagagttctctatatattctggacagaagtcccttatcatatatgcttagcaagtattttctcccattctgtgagttcttcactttcttgatggtatcatttgcaaccaaagattttcaattttgatatagtccaatttatatattttttcttttgtcacatgtcctttggtgttgcccaatccaaggtcatgaagatttactatgtgttctcttaagagttgtatagttttagcttttcatttaggtctaagatttattttgagataatttgtgtatatagaggagttggagttcaatttgattcttttgcaagtggacatctagttatcctagcaccatatgttggaaaaacttgttctttccctcactgaattgtcctggcactcgaatttttagaagaataatataacttttatttatttatttatttatttatttatttatttattttgagacagagtctcactctgttgcccaggcaagagtgcagtggtataatcatagttcactgcaatcttgaactcccaggttcaattcttctgcctcagcctcccagagtagctagatgtaccacacctggctaatttatatatatatatatatatatatatatatatagtagaaccaggatctctttatgttgcccatgctggtcttgaactcctggcctctagtgattttcctgcctcagcctcccaaagtgccgggattacaggcatgagccaccttgcccagccataacttttattttttataaaaaatataataaaaactatggaagataggagagaaagtacagtaaccacgacccccccagtcttagggggatgcgttccaagacccccagtggatgactgaactacagatagtaccagacccagttgctgattgtattaattgaaacacgtttc

SEQ ID NO: 20011 - DNA, 1082 bp, Homo sapiens
tagctttctattgcttaattttctttgacacatttctgaaaggatttcttctaaacatatattgaaaaccactaggggttagttacataattttgattttgaaaattctgaagtagagggtgttaaataaattggcccatttaacattacaatagcagctgatgcggacctctggctgtgggtcaggcaatgtgccaaatagttgtgtgcataatcatatttagttcttactcaaattctattagataaggaattcaaggctcagaaaagtttgataacttgcccaaagtcatataactagtaaatggcaaagatggcatacagggctgtgtgactctcaaacctcagtggctcccatactggacataaacagttatgatggcaagattcccacagtaatacattagattaaatattttgtacagaaattctctgaatacacatgacttaagtactaatgcattattggcccaaatttttcttttttttcttttcttcttttttttttaacccacagctaatatgatagcttaatatttgtttggtaaaaatggaaatctaaaaatggatttttctctggagatttaataattcgttattcttggacccatggactaatcattttgtattatttccatgtgtgtagcacttaccattccaaagagtctagagagtatacataaccatacagaagttgtttcacttatgagtactttagtaaagaaatggggccaggcacggtggctcacacctgtaatcccagcactttgggaggccgaggcgggcggatcaccaggtcaggagatgagaccatcctggctaacagggtgaaaccccatctctactaaaaatacaaaaaattagccaggcgtggtggcaggcgcctgtagtcccagctactcgggaggctgaggcaggagaatggtgtgaacctgggaggtggagcttgcagtgagccgagatcgcaccactgcactccagcctgggcaacagagtaagactctgtctaaaaaaaaaaaaaaaagaaaagaaagaaaaaaatggttttggccgtgttcagagttttctttaaaacatgaaaa

SEQ ID NO: 20012 - DNA, 1023 bp, Homo sapiens
cactgtgcccagcgcggctcttgtcttgagtttatgatctagtgagaaaggcaggtattaaacaaatacatggccagttatgatggtctataatggacatcatcagttccttctctttgtgtatatgcatgctatttttcatgtctagaaatagagtctaattcccctctccttgaatctgggctggtcaatagaatgtggcagaaataaacattttggaactttgaggctagaccttaaggctgtaaagcttgtgtctgggtctctggaaatatttttcttgagataatccctcttaaaacccagtcactctgttgcaagaagctcaagccacatggagaggccttgtgtaggtaacgctgatcaatagccccagctgaacttcaatggccagaatcaactggtcctgtgagtgacccattgtgaacatccagtccagtccagcctttagatgacttcatgccccctactgtcttactgcattcatgtgtgagaagatcgagaactacagatctgagctttgtcaatccacaaaatcttgagagataataaatttttttttttttgagatggagtctcactctgttgcccaggctggagtacagtggcaccaccacagctcactgcaacctccacctcctgggctcaagtgattctcctgcctcagcctccggagtaactgggactacaggtgcccgccaccctgcccggctaatttttttgtatttttagtagagatggggtttcaccatgttggccaggctggtcttgaactcctgacctcaagtgatccacccacctcagcctcccaaagtgcagggattacaggtgtgagccaccgtgcctggcctgagaatgaattgttttaagccactaaatttgagtggtttattatgcagcagtataatacattttggttatctaaccagaatgtaaattatcagattatcagattatgataaatgctataatggacatgaacaggaataaaaggaaaacctaatttagatgattcggagatgg

SEQ ID NO: 20013 - DNA, 1976 bp, Homo sapiens
taatttaattctgctggggtcagagaacataccctatattattttgattcttttatttttattaaaatttattttatttcacaatatattctatcttggtgaacatgccatgtacacttggaaagaaagtgtattctggccttgctggatgtagtgttctataaatgttgattaggtcatgttggttgttagtgtttttcaaatcgtatacgttttcattgatattgttaagtgagaggagagtgttgaaatctccaattgtgattgtaatttagtccactttttcctttgattctgtcaatatgcttcacatagtttgaaacttgtttgacaaacatacatatttatgactgttgtttgtttgttccttatgaattaaccattttatttttagataaatgtccccctttatctctgataatattgtctttttccccttcagtctttttttttttttttttttgaggtggagtctctttctattgcctagactggaatgcagtggcacgatctcggctcactgcaacttccgcctccctggttcaagtgattctcttgcctcagcctcccaagtacctgggactacaggcacgtgccaccaggcctggataattttttctatttttagtagagacggggtttcaccatgttagccaggatggtcttgatctcttgacctcgtgatctgtctgcctcaacctcccaaagtgttgggattacaggtttgagccaccacgctcggctccccttcagtttttttttaatttttattttttttgagacagagtcttgctctgttgcccaggctggagtgcagtggcatgatctcggctcactgcattttccgccttctgggtttaagctattcttgtgcctcagcctcctgagtaactgggattacaggcacatgccaccacctccaggtaattttttgtattttcagtagagacagggtttcactatgtttgccaggctggtcctgaactcctgatctcaagtgatccacccacctcagcctcccaaagtcctggaattacaggcgtgagccatcatgcttggcctccccttcagttttattgaggtgtgattgacaaacaaaaaattattgccaaggccagttgtcaaagagctttcccctgtgttttcaactaggagttttatagtttcagatcttatgtttaagtttttcatccattttgagtagatttttatgtatggtttaataagggtccaacttcatattttttgaatagggatatccagttttcctaccaccatttattaaagaaactatcctttccctgttgtatcttcttggtacctttgttgaagatttgttgaccatataggtttgggtttctttctgggctttctattctgttccattggtttctatgtctgtttttatgccagtgccatactgctttgattactgtagttctatcatataatttggaatcaggaagtgtgatgcctccagctttgttcttctttctctagattgctttagctactcgggatcttttgttgtactattaatatacaaatgttaggggttttttttctattttttgtggaaaataccattggaattttgatagagattgcattgaatctgtagattacattggattgtgtaggtattttaacaatattcttccaatccatgaacacaggatatctttccatttatttgtgtcttcaattttttaatcaatgttttatagtttttcatattcagatatttcacctctttggttaaatttgttcctaaaactattttattacttttgatgttactgtaagtgggatttttatcttcattgttttcatgtagttcactgttagtatatagtaatgcaactgatttttgtgtgtttttttttatcctacaaatttgcagaatcatttattagttctaacagttcttttgtggagtctttagggtttcatatatattagatcatgccatctgc

SEQ ID NO: 20014 - DNA, 1089 bp, Homo sapiens
ttttgaaaataattttctggactgtatttctccatttatttaggtctgtcttaatgtctttaatttaattttacaattttctttataaacttatcatagtcttttgttatatttcttcctatgtatttatgtgtacgtgtgtctgtgtgtttgtgagacagagagagggagggaggaaagggggagtggaaggaggagagagaaaaagagtataaaattaaacatcaactaaaaaaacagctttattgaggtacaatttacataccataaaatttactcattttatgtgtacagttcagtgatttttagtaaatcttcagagttgtgcaatgatcactacaatctaattttagaacatttctgtcaccctaaaaagaaagcttgtgccagtcactcttggcacacttgttggcagtcactccttgttcccatccctagcccgaggaaaccaccatgtagtttaaaaaaaaaaacttattttaagcctttttagtatgaacacttaaaaatacacaaagttgacaaaatagaacaatgactctcaaacaaccaataaggacaatcttctaacttctcacctggattgttttaaaacaagtctcatttcttctataagtatgtcagtatgtgtctccaaggtatgatgatttcttcttaaattgaagtataattttagtttcattatcacacctaaaaagattaacaattttttttttaagagatagggacttgctctgtcactcaggctgtaagtgcagtggtgagatcatagcttactgcagccttgaatttctgggctcaagcctgcttcagcttcctgagtagctagaactacaggtgcgaactaccatatctagctaattaaaaaaaatttttttaatggagaagggtcttactatattgcccaggctggtcttgaactcctggcctcaagcgatcctcccaccttagcctcccaaagtgttgggattacaagtgtgaaccactgtacctggccaaattaacaaaattttttttttgagatagggtcttactgtgttgcccaggtgggagtgcagtggcgcggcttaactgcagccttacctccca

SEQ ID NO: 20015 - DNA, 1028 bp, Homo sapiens
ttttttgagacagagccttactctctcacccaggctggagtacagtggcacaatcttggctctgtgcaacttccacctcccgggttcaagcgattctcctgcttcagcctcccgagtaggtgggattacaggcacgcgctactatgcctggaaaatttttgtatttttggtagagacggggtttcgccatgttgaccaggctggtctcgaattcctgacctcaagtgatccacccgccttggcctcccaaaatgctgggattacaggtgtgagtcacctcacccagccttgttttgtgaatttggattgtgcatttttatgttcactgatactgtatctcaagatgattttcatattttagctagcatttttaggtgacatgttgaaaggtattcagggtaaattagtgttctatttatctggaatggacggtgttaaatattaatatttttatttaattcattagggaaaaatgggtgaactaatatatctgtaataccataaaataggactctgccttttaacgcagaaaatttggaatttatcctttgcactattgtctcaaaagtgacaatcttcttggcaaccaaattgcattacatcttcaatatctgttattaatttgtatgcattgcgcaatctgaacagaagtggtagaaaaaaattgagacttttttcttttgtattgttaactgttatgttaaactgtaggcatctatgtgactgtgaagtatctttttacctgtctcaataaaatgttactaattattctttaacaggtacaaagtgaattaatttgtgctgtttttcttttttttttgagacagagtctcactcagtcgccaggccggaatatggtggtgcgatctcagccctctgcaacctccacctcccggggtcaagcaattctcctgcctcagcctcccgagtagctgggactataggcgtgtgccaccatgcccagataatttttgtatttttagtagagacagggtttcaccatgttgatcaggatggtctcgatctct

SEQ ID NO: 20016 - DNA, 1103 bp, Homo sapiens
ttgtatttttagtagagacggggtttcaccgtgttagccaggatggtctcgatctcctgaccttctgatccgcccgtctcggcctcccaaagtgctgggattacaggcgtgagccaccgcgcccggccagctttgtatttttctaattatctggagaggagataggagtttactagaaaaagaagaaagttttttcatttcaatatgaagattcctacattcaagccccttttccaataggcgccactcagagatcagaataatgacacattctttggtatagatacacacactctgggtgtttaagttagcttacggcagggcaggaacttgcccgatataatagaaagaattcctttgattgagaagcggatactggttagcaaggaccttggaaaactagtagaagagatggaaatagagtaataaccgaagtcttctttaacaatgaagaaacttattttgagactccaggggttggagaaagggttttcctgggctttagaactccattgttatttggtaaaggctgggaggggagtgggctgaaagtatgaaaactgtcctttcccaaatttctcccccatcttgtctaaaatgaccaattattcaacgcttatgcagcttttagtataaactagtttagtcaactagcttttctaataactaactgagatatatcaaggtaatgagattttgaaaggcgatcaaggaaaaagcaaaatatcgttttaaagcataagttgttgatgaacacaaagctttaagtgggagctggcagcttcaggaaggaatctggcaggaagaagaccaagatagcccagagagtgatgaggattactaaaacaagagatggaaagaagaatgtagtaaaggagttgagcaagtaacaacagcaaaaaaagtgaaaagagaccaaagaaaaggaggcactgaagcatagcattgaatgaagtacatatgcaactaggagcaagcattataaaatatgagcagcagtgtgggttgtttacttagaagtaaagttgctaagtctgaatttatttttatttatttatttatttatttatttatttatttatttatttatttattttttgacg

SEQ ID NO: 20017 - DNA, 1046 bp, Homo sapiens
acttgtttgcccactttttaattggactgcttacttatttacagttgaggttagggatttccttattgattctagatataaattatttctcaaatatatgtgatttgcaaatattttctcccaatctgtggcttcttttctcattttcttaatatctttcacagaggaaaagttttaattatgatgaagtctaatttattaattttttcctttatgggttgtacttttggtgtcatatctaagaacattttccctaaatttaggtcacacagagtttctcttgttttttccctaagagtcttatagttcaacatctgataaaattatgcatttgaagtttgttaattttggtataaattgtgaggtttaggtcaaggtccattttgtctcctacaggagaccagttgtcccatcaccacttgttaaaacgactatccttgcttcattaaattgcttttatgcctttgtcaaaaattggttgtctgtacaagtgtgagtttatttttttgctcttttttgttctattgatctgtgtgtctgtctcccaatacgaccgtttaactgttgtgcctctatagtaagtctttaaaaagctaatgtgattacccttattttattctttttttcaaaattcttttagctattctagttcctttgcctttccatataaattttagaatcagcttgttcatgtataaaaatctgttaggatttttataggaattgcattaaaccaactgcagatcaatttcgagagaattgatgtctttactctctaaagcctccgaatccatgagaatgccacatctctccagttatttaggtcattaaaacctttttttggcctggtgcagtgactcatgcctataatcccagcactttgagagactgaggtgggaggatcacttgagcacaggagttcgagaccagcctcagcaacatagtgagacctcatctctacaaaaaatagaaaaattcgccaaccatggtggcacgtgcctgtagtcccagctactggggaggctaaggcgaggtgattgattgag

SEQ ID NO: 20018 - DNA, 1035 bp, Homo sapiens
tcagtggttgtcgggttgtggacagtagtgagggagggatgaataggtgaagcagagtggtattttaggtggtgaaactattctgtacgcactgtaatggtgggtacatgacattatgcatttgttaaagtctgtagaactttacagcacaaaaagttaacctcagtgtgtacaaatttaacaatagctttcacaggtaggcatggtggcttctgcctgtaatcccagctacttgggaggctgaggtaagaagatcactggaggccaagagttcaagtccagcttgggacttgagttcaagtccagcaacatggcaagaccttgtctctaaaaaaaaaaatttttttaaggaaaaaataatataattcaggaggccacgggatttgggaaagaaagcagactgtgacaagagcatctaactgtattacaaatatatgaaacaacctcaccgaagggatggggagaaaagtgctaccctaactttgaaaatgactggagtctgtaaaactaaaggccaaaggaactgtacaagagtacttactcaagttgataaagtttttctgcatgggtttataggttaataaatgcattgttgctatacttgtatactaacattgaacaataagaaaatagatagcagatagtgggagccaggtttctcactgttggagtggaaattttatgtacactaacattgaccaagaagaaaatagatagcagatagtgggagccaggtttttcactgttggagtgaaaattttacaaatcaacaagggaggaagctagaatgacccatgtggtaatggattaacgttgaggatactagaacagctcatatatagttagatagttgcttgtggaaatttttatagatgggtatgtgcacaagttagtatacatactataaagtttagaagtttacaacaccaccaccacttctgactccaattgtaagtttaggggtccccaagatcaccctcatgttgaataattccctagaggtactcacagaactcactgaaagctgctatattt

SEQ ID NO: 20019 - DNA, 1050 bp, Homo sapiens
gccagcgtcatcagtggtaaaataatttgctgaaacagctgtgagttaataattgtaataataagtaagtgtattagagagaaagtatgttgcaaggaagcattgggcagcacagcagagaaaaagctgtctgcaaaggggcagggctggagggaagttttataggctggacctggagggactacatgtagaacaaggtattcgggaacaggatattgtgcaaacgggatgtttgtagttagctgtttctcagaacaattgttctcactcaccctggggcaccccccttgttgttgctaacttatcaggactccacaatgagttcatactgatatataaataattggataaattaataaatggaagtgaatagacaaatctttccatatggaataatgctaattatattatctagatacttcatcctgaggatgggaggttaattctccactccttaagtgtgggctgtgcatagtgacttccttccagagtcccttatgaaaagtggagagtgggaggaaaggaataacttcatgggagagacgtgacaaacacaccttcaagccaagtgattatggtcaatataaacagtcataaatcatgttgatatcatatataccctcaatatgctatgatgaaaaatggcactttatctctgtgatctttgtcacaaaagtctgtaacaccaatctaaccatgagaaaaacaaatactttttttttttttttttgaggcggagtcttgctctgtctcccagactggagtgcagtgcagtggtgcaatcttgactcactgcagcctccacctcccaggttcaagcaattctcctgcctcagcctcccgagtagctgggattacaggtgcacaccaccgtgaccagctaatttttgtgggtttttttgtttgtttttcatttcgagacagagtcttactctgttgcccaggctggagtgcagtggcatgacctcggctcactgcaacctctgcctcttgggttcaagcgattctcctgcctcagcctcctgagtagctaggactacaggtgtgcac

SEQ ID NO: 20020 - DNA, 1061 bp, Homo sapiens
aattttgatttgtgttttcctaatgattagtgatactgaacttttttttttaaatgtgctttatgaccatttatgtatcttctttttttgtttttttttgtttttttttttgagatggagtctcactctgtcaccaggctggagtgcagtggcgtgatctcggctcactgcaacttccacctcctgggttcaagtgattctcctggctcggcctcccgagtagctgggactacaggtgcacaccaccacatccagctaatttttatatttttattagagacggggtttcaccgtgttggccaggatggtctcgatctcttgacctcgtgattcgcctaccttggccttccaaagtgctgggattacaggtgtgagccaccacgcctggtctaccatttgtatatcttctttggagaaatgtctattcaagtcatttgcccactttttaattgggtggtttggtttttatattgttgagttctgtattaactccttgtcagatatatgatttgcaaatatgttctctcattctgtgggttgtctttctactctgttgatagtgtcttttgatgcacaacatttttaaattttcataaagtccagtttgtctattttgttgttgttgcctgtatctttgatgtcatatctaagaaagcattgctacatctaaggttgtgctttcttctttcttgccttatgttttttaaaataataattttatagtattaggtcttatatttaggtcatggagccatttggggttaattttagtatatagtatgaggtaaggtccaatttcattcttttgcttgtggatatccagtttttccagatccatttgttgaaaaggctgtatttttctccactggatggtcttgacacccttgtcaaaaatcactttaccatatatgcaaggatgcatttctggactccctattgtatttagttgttctacatatgtgtctgtctttatgtcagtactattctgccttgattactgtagctttgtagtaacttttgaaatcagaaagtgtggctgggcttggtggctcatgcctgta

SEQ ID NO: 20021 - DNA, 1021 bp, Homo sapiens
tgggagcatgcaggtgagcagttgcaggagccagggcaaacaaatgctggaacgagccggccacttctctccagtgggagcaggtcctgtgcaggccccacagcaggatccaagtgtgttacaatgctcttttagctctgccatctggagggagtgccggctacccctagagccccagagggcatatcactagctcagtgggctttttgcctcattgtgaggggcagctgccctctgccagtgagggcaaagggccagtgtgacagcctttttgggttcctgcacccagtggtcctgaaatcttgtccaatgcccaagaggaatgaggtcacacagacttgaaggatggtgaatgcagagattttattgagcaatggaagtggctcttagtgtgctggggtgctggaaaggggatggagtgggaaagtggtcttcccctggagttcaggtgtcccaaccgaacacctctccgaccatccccagctgaactcctctctgactgtagtctctgatgttcagctacttcttctactctgaatgttcaggtgcttctctcttctgtgtgtccactgagtttggggtctggggttcttatgggcacaggatagggggtgtggtgggctaaaagagaacatttaggtggggaaatggggatgtgaagttctcatttagggctgcaggtccaggcttgagggtggaacctttgccagggaccccgcccttctatctagtatttccctgccttctgtccatatcaacaggaggatcacttgagcccaggagttcaagaccagtctgggcaacatagtgagaccctgtctcaaaaaaaaaaaattctctttgtttccataccactccaaagtcatgagctactctgacagcatatctgctgcctgtataaatattagcagttatttcttttgtccacgacaagttctaactaatgctattaactctgcttgttgagctgaggttgcttttggaagacgagaactttctgtttcctcagttaagatactgt

SEQ ID NO: 20022 - DNA, 1048 bp, Homo sapiens
taaggatgttttattccttttggtatagggagggtgtctttcacatgggaatttcatctcctgcttttaagaaacagaaaagaggctagaaggatctttttgcacctgctgcttttcaagtgcctttaattcaaaatagtcaatatgtcagagtggtatatttttaactccttcagcttaaatggaagattcatgttttcttgaaaggattaggaatatgaagtttcctgcagaattttacaccaaagatgtataaacataagaactttaccagaatagggcagtgagagtctgaaacaatctttcagggaaaatctgacgatatctcctgaacatgtatgtaatcttttggctagactcacagacttcctaaaaagtatgatggtaaggagaaaaatttttcttctgattctgttgtgaaagagtttgtttgtttgtttgtttgtttgttttcttttgagacaggatcttactctgtcgcccaggctggagtgcagtgacacgatctcggctcactgcagcctcgacatccagggctaaagtgatcatcccacctcagtctcctgggtagctgggaccatgggcacatgccaccactgctagctaattttttttggtatattttgtagagatggggttttgccgtattgcccaggctggtctcaaactcctgagctcaagcaatttttttttaaactggtgatggttcacaacttgtgatacctaagtttgtgtatatatcaataatatatataaacaacatgcaatattcatttcctgtatattttattctatgttaagttttttggaggtaactttgtctactcagcaagtagaatgttacgcagcaagtaaagtcattattgttttgtttagtcttgctttgtttttgcaatcctaattaaggataatattcacttcccatccagagagtataccaatcctttttattctgcttttcactttcccgtttccttctttttctttctcttttaaaacttacacaaatgtcatacatgaaaacactgccattgcaaaaacttccaga

SEQ ID NO: 20023 - DNA, 1023 bp, Homo sapiens
ttcaatttctcgcctgggcaataaagtggaagtgtttcgggtcagtggtggggtggagtgggagagtgggtaggggaattaagtcccaccctttggtatttcaagaaatccatttgttttctatctatctgtcctacgtctactctattttgcctagtgtcctcatgtctggaatacccctcttcaatttctcaagaggatacactgccattctccaaccaagtcaggggtgtatacacttagctgctagcattctacacatgggagtagggaggagaatcaactgttcacatacacagacttttatcctggtttttcactttgtgcttcctcactacccactgggtacttccaaggtcagaggttttcccagattctttgggggtgaattggctttcttctcaccaatgtccccctttgtaatttcctgagattatagcttcctccactataacaagtcagataccactcctccatttgttctcccttttctaaaaatatgttatccactgtaaaacatgctatgtactccctcttctatttgattgtccttgaggatttaaaccttttaaattatgttgccatcattttattaggggagcagagaaatacatatgcttgatcttccttttctttttgacagaagtcatcagatgaatgttattttaaaatattattgcatttaactatactatttaattatataatgagctggcattccctagtacacctggaaaaagtagtccagatttgttcatatagatgtagagtttggctgccatgaccacaccctcctctttataacaagcaagtggtagtgaacaaactcaggtcacaggatccaatggaaagagtttgaattcccatagccggggcaggttcctttacctatggttaatgttctagagcttgactttccccatctctgctagaaacagactttactcagccacaattccattttcttttatttccccttttgcctttactagcttgaattactggcattaactgaggattctt

SEQ ID NO: 20024 - DNA, 1027 bp, Homo sapiens
ggcttacgcctgtaatcccggcactttgagagactgaggcaagtggatcacgaggtcaggagatcgagaccatcctggctaacacagtgaaaccccgtgtctactaaaaatacacacacaaaaaaaaatttagtcgagcgtggtggcacatgcctgaagtctcagctacttgggaggctgaggcaggagaatcgcttgaacccaggaggcgaaggctgcagtgagccaggatcgcgccaccgtactccagactgggagacacgatgagactccatctaaaaaaaaaaaagaaagaagtgaattgttttatctccacatatttggggattttccaattatctttatgatactcatttctagtttaattctgctgtgatctgaataagacattgtataatttttattcatttaaatttcttaatgcatgttttatggcccagaatgtggtctatctggatgaatgttccctatgagtttgagaagaatgtgtattctgctgttggatgaagtagtctgtagatgtaaattatattcagttgatggatggtgttgttgagttcaactatgtccttactaattttctgcctgctgcattttgtccatttctgagagagggatgttgaagtctccaactatagtagtggattcatctctttgtccttgttgttctaccagtttttgcctcacgtattttgatgcactcttactagaaacacacacttaaaggattatcatattttcttggggaattgactcctttatcattatgtaatgcccttcttcagccctgataacattccttgctttgaaatctactctgtctgaaattaagtatctacttctgctttcttttgattagtgttatcatggtatttttctctattttctttcatctatatgtgtctttatatttaaagtggatttcttgtagacaacatatagttgggtcttgtttttttaatccattctgacaatcatttaatttgtgcatttagactattaatgttcaaagtgattattgatatac

SEQ ID NO: 20025 - DNA, 1041 bp, Homo sapiens
aatttttttttccattggctgccccctcctctctactttcaattttgtagttagggctctgcagagaagagcttgagattggtgcaattggaagaagagccaaccaatcacaccagagcttccaccgacagcagaggggacgtaacacaccttctttcccctccggctttccttccccttctctcccgccttctccttattcataccagaagcgcctcagctctgattggctggagctctgtgctatctcagccaatcacaagccgggctgtgctcctacaccatccgaagagcgaatcgtgcagagaccgtgtctacgattggcctctccctgacaaggatttaattttgaatttttctttatggcgtgggagaggccacagcccggactccatcgactcccccggctcttagactagtaagtgcaggaacgattatttctttgttatctgagctcgcgtcttgagtagctgggcctgttgctgcttgtgtttttatggtttagggaggtggggactttggctggacacgaaggggaaatggaaaggaggaaggggaggtttggggctggggaagaagtgctcggcctggcttcatcttaaccatacttctatttaattaacacttcgcaagatacgttttggagcaaagcatctgccttccttttgaacatttctttacatatttgctgctcaatgcaagtccacagatcagcggcatccgcatctcttgtttgcttgttacaaatgcaaattatcggactccacccaaatttactaaatcagaatatacattttaacaagatttccctgagtgatttctatgcacattaaagtttaagttggtacatttcttgactgggaatattactatgttactcgatattgtctggcatgctgttagagtgtcaattttaaatgcgtgtcctgtttactgagtgcctaatactgtgcgggatgagactttagggagctgcagtctctttggaaaaacaagacagaacaaaaacagcaatgcttaaaaaaaaaaaagcataaaaca

SEQ ID NO: 20026 - DNA, 1043 bp, Homo sapiens
ctatcatgtagctataagtgtaatacatatattaagtatcatagataaaaggagtgctcccttcagcagcacatgtaaccatagatacaaagatttaaatataaaagatttaggataaaaagaatcctctcttaaaaaggaaaacaaaattatatgtatatagcagctatgacacccatctcacaactttacaggaacagtatccaaaaataccagtattttcaaaatatttaaaataaatgtagtaataattctatgcccatctttttcaaaataaaccaataaaatatatagtatatattagacatgttagtatatctaagacatgttaaaaattacaactgaattctcacaattcagtcacaaatctaaacagcaaataaaaatttctatgacaggaacttagggtaactaccaatagctataaatagaagagattattatgtaagtatcatagataaaaagtgtactcgcttcaggggcacatataataatacagaaaacatttaaagataaaagatttaggataaaaaggattctctgttgaaatgaaaattatctttatatatatatatacataacagctataactcatgaaaaaatctacaggaacagcatattttcaaaagtacaacaattttgaagctatttgaaataaacctattaataattcgatggccaacattttccaaacaaaccaataaatgcatagtgtgtatgaagctatctgttacagtctatggcactcatatttttacaaagaattctgtgctaatctgagtgtctgcactgtgccttcaaatgctcttggactgtggcaaccaagtccataggaaagaggacctccaggttccgccccagggaggttggaattcagcggtataaaaatagaggtggtggtgcagaaaggggtggaaccagaaacacccctggtttctcactgttctctatggattcctagaagtgagaggtgacagcgtgctggcagccctcgctcgctttccgtgcctcctcacctgggcgcccactctggccagccttga

SEQ ID NO: 20027 - DNA, 1027 bp, Homo sapiens
cccattctgcttgaagctctggaaggaattcagggactgagaatacacttcctcagactcttctctggctggtttggggaggaaggatctacttgcaagggacgggggatttgaatcctggttttggtcctctctaattgtgtgatcttgggcaaattgttcctttttctgtgtctggaaagcaggggtcatcatcataatgcctgtctccctgggttgttgtgaggattaattgagatatgacccctcatagacgcataacagggaattaataaattgtagaatcctggaggtttatctgcagttgttccagggtctctctcccaaactgcccccacttcctaccttcctccaaccaaggcttactgagctttctgagctcctcttgccaagctttgggctgcgtatgagggctgattaaccagacatggtctcatgtctgattaaccatggccaggaatggtttgcaatctagtgggaagtctgactgagaaacaactaattttgtggaactttttttttttttttgagatggagtttcactcttgttgcccaagctggagtacaatggtgtgatctcagctcactgcaatctccacccccccaggttcaagcgatcgtcctgccccagcctccagagtagctgggattacaggcacctgccactacgcccggctaatttttgtatttttagtagagacagggtttcactacgttggccaggctggtctcgaactcctgacctcaggtgatccacccgccttggcctcccaaagtgctgggattacaggcgtgagccaccgtgcccagctggaactttatttattttttttttttgagacagagtcttgctctgtcgcccaggctggagtgcagtggtgcgatctcagctcactgcaggctccgccctccaggttcacgccattctcctgcctcagcctcccaagtagctgggactacaggcacccgccacctcgctcggctaattttttatactttcagtagagacggggtttcaccgtgttag

SEQ ID NO: 20028 - DNA, 1031 bp, Homo sapiens
gtcctgtgaattctagccaccttggtcttcctggactcccagctttctctccctaacccagggagttctctgagttccatttgggctttacttccctgtaccttggtctgcagtctttatcaaggctgaagttggggcagttgttgggcgtactgcgtttatttcctgtctctgtcctttattgcctgatattacagtgttttggaaatcattatttcatgtattttttccatttttttggtttcaggtggaagggtaaatctggtctctcttaatctatgttggccagaaacagaggtctttagaaatgtggatttttcaaaataaaagattatttcaaattgtactatgagatttaccactctctacatattctttttatagcaaagtgatttcccaaaagagacctttgaaggccctaaacatgaagtactacgaagatgtctttgtgcgggctatttcaaaaatgtagctcgaaggtaagcaataaagacttgagagatggatcaagatataatactgtatttgactataatattggactatttaatattaaacattgaagatttgatttaagctctgtgatgattatgacatgaattacagtgacgagggagagctacagtgacgagggagagctgcagtggctcagaatgtggtattagagctcaagtagggtaggaggggtatgtttgtagggtggctgtccagcatgggttatcttcacttaaggcaagtaacaagagttttctttcagagaggtggccctgtgtatagtgtgaaagccaagtaggttgagcatagcatccctgaggaagggtagcttggcatggagtgctagggcttgagcaaggtggggaggggttatttggtttggggcatcagtcagagtgtagtgaggaaggcatctttatagagaaaggggtaacagtgatggtgatggagattcattaaatacagaggaattgaacacataactctgtgagtgataatggtgaagggagttagaaatagcgaaagtgagaaaatag

SEQ ID NO: 20029 - DNA, 1796 bp, Homo sapiens
tttagagtcacacagctagtgagcagtcagacttttaatatttattctttcatttggctcattgcctcatttggtaaatggtctgtatcatttgaattgcaaaatgtaccacaattgtttatatctatgctgtgatgttctttgattctagtagtactgtcgtttgtttatcgtgaaatattttttatattatgagaaaagtaggagacagcaaactaacatctgactttatgccttgaatgattatttagctgtatcttttttaaggactttatcctgtttcctattggaaaattgtgcaggatgattgggatccggttaacttgtaaccaggattgtctgcatccctctcataagactgaacttgtcacacttttctatagactttttcttactgaaaagaatgagtgtgttccagtctgaagccacttgtgaaaggaggaaacttctgctttctattttactgtaaattcatgtttttgtgtttatgccaagaaatagaagcttgaactcaacgaaggcagttgtgcatgaaagggataggaaatgaaggtgacaatggaatatatttgctcattttgagtagcatcatggtagaaaggaaaatggttacagacttgtagggttgtgctttggaggcagactgccagtactgttaatacttcttgttcctaatccttaggtaaataaggattttcttcaagttctgaagtaagacggttttaaagattattgctgaaagaataggaaccagatccattaaagccatattttgtcacattaaaaaactctgcagtgtgctattctggaaaatgtctcagatgtttaatctgggcttatctattgattatgtcaggttttcaacttgtctcaacttcctcatttattaaaacaatatttcctggcaattttaaagttagactacagtatgtttttgtatttgtagtataatatttagccccttaaccccttacaggcactcgaatattagttcttcccctccaccctggaagagtttccctttgtccacttgagttgaatatatgtgccgtactaaaggagaaaaactaccatctacccagttattgaagccaagatcttgaagttacaccagactctctaatttctcattttctgcatccgtcgatttctggagttcctcagtgatgcacactgggggtctcagggatgacagtttttcatgaccctaggttgaaactgggagtcatagaagacgaaaaaacgagaattggattgggagttgactctgttgcccaggctggagtacggtggtgcaatcttggttcactgcaacttccgcctcccaggttcaagcaattctcctgcctcagcctcctgagtagctgggactacaggggcccgccaccaggcctggcgaattttttttgtatttttagtagagatggggtttcaccatgttggccaggctggtctcaaactcctgacctcaaataatctaccctcctcagcttcccaaagtgctgggattacaggcgtgagccatcgtgcctggccaacttgcatttatttctgattagctgctcatctgagaaaggtggcttaaaaaaaaccaccaaagtggacagactgaagctaaagactgtcagtatatatgctctgcttggcaaacagctgactttggatagatctcattatttaaagatgaataataagggggaaaaacgtgtagagagaacatggtttacaaaaacccatctctttctccagtctctgcaatattctatatttggtcatattgaactatgaaaatctaa

SEQ ID NO: 20030 - DNA, 1029 bp, Homo sapiens
gtatctctaattgcttaggggagaagggtattactggaaagacggggtgggtgacttttcatagtataaccttttgtaagattttagtgctttactgtatgcacgtgataactattcaaaaaaacaagcccctttttttggacccagtttattgactccatattcttataacagcaaaataaaaattcttttaagttaaaaaaaactttatcataggaatttccaagcatatgttaaaataggatatctccagcttcaacactaatggcattttgcagattgagaggataataaaatgtagctgtagtttggatacatgtatccagatatattacatgtatttcagatatgtcctctgaaaatacctgcaagtttatagagaatgttgtatatgtcctttgactttatccatgcttagttccatagtgtataattcagtttatggctgggtacagtggttcatacctgtaatcccaacactgggaggtcgagctgggaggattacttgagcccaggagttcgagaccagcctgggtaacatagggagaacctgtctcttaaaaaaaaaaaaaaattagccaggcatggtggcgcctgtagtctcaggtactgaggaggctgaggtaggaagatcacttgagcctgggaggtcgaggctgcagtggtaccactgcactccagcctgggcaacagggcaagaccctgtctcaataaataaagaataaaaatacaattcagtttctgtggtatagcttatatgccatcacacctttataactgactgagaatactttatggttactatgtgctgttttgaaaataaaacctgtttaaaaatatgttgcattttaaaagttttaatctatattgatattactagacatagttatatagtttggccaccctgttacatgctcctactgtaagggtatacctaaaccagacttgcagttaataagagtgacttgtcctattattgtgtgctttggcatatttctcttttgagtatataacaggaaaatatgggaa

SEQ ID NO: 20031 - DNA, 1102 bp, Homo sapiens
gtattaagcttccttcagactctttaaagaatttaaattcaggtccttagcaattcccatgcctctctattaaaaggccatcattttaattttgccaaaattcttttctatttttaatgttattgttatcttatcacatttcttaatgctttcttatgtgtgcagatggtgagttatcttaaattagattgtattagttattgtcctgttctataaaaagaataaattgaaaagattttcggagcattgtacaataacatcatagatttgtccctatatgtctgcactatggagtcaagctgtcatcccttgtccccctccccaagaccaccccacttatgtatatattccaacccctaataatctgggagttgaggaaggcagcaaaggaaagtaagtcattccaaaatactgcttccctctgaagccagttttgaaccccttggcttctttttataaacaggactgtaactctcacaatttttcaagtctggttgtggtttacatactgtgtgggatgggaataacattcttcattttatgaaagaaatttttgcacatgtgttacggagggttgtagtacaaagctgtatgttttgccccccttctttgtccccccagcacccgaatcttaaaattttggtccttcaggagccagattctctgtgtctcaggaatggtgtttttcttagtctttaaagactaatcttgatagcctagtgatagttgtaggctttggcctctattaatttataccaaatcacattttgaactgatggatttcaaactacaagtacaagcctttgcatctgactcagtggactcttaacactcaaggcaaatttcatccttttttaactaaatgcttgctttcttaattggatgaagcttgcactttgttcttatctccagtatattaacagcatctgaaactatcctcttcctttgtctccctctcctttcctccagcacctctaccttccctttgttatcttaagccggttaaatgtagcaggcacttctcttacgtgctagtggcaacaagacagaattgaagcagatcctctttttaaaaagcagtttccacaagatttatttagat

SEQ ID NO: 20032 - DNA, 1964 bp, Homo sapiens
tccaaagaaggcagtggatgtcttctttcctccagaagcacaaaatgattttcctgttgcaatgcaggtattttaagcaaaataaatgactttttaaaaatctctcctcttaaaagaaattaacccaaagactattcatggtagatataatttaagtgatgcttaaaagaatacttttttaaagtttattagtgaagctttgtaaaataataccttggcttttcatgtacaggactaccttaggcctattatgaggtttggctccagaccaccacaataaagtaaataccacaacaaagtgagtcataagaattctttggtttcccagtgcagatcaaagttacacttaacactatgctgtagtctactgtaaagtgtgaaatagcattgtctagaaaaacagtatacatactgtaatttaaaaatactttattgctaaaaaatgttaatgattatttgagcctttagtgagttgtaatctttttgcttgtggaaagtcttttctcaatgtcgatggctgctgaataatcagagtggtggttgctgaaggttgaggtggctgtggcagtttcgtaaaataagacagcaaagaagtttgctgcatcaattgactctttcacaaaagatttctctgtgcattgctgtttgatagcattttacccacagtagatctttcagaattggagtcagttctttcaaaccctgccactgctttattagctaagtttctgtaataatctaaatcctttgttgtcattcagcaatgttcacagcacctttaccagcagtagattttatctcaagaaacctcttttctttgcccatccttaagaagcagctcctttactaggagattacagtaattcagtcacatttttaggctctatttctaattctggttttcttgctatttctaccacatctccacttacttgctccactcaagtcttgaactcctcagtcatccatgaaggttggaatcagcctcttccaaactccttttaatgttgatattttgacttcctcccatgaatcatcagtgttcttagtggcatctagaatgatgaatcctttccagattgaccgttacttaaatttactgtggtgaatcctttccagattcacttaaatttactttgcccagatccatcagatgaatcactgttcagggcagctgtggtcttatgaaataatatttcttaaataagaagacttgtaagtcaaaattacttctttggtccataggcttcagagtggatgctgtcttcgcagacatgaaagcaatattaatctccttgtatatctccattagagctcttgggtgactatgtgcattgtcgatgagcagtaacattttgaaaggaatctttttttttctgagcagtaggtctcaacagtaggcataaaaagatttagtaaaccatgctgtaaacagatgtgctgtcatcagggctttgctgttccatttctatagcataggcaaagtagatttagcataattcttgaaggtcctaggatttttggaatagcagatgagcattggcttcaccttaaagtcaccagcatcattagttcctaataagagagtcagcctgtccattaaagccaggcattgacttctctgtagagaaaatctgttgtttagtgtagccaccttcaatgatcttagctagatcttccatataacttgctgcagtttctacatcagtacttggtttttcaccttgcacttttatgttatagagatggtttatttgcttaaacctcatgaatcaacttatgctaccttcaaatttttcttctgttgctttctcacctctctgagccttcacagaattgaggagagttagggccttaaactagattaggctttggcttaagagaatgttgtagctggttggatcttttattttatttatttgtttatttatttatttatttattttatttatttttttttttga

SEQ ID NO: 20033 - DNA, 1050 bp, Homo sapiens
ggtagaacacatagaggcaattgtagttattatattggcctaatattgttgtgtctcaggtaatagggaggcctgaggaaagggaaagaaacgggagaacagctggttggtggagcagtcagaacacacacaatatttatcagttcagtttgctgtcttatgtgggtgcaattcatcacaccccaaaataatagttacatcaaagatgactggccacagatcaacatgacagatacaataatgaaaaggtttgaaatattgtgagaattaatgaaaacgtgacacagagacactgaagagagcacatgctgttggaaaatagtgccaataggcttgctcgatgcagggttgccataaaccttccattcgtaaagattcatctgcactgcaaagtgcagtaaaatgaggtatccctgtaatacgtaaactgtgctatctaagttttgaattgtctttcctcttatcagtttcatgttatataagagcttgggatatccatatttaaatgtgctgtagaaatgaaggaaactttaaatattagcttataatttttcaaataaccctcttgttctggaattttaccatctctaaaatggaattagactgaatgtttttattttctgtttgtagattcattattttactaaagtgttgattttctttctgtagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagtaaggaaaccttgaaacttaagcaataaaataagataacctgatgagttgggaacaatcctgtccttttgagaaattactccccaagattaaaaaatagaaaataaacatattactgttagtttttttccaaaaagtaaatagtaactttggatattagaaaataatatatatcaaagcacgatgtaagctgataaaaaagaaaat

SEQ ID NO: 20034 - DNA, 1018 bp, Homo sapiens
tctccatagtatcttaaaacaatttcttttaaatctttttttgtagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagtatgtgttttaatgctttttaggcatgtttccaacattgttttagtaattgtgcagcgcctctcagattgttatgcaaagctactgaggggcctactccttattaaagaaaatgtagctattataatattcttttgtactttaacagttcactattaaaccttaatctgtaatacggatattgaattactcatgtaagtggagtggacaataaacttgccttgtttgtggttttacaggttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgaggtatttcagtttcttacctaatagatggtgttagttgtgattaataggtacactgaaaatgtgtttgtggtactaaatattaataatttcataccaccatgaggttcaacattatttcatttattcattcattcatttattttgtcttgtagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtaattaggagtttttgagtttttaaaaaaagtacttaaggtagccaagaagaggtatgcttatgatcaggctgttggaaattttgtttttctaaaa

SEQ ID NO: 20035 - DNA, 1073 bp, Homo sapiens
tagctttagctttattcttgtaactgccagttactttgtgatggaaataaagctttaaaattgatagctatctataaaaggctaggaaaactacagaacacttagattactgctctctcactgcctattatgtgtgtgtgtgtacactatatatatatataatgattcctgagactttatagaaagttctgaagtattttttgtcttggaagaattttacattacaagtaaaaccaaaatgtttttgtagaacacagtatagaaagtaggcttttcctactcccagattatcatcatttgtgtgtgtggttgcattggcagattgttcttttgaagaatttactacctgggctctagattaaatagcaaaacccttaggggttttagtgtaatgaagtagtcaaaatgttgaaactgctctacattttagattaaaagatacacttttcaaaaaagtatagctttaaaatgtcttggccatcatgaatattctgggtaacctagctgtgctatgtttggaccaaaactttctggtgtcaaaaaacccctccaaatgagaaagatttgatactctgtgcttgactagtgtacccatactactgattcacttccttctttgagtatcattactatttcctttaaaaaaaacaacaacaaaaaaaactactactagattcttttgggggcagggggtgttgggtttttttttttgtttttctttttaagcttttaagttcaggggtgcgtgggcaggtttgttatataggtaaactgtgtcatgggggtttgttgtacagattgtttcgtcatccaggtattaagcctacaacccattagttattttttctgatcctctccctcctcccatcctccacccttcagtaggccccagtgtctgttgttcctctctgtgtccatgtgttctcatcatttatctcccacttgctagtgagaacatgcagtatttggttttctgttcctgtgttaatactaccagattcttaaatgatttctttttgtttttattgagccctcagcttctatgcttaaattgtaacttctttagctttgga

SEQ ID NO: 20036 - DNA, 1033 bp, Homo sapiens
taaagataacaaaaatattttatatgtgtataggtaagatgactagtgtgttgatccatacttttttgatgttcatttagtaggaaaaacatgacatactaaaatttttacatagatagatgcagacagattctagaaatgatcgtaacagctattagtgcagagtttccatggtgttaaacaatacttattttagaaaaccttccttaatgtggaaaatctgcagctttacagacatttttattttttaatttaggatggctatattaaaattaagatttaccttggtgttcttgggacacttcatagactagtcttcgtattatttataatcgagtaactaatatcccctagtctcaggagccatttaattctaaccttgaaaataatgttcttagtggccatcactggggaaagttctaccctacttagttctgcttccctagtagactgtgttagaggaatcatttattgaggaatgtttcactgtgtataaatgaattcctgatggaaactgttgttttttgtgctctaccttatgtctgtggaatgtaacaggacatgtatcaggtaaatgcccagtacaggttttacttacctgtctataacatcttctatgtcagtctataagtaggattgtagtttggtatctgtaatggaatgataaaagcagttggcaatttaaagatatcttttctttaaatgctgggtttttttttttgtagggggtgggttttcttatggccacatgtggtcaccatcatgctgctccttgtaggctttgttataatagagtattagaggctggttgtatagattggatgtggggagggatagaaaatcattagtttgaaacaaatgtaagccatttatgccatatgtttgacaatgtgactatagttattaagttgattttaaatacggtagaagtgttattaccagtgaaagtcccagtatggtgaatttatcatctgagagccactggctcaggtatcttaatttgttactcttgttttttggtaaagggtgtgta

SEQ ID NO: 20037 - DNA, 1012 bp, Homo sapiens
cggttgtggtggcacgtgcctgtagtagcagctactcgggaggctgaggccggagaatcgcttgaaccctagaggcaggttgcagtgagcccagattgcatcaccactgcactccagcctgggcaacagagggagactccatctcaaaaaaaaagaaaaaaatcttgccctccaaattagaaatattgtccatttcatagccatatgttagtccttgatagtgaaaatcttggagaaaatggtatctttaggtaaaatgaaaaatcataccttttgatgcttgaatctaggtgtcatattacatgttaccatctaaggggctcattgattgagaacggaatataatgttaaacaaaatactgatctggcatttggatggctttttttttttaaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggttgataaagttgcggggcaggggctgttttaaaccaggcctaaaatggtgttacaagtgattataatctataaataaaagtattggttttgtgaatatgagagctgactttaaggcaatttaagttaatggatttcttgattctaggggctctcttatgttaaggtcaaacttgtctggggaaaaaaaagcttttagcttatctcttctttgaaaattttaatttaaatgatacaactaggaggcttttttccccttgcaaaaccagatttatattggaaagtttccattgtttttcttggtttactagttcagtatgtggggtctaatgtttttgactttcactatttctttgaataggatgcaatgcagtatgcttctgaatctaaagatactgaattggctgaagaactcctgcagtggtttttgcaggaagaaaaaagagag

SEQ ID NO: 20038 - DNA, 1245 bp, Homo sapiens
cttctgtctgatactatccactttgaagagtagctagcatatagtagccatttacttttggctcaattaaaagcaaacatttttgggacaaaatcaggctttcctgattacttcttagataacagagcccacacagtattaaaacatgcagcctttctttatgcaaaaagattgaatatggagccacttgaatcttaaacttcagtctgcagctataaccaatatcatcagaagttatacacaattggcaaaagaatagcttattctgcccaaatacttgtccagtcactaggatcatttcacttttttgaataccatttgctttggggagggaagtattgccagaccatgaattcattattacctctgatcagttttaaacttcatttgaaaagtggttccttctcgttttctccctccctcaggctgcatcctagcatgcccagttttagtctggcatgagcttttatggcattttgaatccctccttcctgagggtttataatgacagtgctgaaaaccacctggactgaagtatgaacattgccattgaatttgagggggactgagaatgttctttctagtctgttttattttgacagaatttaacatactaaggcttttccactttctgccataaacctaggtttataatacttttggggtgctaattaacatgatgtgtttttctccaggtggataaattagatgcttcagaatcactgagaaaagaagaagaacaagctacagagacacaacccattgtttatggtaatctctctctgtaacctcaaaaaattcattagacaaatatttaattacttagagactgtgcctcaaaatagaatacaacaagcttctaaagtgcaaaaggctttctaagaaatactgctctctactgtctgattttttttctgagaagtcataaagcaggtgttgatattattcactaaaataatcttaaatacaagaaaactcaaaaatagtcatttaaaatcataacatgaatctttcctatcatctggtccctcacgcattacctgctcataaattactgaaaaagaaatattgatgaattccattttcaaaagagcaaaaggtgagagaacatgccaaggctgtctttagtatgctttacataaagaatacatcctcattttaaattctaactggggcagagaactgggtagagtttccatttgagaactttccagagagataggatcttcaaactctcaagtgaat

SEQ ID NO: 20039 - DNA, 1050 bp, Homo sapiens
attttagccttttattgaagtgatgtgctttttgagtagaaagttttgctttactaacacctgaagaatgatacaatcacaggcaatctggtttttatatgttgtattacattaaagtaaaagcactgatacctgtagtatgaaatgaagcatgttataaataaagtacatttaactatcttaaacatttcaagtttggtttttttttttgcccatatcattttattcagtagaattgtttcctaaataaaactggtctatgatcttagatttatgtatcaacagttgcagcatcttttgtagtatattctatttttatataataatgttaaagggaatatgaaagaaaactgtaaaaaggtaaaatgataagattaattttgagtacacagtagtatgatatttaattgtaaattagaaggagttagactttatagtgtgttaacatttggagttactagtgcttgatatcctccttctgtggacagattacctccaaatttcaatctggaagatccctgaaataactactaggaaaaggtttacaactatatggcttttatatttttactatttgtattagaatatctatataaattgttcaatagaataactaaattgttcaaattttggttataaaagaaaaaaagtgtaaacacatcatacatatcatgtggcttattactgtgatgttattcctgtattcagttttattcagtcacagctacacagcagaagtttgtaatgtattgctggattttattttgctgtattagctcctcaagagttactgatctatgaaatggcagagaatggaaaaaattgtgaccagagacgtgtagcaatgaacaaggaacatcataatggaaatttcacaggtaaattttgatggtttgcagggaggagtgctatgggtttaaatgatatacttttcattggaataaaatagagatatattacttcttttatttttaatcttatattatcttcttagtaaattaaattatgggtcagtcagggcctgtaaggtgatatttcacagtgatggca

SEQ ID NO: 20040 - DNA, 1023 bp, Homo sapiens
cagcctcccgagtagctggaattaaaggcatgcgccaccacgcccagccaatttttgtatttttagtagagatgggatttcaccatgttggccagggtggtcttgaactcctgacctcgggtgatccacccaccttggcctcccaaagtgctgggattacaggcatgagccaccgcgcccggcctcatttgtttgttaatcaccatattgccttgcagaggacattttgcagcactgatctgacttttgggttactttggttgtcagtaaacttggcaatttcaccaagagtttcaggattcagagatgggcattgcatacatcatagtgtcttcccattaggagcttttgtgtgctatttttttctttccttttagagagcacatacatttgtatattcttcctcttctgctcaccccattggaatttaaaattaacattagcatgtcaaacttactcttctgtaccaggtgttttttaatattttagagattatgctataactgtacatgaaaaactgattcttaggctgggcgtggtgattcacgcctgtaatcccaacactttgggaggccaaggcggaaggatctcttgagcccaggagtttgagaccagccaggacaacacagggaaacctcatctctgcaaaagattttaaaaatttgctggatgtgatcgtatgcgcctgtagttctagctagctactcaagttctagctagctactggaaagactgaggtgagagtatcgatttagcccacaaggctgcagtgagctgcgatcacaccactgcactccagcctgggtgacagagcaagaccctgtcccccaaaaaaaaaaatttattctttattatggctgcttagtttttctttccattgtacgagtgtgctgtactttaatcactcttctgtcctctattggtaatatataagttattgattattttttgctagtacaaataatgctgtggtcaataaagttgtgcaagtcatttcaccttatacctaatcattcctagaaa

SEQ ID NO: 20041 - DNA, 1027 bp, Homo sapiens
tttcttgctatggcttggcaaagagaagatttttaatgctttcaatcatgaatttgttttaggccctttgcttattttatgttttacagatctgcatattttttaattatacaagtaattttagtaataagattcttacattccaaaagtattataaagtaaaaagtgaaagctcacacaccttctccccagtgtagggtaataatcactgtattccagactgctttctttgcatacataactttttataaaaattagaatcataccataaattttagtcacaagttcctttttcacagtatcatagacatgtgataccaatgttattataaaattattttttattacgaagtgatacatctcattgtagaaaattggtgagtgccctttagtcttttctctataaatatttatatacctaagagtgaaatcatattgtttgttgttttgtgacttgatttgaatctaaaaacgtgaacatttttccacgccatcaaatattttcacatctttgctataacgggtttttttcttactacaaagtaagtttattataatgaaatgctgaaaatacaaataaagaagaaatagaatgttcatctaacaggtgcatatatcttttttatgatatatttttcattttcttactggtttacatatttaagaagatgctctttgtcatatgctgccagtattattccttattcccagtagtttttccatgtcatttactgggtatgttttgttacatgttactttttttagacagagtctcgctctgtcgcctatgctggagtgcagtggtgtgatcttggctcactgcaacctctgcctcccgggttcaagtggttctcctaactcagcctcccaagtagctaggattacaggcacatgtcaccacgcccagctaatttttgtatttttagtagagatggggtttcaccatgttggccaggctagtctcgagctcccgacctcaagtgatctgccagccttggcctcccaaagttctggaattacaggcatg

SEQ ID NO: 20042 - DNA, 1034 bp, Homo sapiens
ctaaatctgtggtaatggaagccaatgttagtggttattttgcagggagtaattactaggagtgccaccagcagggtttctggagttccggtaatgttctgtatctggatctcagtagtggttacatgggtgtgttgtaaatttccattaagaggtatattttagatttgtatgctttactgtatacgttatgccttagtttaaaaaactactcatactgttttctcctgcaacctgcccatgtaaatttggtaacggaaatacatctatacatcgagaaatccacttaatcctgatcttgacccagaaatagttgatagctccctatttttggcacaacactctgaaatgtgtggtgttcacagtggattatgtatttcctgtgtgtatacatgaaaaaaatttgtgttgatcagttctcacgtaacttttgaaaagtgtaatttggataaagcatcatgagacctactacagtcacagctgcctctagatcaatgacttttttacttctttttttaaactgtagccaacaatacaaaatacattgtacttagcaacccagagccaatttgtgtgtaactagaataaatgtttcgtgaaatagtatttacttccattgcttgtgaggtctcaccattttattctgttcattaaaacacaagatgtaaggccgggcacggtggctcacgcctgtaatcccagcactctgggaggccaaggcaggcggatcacctgaggtcgggagttccagaccagcctgaccaacatggagaaaccccgtctccactaaaaatacaaaattagccaggtgtggtggcgcatgcctgtaatcccagctactcgggaggctgaggcaggagaattgcttgaacccaggaggcagaggttgcagtgagccgagattgtgccattacactccagcctgagcaacaagagcgaaactccgtctcaaaagaaaaaaataaaaagaaaaagcaagatgtaatttgttaccaactaaattttcacaccgcattttaatttaatgaaactgc

SEQ ID NO: 20043 - DNA, 1031 bp, Homo sapiens
ctcattgcctttaaaattgcgtggtgctgggattggcaggtgccaactgtttgctcattctctttgacccactagccttgcagtttgctgtgtgggtgttgatactcctaaattaaagcagggaaggggtggttttagatggcttttaacacctgctctccacccaagcaccctggattcatttgatatctggattctaattctgtagtcaggagactggcccaaactgtggcccagagagaagtgagtcagttgcaagtggctagctgactctatgggaacagaaataaaatgcagcttagagagtttgtcagccaaatccacaaatgtgtggctttttgaaacattggacatctgttcctcttaatttaaaataaactttttttttttttttttttaagcacaaagttgcttggctccttgtttctttgtgtcagcagcagttgctgctctaatttaggaaccctaggatctgatttaggacatttggaatctttaaggcacattcgatctagaaagtggaactgaattgctttgggaaggcaagaggatgattttacagtatagggtttgtgtggaaatccccttcagcagtaatcaacccaggtgtccaacctgtttgttaaccatttccaaatgactcagaggacctagagggagggcttgaacacactccagcactgtttctacaatttagcctttatttgcattggaaaccacattcctgaattcttgagggggcaggctctggcttattctgggcaactgacttcaagtgggacccctgagctacctatgtaagcaaagagtcagccatctctggagagttaccagggaggaggatctttctgtgaacttgctttgatgacctccacccaaagccctttgaggaacagttttgtttattcaaggagcccttggcaggtcactcctcccctaccacaaatctaatccaaatgcgacattttcctttgaggccatctatcccttttgggggacaaaacacatcagcttttcccttcagaccactt

SEQ ID NO: 20044 - DNA, 1026 bp, Homo sapiens
gggtacaagcaagtaggattttgagaaggtgtgaggaggaggtcagaaaaattggtggaaataggaaagagaaagaaatatggccccgattttggggagagaaagtctggggaaagagcaaaggcaattaaagaggattttgaggaagagacttctgtaaaatatgtcttagcaacactttttggagttgaaaatatttctttttagtgtgttattttttctaagaggtgcctcaagatggataatggaagatttggagtacgattgggttgacaatccaaggagattcggtgacatccagattaccctgaaataaaaaaaaaaaaaaattctggaaaatgagagaagtttagattcttagaaaatcttctgatagtttctatttgtgaatttatagactttaatttattacacaaagtttttaaacattggtgcatatcagttttcctcattttatagtaaggaaactgaggcataggccatatgatagccaaagatcacatagtggtagtgtcttctgacttaattcagcaggcttcattgcacaggttcttcattgcatttactagttgtgtttataatgttcctctttgtggtatgtcaaaagtgaattcagattcctttggccatactcactctgtgacctggagtaaattccttaatctctaatgttttctataacatgagggttacattaaataagtacgtaaagtacagtactctcaaaatatcctggcgtattaagcaattagctagttcacagaaattcagcttgtcttgtcattgctaaggaaccaatcattcaggtttaacctcgtatacctagagacttaataattgcagttaaactcgaggtgctgtatttttacaactgtagtatcatagtgtgtatttttttttaaaactaattgatcccgtttagagagatgtgcctttcaaggtacgttacagagtgactatgcgttagtaaatataggtatttccatagtttatttaattagagattaaaagatgagactaaatgat

SEQ ID NO: 20045 - DNA, 1068 bp, Homo sapiens
ctgtaatcccagcactttgggaggccgaggcaggtggatcacgatgtcaggagcaggagaccagcctggccaatatggtgaaacccagtttctactaaaaatacaaaaattagccaggcatggtggtgcacacctctagtcccagctattcaggaggctgaggcaggagaatctcttgaacctgggaggtggaggttgcagtgagccaagatcataccactgcactccagcctgggcgacacagtgagattccgtctcaaaaaaaaaaaaaaaagattctgtttaaatatctcagaggaatataatcaaagcctattggtaagaggggagtttttgggcggagggtgtcttttttgtttgtttttttgtttcactgttgatgatatcatttggggcagtaaattgaaactaaggaaaagttttccttcagagaatttagattgcaaaaatgttggaatcttctctgctctctatagcattaagagtagtagaaaactgtaatgcaatttaaaaaattctcactttgtactctaattcaaaatttgaaataatcacgcaggcttactgtacaagtttcagattgggacatcagatttttattgagtaaaaggtttaaaatttttgaaaaccaaagtgctatatagatagtatatactcaaatattcatgattatgaaaaattatagaaaaaatatcaatacttatcttgctttgtaatatatacttactataaagcagcaacttttttttattttttatttttttgagacggagttttgctcttgtggcccaggctggagtgcagtggtgcgatctcggctcactgcaacctctgcctcctgggttcaagctattctcctgcctcagcctcccgagtagctgggattacaggtgccgactaccacacccagctaattttttgtatttttttggtagagacggggtttcaccatgttggccaggctggtctcaaactcttgacttcaggcgatacacctgcctcggcctcccaaagtgctgggattacaggcatgagccaccgtgcccggccagcagcaactatttttaa

SEQ ID NO: 20046 - DNA, 1048 bp, Homo sapiens
gctaattttttatatttttagtagagacggggtttcaccacattggcctggctgattttgaactcctgacctcaggtcatccacccgcctcagcctcccaaagtgttgggattacaggtgtgagccactgcgcctggcccttgggaggaccttttttttattattatttttttgagacagaatcttgctctgttgcccaggctggagtggaactcccaggcttaggtgatcatcctgcctcagcctcctcgatagctgggactacaggcatacaacaccacactcagctcgagttttatagttttagctcctgtatttaggtctttgctccattttgagttaatttttgtgtatagtgtgaagtagcatatagatatccagttgtcctagcatcattatttgatttgtatgtggatatccagttgttccaacacatttattgaaagattgcctcttgcctaatgaatatttttggcagttttatcaaaaattagttgacaatataaatgtaagagtttatttctgggctcttaattctattctgttgatctatatgtctttctttatgccagtaccacactgccttgatggctgtagctttgtaacatgttttgaaattgggaagtgtcagtcctccacctttgttctttttcaagattgtatcagttattttgggtcccttgcctcccttccccttccccttccccttccctttcgacagagtctagctttgttgcccaggctggagtgtgcagtggcgcgatctcggctcactgcaacctctgcctcctgggttcaagccattcttctgcctcagccctgagtagctgggattacaagcatggatgaccactccagttaatttttgtatttttagtagagatggggtttcaccatattggccaggctggtcttgaactcctgacctcgagtaatccacctatcttggcctcctaaagtgctagaattacaggtgtgagccaccacacccggcctggctcctttgcatttctttctttctttacttttttttgtttgtttgttttga

SEQ ID NO: 20047 - DNA, 1021 bp, Homo sapiens
gctggtctcgaactcaggtgatctgcccgccttggcctcccaaagtgctgggattacaggcatgagccaccatgcccagccaactgctatctttttaattcagcagttttcaatttttttttttagacggagcctcactctgttgcccaggctggagtgcagtggcgtgatctcagctcactgcaacctccacctcccaggttaaagcgattcctctgcttcagcttcctgagtgtctgggattacaggcgcccaccaccacacccggctaatttttgtatttttagtagagatgcggtttcgccatattggcatgctggtgtcgaactcctgacctcgggggatcggcccgccttgacctcccaaagtgttgggattacaggcgtgagccaccgagcctggcagtattaactttcttttatgcgagttaaggatttgtttcttgtttacttcaccctcctttatcctcatcctctcattttgttttgctttctttgaatctactattgtcctctgatgtcttccaacaactttgtaaaacacctttcagtctaatgttctttgatcaggcttataagataatctatcagttccatttatttcccagaggcatatcttaggaactttctatccacctgttcccatctggagtggtagctctttagtcacaactgttatgactggactctttcttcaccacaaccctggaatcctcttggctccttcagtgttggatcttttgtttcctggatcccatatcttcattttttccctttttcttagtttatgtccttgttttggtgacactatactagtggctccctcagacaaggtatataaagatacatttataataaaaatatatccatattgcatatttgagaatttctttacatttttatttacttgattgtttatgttattggagttgaaaattattttcacttagaattttgctcagttttcttctattcttgagagtttctgttgaagtgctttggcattctgattcccagtcgtt

SEQ ID NO: 20048 - DNA, 1062 bp, Homo sapiens
gatctttgtgtaaggtggtaagttttttactttctggatcagtgatgattgattcatactatctagcaattttctttctttcccctaattggtagcattgggcagaatgagctaccttgttataatgagtttctgagaccattttaaggactcttcacagttcactgtgataaaagctatatatttgaagtactgtctcacacctttgttcaaaaggtacagagtatgtttattggggtctgtgtacgtaaactagacttcataaaacagttttcccaggatttttctttttcaggatggtagagaattttgtatatacttaaagctagagccttaaacaggttatttcacttttttctctatctttattttctctttactagatagattgtatcattggcaaaaggtgactttgccctagccttaaacagttagcatcccattttatggatggtaccttgttcttgacatctgcaagaaaatttgaggcaagaaaagttaaatggaaggatagattaaagtattatgtgacatgttcaaacactgcacatacttataattcggagaataatcatgctgtaatctttcattgtaggtcatgtgaaactaacagactttggactatgcaaagaatctattcatgatggaacagtcacacacacattttgtggaacaatagaatacatgtgagctacatgttaaacataattggtttgggggtaatagctaattttacctgttttaaggaatagtatctgttttctgtaccctcattgactctgtatattgtttttaaaattctaattcagatgatatgcaaatgggtgaatttttaagcatattattttcctcattgtagggcccctgaaatcttgatgagaagtggccacaatcgtgctgtggattggtggagtttgggagcattaatgtatgacatgctgactggagcagtaggtgcacagttaaaagctgcatgtattattggtctgtgctgagtcactatagcaagagacctgtcctgtgctttctgaacatgttaccagtggagttttcaaagcccaa

SEQ ID NO: 20049 - DNA, 1019 bp, Homo sapiens
tgctgggattacagacgtgagccaccatgcccagtcgatatattcacatttttaataggaataactgtatactaaaatctattttagtgcatgtttaagatttgaagatgtaatttgactcagtactttccacctacatttttttcttcattctgtgcctgctaagactattctaatactttattatagttaacccccgtgaaaagagctcccagagcttacagtgcatttgattgatgtaacatggactatttattattttctaaattattttgtttgtataaagcaatctgaagaggatgtaagtcagtttgattccaagtttacacgtcagacacctgtcgacagcccagatgactcaactctcagtgaaagtgccaatcaggtctttctggtaagtgaaagaatttccatgtagtcatgggaaattttagtgtgaggatgggctcttcaaagaaaattcagtttgcttgctttgcagttcatgtaggtaacctggcccacttttttttttttttttaaataagccatgcctttataacttattgatgcctacaaaatttattttcataatccaacattttattttagcaattagagtgggaatgtacaaatctttggaaagtatgattcccttttttttttaggccacagacttaaaatgatgtttggcttagcatctcaaccaaaaattagtcatagcagtcggggagaaaaacctcactgactacatgtattttattcctgaaacagctatagatttttggtactttttttttttttttttttgagacagggtctcaccttgtagcctaggctgggtgtagtgtagtggtgtgatcacagttcactgcagccttgacctcccaggctcaagtgatccacccatttcagccttgtgagtacctgtaccacaggtgtgtgccacatgcagctaattttttatttttttgtagagacagagtctcactattttactcctggactcaagctatcttcctgccttggcttcccaaagt

SEQ ID NO: 20050 - DNA, 1049 bp, Homo sapiens
ctaaagctcgcagatattctgaagaagtgcccagacaagattattactgggtgaagtggggaataagtgaaagggtatcaccagagacaggttaactttgaagggaaagcagtaattttggatataatagccaaagagggcattggttaaaaggtgacgtataaaccaaacgtgaaccaagtgcccagagcgttggaactcatagccctaccctccacttccagggagagaagagggactaaaggccaccaatggccaatgacttaatgagtcgtgactgtgtaatgaggcctctataaaaaccagaaggatcgagtgcagggggcttccaagaagttgaagaaaaatacatctacgtgtctaaaaggcagttcaccccaacttcatgaggatggaagtttttacacttgggacccttctggacctcctcaccctatgtatctcttaatctggctgttcattttgtcaacctaaaatagttaagagggtgagaatctagtttatttatgtatttattgagacagggtcttgctgtattgtccaggctggagtgctcaagtaatcctcccactttgacctcccaaagcactggcattacaggtgtgacccacctcacccagccagagtctggtttaaagagagtttattcaagcatagagtttaaggacagcctcctgggaaacacagattccaaaggatggaagtcagtgttttgtgaatgtgaagtttggattgtttatatagacagattggggaagcttaacagaatttcaacatctgtctctccagggtcttattttttgtgtaggctgtagtccagtggtacaatcatagctcactgcagcttctaactgccgggctcaagggatcttcctacctcagcctcctgagtatctgggattacaggtgccaaccactacatccagctctatataaggcttaatgcatagttacaacaatctgattagtcaggtggtctttttctttcaggaaaggtgtatttaatactacacactgaagatgtagcagtcgtggggtcttttgcaccc

SEQ ID NO: 20051 - DNA, 1045 bp, Homo sapiens
ctttggcctaccccccgtctcccaggcttccccactatccttctccagagtgtttgttataatcaatcagtgaacctacactgacatactgttatcacctggtgtccatagtttacattagggttcactccgggtgttatacattttatgggttttgacaaatacgtcatgacacgtatccatcattatagtatcatgcagattagtttcatcaccgtaagagtcctctgtactttgtctgttcatccctcccccacttactcctggcaaccactgctctttttactgccttcataattttgctttttccagaatgtcatatagttggaaccatatagtatgtagcccctatgcatgactttttaatatatgcatttattgtttgtaatatactaggtcactgagttatacagatcttgcaaatattgacactttttattatactatataatatccagtcatgcagcctctcaaaaaactccactgtatacatgtggtcttagtagtattatgaaaaaaaaaaatggaccttggagacaccctgaaaaagtctgtagtaacctgccaggggcccctaaaccacattttgagaaccactttgccagtactcgtatggtttcatcatcttttatattttaatctttaatccttctggaattttaagatctaagctatgtagtaaataggcaagttaactttttttctagatggctactagtagccacttgaataattatacatcttttcattactgagtagcagggtgaccaggcttaagacccttctttagtgggaagatgaccttgaatttaccctcttcttgtatttctctggtgaagataaatgtgaaatatcacctctgttgtaagacagcattgcttattgtagaatgatccctgaatggaattgcatcttggtagggaagttgttgaatggactgtacatttctattcggaagcacaggccttggcttccttgtatgcatgcagtttgtcttgtgtagggaccaagaaactgtagtcatgtgctatttattacattggtt

SEQ ID NO: 20052 - DNA, 1050 bp, Homo sapiens
ctgtcaacccccaattgtttactaattaggtagtgttgctttttttttgacatggtatttatacttacttttcttcacattacattcatttggttatactgcctattccagtaatctcaaaattttccactttgaatctaccctaattcctctctgaacaggaattttggcttatgcatctttgtatttgaaacacataagacattattttgtaataatgtagtcttattttattagtgatttaatatactgagctatcttagttgttgtattttaatcatttagattatttatgtgaactctttatttttagtgtaatgaacaagtctggggtgaatcgtgtagtttggaaacgacctcgactcactcacaatggacctgttagaaggagcacagttattgaccagattccttttctggcagtagcaagagcacttggtaagtaggacttaatttggtgaaattatattgaattttctacaatatatggtggcaaaataaaagaggagacagaactaaacccttacttggcatatagtgagggtagagatatcatgatattctattaactgctttagaacctaatcgaagccatgcatggtggctcacgcttataatcccagcactttgggaggctgaggtgggcggatctcttgaggtcaggagtttgagaccagcctagccaacatggtgaaactgcatcttcactaaaaaatacaaaaattagctgggcatagtgatgtgtagctgtagtcctagctactcaagaggctgagtcaggagaattgcttgaaagcaggaggcagaggttgcagtgatcgcatcactgcactccagcctgggcgacagagcaagactctaaaaaaaagcctaattgaggggaaggtttaggtatataattcactgacagttgccctttgttcatgagtcacgttcaatgttttgctaatttctatctctgtttagggaagtatatgcatatctaggcttaatgttacccttgaaactatttttaagtatcccattctcctttagcccttaatagtcctc

SEQ ID NO: 20053 - DNA, 1299 bp, Homo sapiens
aagtgttcccccagcctcagcttcccaagtagctggggctacaggtgcatgccatcacacccaactaatttttaaaaattttttgtagagacgtctcgctttgcccaggttggtctcaaattcctggcttcaagcgatctgcccacctcagcctcccaaagtgcatgtgcgacagcgctcagcctactcatgatttttttttttttttttttagacagaatttcgcttttattgcccaggttggcgtgcagtgatgtgatctcagctcactgcaaccttcacctcctgggttcaagcaattctgctgcctcagcctcccaagtagctgggattataggcgtgcgcccccacgcccggctaattttgtatttttagtaaagacctgtgagtgtctggggccacagaatgtaggcagaagtaacaaatgtaagggttctcattactcatgaatttttctcttttttctttttctttctttctttttttgtttttttgagatgaggtctcactctgtgccacaggggtttcaccatgttggtcaggctggtctccaactcctgacctcaagtgatctacccacttcggcctctcagagtactgggattacaggcatgagccactgtgccccgctcctactcagtatttttaactgagcagctggaaaaatggagttgccactaagtgataaagaaatgactggaacatcagtgtaaaggagaggtcggaagttcagttttggacacattaccctttcggcatgttttagacattaaggtggtgatacctatttggcttcccattataagaattgatttcaggtgttgtctagggtggagctttcaatttgggggagccagtagcatatagatagtatacaaagtcttgaggtcatgtagggattgagtgcagatagaaaaggggacaaggtctagtggctgagccctgagatactctcactgttaagactcgggggatgtgctctggtttcatttgagggttggattaaaattaaaaaaaaatctaaaagagttaggggatgtgaatggaagaacaaggtaaaacaactaacagctgtaagtcaaataggaaatttgggttagcgtaccctggaagctaagtgaagaaagtgtttccagaaagaaagtgtttcaaatactgttgtcatttaggtggagggaggattgaaaaatgaccatgggatttaggaatgtggaggtcattggtgaccttgaaaaagaaggtagcttttggtggaatagcaagaccacaaccatgattggggttattgaagaaagaact

SEQ ID NO: 20054 - DNA, 1059 bp, Homo sapiens
tgtgcctgtagtttcagctacttgggaggctgaggtgggaggattgcttgagcctgggaggtctaggctgcagtgagccgagatcgtgccactgcactccagcctgggtgatggagtgcaaccctgtctaaaaataaataaataaatacagttaaataagtaagtaaataaaaaaaaatcatttataaaaggctggatgggctgagcactttggctcatgcttgcagtcccagcactttgggaggctgaggtgggaggatcacatgaggtcaggagttcaagaccagcctggccaacatggtgaaacctcgtctctactaaaaatacaaaattagtcgggcatagtggcacactcctgcagccctagctgctcaggaagctgaggcaggagaatcgcttgaacccaggaggtggaggctgcagtgagccgagattgtgccactgcattccagcctgggcgacagagcgagactttgtctcaaaaaaacaaaaacaaaaacaaaaacaaaacaaaagggagtctcactctgtcgcccaggctggagtgcagtggaatgatcttggcttactgcaacctgcgcctcctgggttcaggtgattctcctgtctcagccccctgagtagctgggattacaggtgctcgccatcacgcccagctaatttttgtatttttagtagagacgaggtttcaccatgttggttaggctggtctcaatctcctgacctcaggtaattcacctgcctcggcctcccaaagtgctgggattacaggtgtgagccactgcgcccagcctcctatctctttgagactctacttttgagaattgctggcttatatagtaatgctgtttttaatgttttgaggaaccaccatggttttcctcagtgaacgtaccatttttcattcccaccaacaatgtacaagggtcccaacttctccacaccctttccaacacttgttagtttcctctctctctctctctctctttttggtagtagccatcctaatgggactgggttgtggttttgatttggattttcctgatgattagtaatgtt

SEQ ID NO: 20055 - DNA, 1090 bp, Homo sapiens
actaaaaaaacaaaaattagctgggcgtggtggcatgcgcctgtagtcacagctacttgggaggctgaggcaggagaattgcttgaacacaggaggtggaggatgcaacaagccgagactgtgccactgcactccagcctggtgacagagtgagattccatctcaaaaaaaaaaaatttattgatcattaaaaattgagacaaggtctcactgtgttgcctaggtgtcgaacttctgggctcaagccatccttctgtctcagcctccgaaagtgttgggattttaggcgtgagccaccatgcatggtcttaattttttttttttttttggtagagatgaggtgttgctgtgttgcccaggctgatcttaaactcaagtgatcctcccacctcggtgtcccaaagtgctgggattgcatgtgtgggcaacaatggccatcatcattttaaagtatattgtcagtattgttaaataatttacattgtcgtacaaccagtcttcagaattcttcattgtgcaaaactgaaactctgtacccattgcacaacaactccacagtctctacctcctcccagcccctggcaaccaccactctactttctgtttctatgatttttaactactttagggacctcacatgggtagaatgatagattatttgcctttttgtgattacctatttcacttaacataatgttctcaaggttcattcatgttgtagcatgtgtcagaattttcttcctttttaaggctgaatcatgcttcattgtatgtatataccacatttttttttttttttttttgagatggagtctcgctctgtcacccaggctggagtgcagtggcgtgatctcagctcactgaaacctccatctcccaggttcaagcgattctcctgcctcggcctccttagcatctgggactacaggcgtgcgccatcacacctagctaatttttgtatttttgtagagacggggtttcatcatgttggccaggatggtctcttgacctcgtgatctgcccacctcggcctcccaaagtgttgggattgcaggtgtgagccaccgcgcccagccctgtaccacatttt

SEQ ID NO: 20056 - DNA, 1137 bp, Homo sapiens
acgtcatttttctgacggatgtaagaagagctgttcagctttttacctgtggtcagatctaagtgaagtcttctgagctgcatgtgttggcctggaaactgaaagtctgaatgttcacaaatcagtgtatttcagcttcgaaggacattgtgttgctagaacctaatcattgcaccttagtttgagggaaggattggtcattattgtatttggaattaagatatgaatttcattatgtacaaaaaaactctacttattccaagagctgcttaatcgagtccttgaatctcattaatatcctgtactatcatacctatctgtggtccttcaggacaaaagtcttacatcatctgccctcatggagggccattataataaagactaattatttatatatttactttgaggcagcattacatatccattggagactgatttatgcatttcagttaccatgcatctattgatttaaatccataatttttggacacctaccagaatggctgacactaaatattggctaggatgtggagcagatagaactcttgtacgttgctggtggaagtgtaaattggtacaatcacattggaaaattaaatctacaaaagatacacatgtgcctgccctaatatacagaagtagttactctactagatatatatccaagagaaatacatatacatgtttactaaaagacatttgtgagaatgtttacatcaatattctttattatgttgttttcaaaatggtaaaacagtgatctcatacaactatataagggacagatatcctgcattttttttaactcattgattagggatttgggatgttattatagctggttccaagaagaaggtgaatatcacagagaagcaattaggaatactgaaataaattttctaatagatacaagcttggttaatattctgttgggcactaaaatgtactgtttggaataatcttttctacagagtggaattcacttgtatctctaccagacaaaattcatttgcatttctgtgcacaagaatcaattgcattactatcagtttttgacagctcagagtattgtacagtagcccagtcaaagacaaagtgtggatcccctatagaatcagataaccccaaagggtctgc

SEQ ID NO: 20057 - DNA, 1027 bp, Homo sapiens
gagttttggcgatgacctcttaagtacaacaccgaaagcgcaatcataaatgaaaaaatcagtaagttgggctttattaaaattaaaaacttttgctccgtgaaagattattttaagagagtgagaagatgggctgcagatggtgaggaaatattggtgaaagacacgtctgactaaagaactaaaaaactcttaaacctgaacagtaagaaaatgaacaatcctattaaaaaatgagcaaaagggtctcagcagctcgggctgcaggaggagtggcagcagccaggcagcccagcttcgcaaaggctctcggcatgctgcggcccgcaggcacctggcacacgtcctccccgccaccaggatgcccgagaggaaggtcagctccaccgaaggggccgccaaggaagaggccaagaggagatcgccgcggttgtcagctaaacttgctcctgcaaaaatggaagcgaagccgaaaaaggcagcagcaaagcattgaaaccaccatctgtaaagctctacatgttcttcacggggtgaataatttctacccaaaacttgggttaaagcttgaaacgaggaagtacaaataaaagggcaaaggggagcaaagggaaaacaggctgaaagaaactaaagaagatttacctgcagaaaagggggaaatgaaaactgaggggagtccagcctctgatgaagcaggagagaaagaagccaagtctgattaataccatataccatgtcttatcagtggtccctgtctcccttcttgtacaatccagaggaatatttttatcaactattttgtaaatgcaagttttttagtagctctagaaacatttttaagaagggaatctcacctcatcccattttttaagtgtaaatgcttttttttaagaggtgaaatcatttgctggttgtttattttttggtacaaccagaaaatagtgtgggatattgaattatgggaagctttgactgtcttgggtgtcagcttaacatttcatagatgggggatagttttcatatc

SEQ ID NO: 20058 - DNA, 1017 bp, Homo sapiens
agtcattgaaagatggcaatccctgatagatgaagaacaaatgagaggatgcctatggttgccccagtttattgctttgaaagagtttccagtcatggtgcaggaagggggaaccctagtggagcctagcagtctccctgaattgatgaggtattgctaagagtcctgggaggccaagatcatagattctcaatacactggaccagagacatgggagctgcagagagagaatcccagagatctgcagaggagacatgcgaacaaagaaagaactaccgtcagatcagaaaggcaagagtaaaactatcttttattcaaaaatgacatgattgtctatgttgaaaaactaaaggattttattttatttttaaaaaactaataaatgattttaacaaggttacaggatattagatcaatatacaaaaatcagttgcatttctatatactaacaacaatgaattgatcatttaaaaaatccagaagtgtatactactgacattcaataagcaagacttgtactctgaaagctagaaaatattgctcagagtaaagacctaaataaatggagaattaaaccattttcttgtgctagaatacttaccatcattaaaatgtcagttcttcccagatttatccatagactcgatgtaatctgcatcaacatcccagcagggttttcttttggttaaacattaacaagataattctaaaattcacatgaaaatgcacaacacttatgagcaaaataattttgaaaaagaaaaagttggagaaatgtcactacctatatcaagacttactaaaactacaataatcagtagggatcctgtgaccattcccacacatgtggagacaacttatttttgacaaaggtgcaaagatacaaagtggagaaagattagtcttttccacaaattaacaaattaactcaaattagatcatagacttaaatgtagaacctacaactatgaagttattagagcaccaaaagaaaccttcgtgacttgggttagggac

SEQ ID NO: 20059 - DNA, 1053 bp, Homo sapiens
ctgcttgtggaattttgcaagtccagtagctgccttcttcttctttttctttttttttttttaatcatgcctttgtgcctttcagtccaagatggcggtgtttctgcagatactacattctcaaaaaccttgtgtatctcctgtgtatgtcatggggatccatgccatcagacaagaggacactccacagatctttcttgcatttgtctctctattcctggcttctgctgattgagtggatccatgaaacacatgcctgatgtcttcagcagaatgttgtcaagctatactcctggccttcagagcacattttcccaaccatgaaactcctcatagtaacatctttttctccttggtaggatattcaaataccagaagatccaaaggaagtattattgaatggtaaaataagaagcactctgaatggcagtaagggagacatttgaggtcagggagaaattttgaaaaacttatatcataaattttgtcatttagctatgatggaatgataggaactggattaaacctctgtatccgttaaggttctaccagagaaacagaatcagtagggcattacagaggtttatcagcatacatgattctggcggctggctaggctagtctgaaatcagtagggctggccagaaggaatgtccaggtggaaactgtcatgcaggagctgctgcttcaatctataggatcacaatagtcacattagcagaatgaacctcgagattacccagatgtagtaaattataaaaattattttatttttaaaataaattttcaattttggaatcattttagagttacagaaaagttgcaaagatagtatagaaagtttctataccatatcaaatttctccttttttatacttaaaaaaatatacatataaaatttactatctttaccatttttaagtgtacagttcagtggtaataaatacatttctattccttttcttccccttcattcaccctgccccacacttcctggcctctgataactgccattctactctctatcttcatgaggcccactgcttttttttt

SEQ ID NO: 20060 - DNA, 1038 bp, Homo sapiens
gtcaagaagtcagagcttttcaactacagaattaacttagttaaactccttggtatattttagatttttatccctgtcaattccacagcaagatattaaaaacagtccaaaagctttgctcttctgtagaagacaaaagtttaccaaaaaataaaaaataaaaaaataaaaaaaaaggccccgtagaactcatcatctagtttttatttttgaaagatatgatatagggaatagaacatctacatgatgtcttagaataggtaaagtgttgcaaagagggcaaaaataaaggagatatttgggactggggctgtttccgtagaattgtcttctgaggagtgccagagagtcacattgacctcgggcttcagtgtggctcagtaatccgatttcaaaatgcaagagttccaaataggagaccaaagacactaggtgaggagcttatatcctagaacaatagtgggtgttgtagataagtgtatggagaggtgatgagaacagaatttaatacagtcgtaggagtctagagtactgagttataggaaggtgtctattgtaaaccttcagaaaagtggagtgcctaaagtggataaggtctgtgtctgtggtaagaataagtgggatgatatgtggacctcctaataacactgctctttcacagggcaccattgcttagtgtcctttagctctttttgcaaatgaagctttgccgtttctatacttatctctaatactctaatactatacttacctcatatgtctaatgacaacagaaggacagtgctctttttatcctccaaatgtttcacttgacccactttattccattgtaggtcttagtttctcataccttctgttcctaaagaatctttctttgtcctccattaacaataacttttagaaacctgtaacaaaaatttctctctctctctggtatgacactcctttaaggtactttctgatctacaactattgtcatttgattccttaatgttattttaactgattttatgtcctttggttcacaatatggtaaga

SEQ ID NO: 20061 - DNA, 1035 bp, Homo sapiens
ctagattcttactgtctctctgtaaaatacatatagagtatttttgattttcagcagttctataactgcttgatgagtagatgttattcccataacatctgtctcatcttgtctttggtgattctaatgacaccataccagctgggcgcagtggatcacaactataatcctagcactttgggaggccgaagcggtggatcacttgaggtcaggtgtttgagaccagcctggctaacatggcaaaaccccgtccctaataaaaatacaaaaattagctgggcatggtttcacatggctgtaatcccagctactcaggaggctgaggcacaagaattgcttgaacccgggaggcagaggttgcagtgagctgagattgcaccagtgcactctagcctgggtgaccgagcaaggctctgtctcaaaaagacaaaacaaaacgaaacaaaacaaaaaccatcctacctaaaatttgtgggggttaaataattgtaagatgttccattgttggctgaggagatcattttggaaatggacacattataggattttaacctaagacacaggctacccagaacaaatgggatttggggcagttgctcactttttcccatatccagctgatgaacaacaatgtcgatgaatcattgatagtatttctagccaaagcactgcatcaatttattcattttcctgtatgttcattttggctagatagctaagaatttctttctattctttgtaccttataacctgtgcccttcttttgataaagatgtaggacctctaaagagaaagcagaaagacagctgtcaatgtcttgttggaactttgttttccagattgctgactattcttgttccaaaacttgaaggctatacctaatagataacctttccttgcttctgagtcatcaaatcaaagagcctagaaagatctggttcacccctgagtttgtttgtcctgatttgtggttttactatggagatggatgtttactaacaaagaactcagataattgagatcgaaagacaaact

SEQ ID NO: 20062 - DNA, 1035 bp, Homo sapiens
ttttcactgtagtttactttagcatatatggtctcaagaataaaaataaggaattactaaggaacctcctgaatgcaatactattaacattcacaaaaatagctatatgcaaattagtagatgtccttagctgagacaaaattattttgaggttgtgatcatgaaaattaacgtaagctgatataattttgaattgtatgcatctgttttcatgaaagaaacctatttggagaggtttattcttgaaaaattatggaattaaaagttaaataggattcttaacatctgtttttaaatcttgaattatatgcagctcatagagtttctctcctgtatgcatattaaatgatatataatgaactatcagtggttttaggtaacatttggttactgaatacactatgctaagcatttcacgtgcattatcacctgtattcacaaaatattatgaggtaaaagcactgttacaatttccatttttttcagaagaaggtgtgatttagagaaattaagtactgtatactacctcccaactttggcagtgtcatctgaatttttttgtcatgaacatgttttacatagcttgttgttaaagtccatttttgataaattttttgaatagacgtgtgtaatgcaagtgcatgagctttgtggttaggtgtagatttcattcccatttctgtagctgactgggtacatgaccttgagtttctttgtccataagaagagtataggaacatctgtctctgatgttgtaaaaattaatagataataaaaatcttctggccatagttcaggtacataacaaggactcattaaatgtcagttgtcaccaccttaccttctttccgtaaaatatttcctttctgtctgtcccaaagttttagttttgctcttcacgtgtatcataatgtattatgagcatcctaagaagataggttatactattgtccccattttacagttgagaaaacagactgaaatgttgtagattcctggttgaatccctatagcagtctgattccagagcctgtg

SEQ ID NO: 20063 - DNA, 1048 bp, Homo sapiens
tgtttaatttttcaagaaacttccaaactattttccatactgtctgtattattttataatcctaccatcaatatatgagaaatctacctgttgagaaagaattattgaagtctccagctataactgtaggtatgtctatttcttccttcagttccgtcagggtttgcttcatatgttttgtagctctgtttttagtgcatgcgcatctcgggttgctgtgttttctttgtgtaactttttatcattatataatgtctttctcttatctggtaattttcttttctctaaagtctactttatcttgtattaaggtagccacccccactttccttcctgtaacttttacgtgatatatctttttctaacattttagtttcagtgtgtctgtatcattatatttgatatgttttaaatgaatttcctgtaaaaaacatatagttgagtcatgtgttttagtccattcttccaatatctgtcttttaattagtgtttgtagaccatttacattgaatataattatttatctgtcagggcttaagtctgccattttattttttattttctatttgatctctgctttttctttctctgtttttttgtttgtttaggctcgatttggtttttcttttttgcctgccttcctgtaggttatggaacattttctaaaattctatcttgatttgtctatagtggttttttttttttttaatttcaataggcttttggggaacaggtggtgtttggttacatgaataagttctttggtggtgatttctgagatttttggtgcacccatcacccgagcagtgtacactgtatccaatgtgtcatattttatcctttgccacccctcactctttcccctgagtcctgatagtcaaatgtatcattcttatgccttggcgtcctcttagcttagctcccacttatgagtgagaacatatgatgtttggttttccattcctgagttacttcacttagaataatactctccagctgggcacggcggctcatgcctgtaatcccggcactttaggtggctgaggtg

SEQ ID NO: 20064 - DNA, 1051 bp, Homo sapiens
gagtcattctgttggatgccttcctctgaaggaagactgtattgcatttgtgtggctttggggaagacattcagcaaagaacaccacaattcccattgagctcagaaaatgtgattaaggagtttgaatgtaattacccaaagtttggcttttcttttaaagaacccattcattttagagattccttgatactgtaaacctgacaactcaatctggttttcttttaggaagccttccaccaggaatagtgtgagtcaaggatgagtacatgaagatgaagcccatgcaatgaggacagcctaggccgtgttaggctttgacttaaatcagatttcatctacggctgagatgcagaggagagacttagtgaaatatgcagagctccattccagttcctttcttatttgtttgatgtacaggcttatttaagtgaaaggtgggacaccagtagatatacattcagacaaatcaccctgcagttattgctcaacagagtaataataatagatttggagaatgttctgtgttttcaaagacagaggttaacaagcaatggacaaaccttccgttcttctctatcccaaatcgtttgaatcgtttgactgctatacacaatccccagcacttataaaataaaaaaagtatggagagagagaaagcaagtaacccagcagagtttgtgacagaaactgttagccctcttttgtattgtttctgcatcgtcctgtcaaacatctggaaaccagcatattggcagtcgtctcacaacatgattttgcatttacatcatcgtgctagctggtagaattttttcccccaggaaaaaaaaatcggcaacttttggtctgtcacaaggtcaagtgatgattagtgatgtagtctctcctaaacacatggttagcacagaaaatttaaatcagttccccaaaatttggtaaccattaaattacttcctaagtcacttccggatgtcaggcctaaggtggagagggggacagggctatattgagttctccgcagttttctaacagagagatttagtttggcagct

SEQ ID NO: 20065 - DNA, 1094 bp, Homo sapiens
aaaataaaatccttatctgtacttaacaaagactgccaacacttttccatagaccaccaatgattcttgttttgtagctttttgtttataaaggcaatgttgtattccacagcatcattacacactgcttctgtgactcagacagctggcaggtccaagatagagcatatggatgatgctctaatgacatctgtccagttgttgtaatcacatatttggtggacagctaaaagacccactttcaccttaactgagtttatgtgactaattttaaatttactgtaaacacttttttatacgtctcatgcttattaatacttaataataattccacaagtatttctctcaattctaaatcccagagcaccatagaaactggcaaaatatcttcccaattaattatgagaaattcatctgtacaattttcttattaattctcgtatccaaaagaaccacaatacaacccaagaccccaatcattagaataaccacaaaaccgattcttaattacctcttgcctgggacactgcagaagtaaccaaatcggtcccacaaacataagcctctctaaccctgccacctcccccagtttatgttacgtaatatggtgagaatcttcttcctcaaatactttttatcctgtcatccctgttctcaagaatcttcagttgtatcccattttacaccaggaagttcaaatgtttgaatggagatttaaaaagtctagctatgcttcttgtacatcccctctaggagcacacccactctaatcaaactgacctttttagtttagctgggctccaaccagttctgttctagctcctgaagtcagcgtcaagaaatattggtcttggccaggagcggtgcctcacacctgtaatcccagcactttgggaggccaaggcgggctgatcacttgaggtcgggagttcgagacaagcctggccaacatgcaaaaccccgtctctgctaaagatataaaaattagcctggcctggtggcgggcacccgtaattccagctacttgggaggctgaggtgggagaatcacttgaacctgggaggcggaggttgcagtgagccgagattgcgcca

SEQ ID NO: 20066 - DNA, 1030 bp, Homo sapiens
tgaggcaggaaaatcacttgaacccggaaggcagagattgcagagccaagattgcaccagtgcattccagcctgggtgacagagcaagactccatctcaaaaagaaaaacaaaacaaaatgctaaaaactgaattatcagtagaacagcccatgtactctgtggacggtgatgggtttttgttttgtgggagttgttgttttggttgattcggtgtttcctttgagtccactgaggagccactgttttcttccatatctttagatcctgatatggtaggacatgcacaatctattttgaatcatcataaagattgaattttcagcctacaaaaacaaaagaaaattcttagggcatcagttctcatctttcagatagaacctaggacctgtgaggctggtaatctttggaatagcactgtatggtaaaactttctgtgataatggaaatgtggcgtatctgtgctgtccaatataatagtcacatgtggctgctgagtgctgggaatgtggctgttataaccaaggaactgaaattttaaatttcatttaattttaattgatttaaatttaaatagttgatgtggctattggctatcattttgaatagcacagctttagaaatcttagctttgacaaaaaccacaaacttaagtttatccccagcaaacatcttaggtgccagagacggcagatttggattgaataaattatccatgttgagtatctacgtgggaactcctagttatacagtgcagattcagagattactgttgtaccttggctatgtgacttacacacagaccaaattactctgctgggggtaaattcatactccagtgttacttcaacatttctgaacatctttttgtaagcaattttgcattttttactgacttgattgttgtagtaattacaaaataaattatccatttagggggcagtgttgaagcattgaggaataaaaggataaatgtggtatatttgattgttttcagtgtttaagaactcttattggaataagagacttac

SEQ ID NO: 20067 - DNA, 1373 bp, Homo sapiens
ctccaactcctgggctcaagcgatcctcccaccttggccttccaaagtgctgggattacaggcaggagctaccacgcccagccgagcacttccttaaagaatctatttattttgtgaaataggtaaatatttattgaatgcttattgtgtttttagcagtgtgggaggtgagaaaacttttcctttcctaattcaaggagccttagttaggaaagatgaggcataagtgcatttcaattacttaaaagatgaagaaataccacaaggcactatatgagtaattgcaaaattaatggcacagagagtaaatgcttatcgtaatattagaattgtaacactgataaagtccttatctagtcccacttccttaaaagaagataaaactcagaaagattagcaatacaggcttaaaattatacagcaagatattgccaggtctagaattcaaattcacatcttttgactaccagtctctcacctgaactaactctctccttgaactgtagatacttagatttttgagagggaaataaaatctcactatagatagttttaagcttctgacacaatctagcagatgtctgtgaaactgtgtgctataccctggacattaggcactaggtactagaaaagatggtcccctgactcaagtagtttacagtgtaatagggtagacctctaaaaaactggactacaaggtaaacttaaggaaatgacacagaagagctttacgtacatatgctgtgggagcccagacattggaggagaaaccctgtttatcaggactggggcttcttgtaggggatacctttgaacagatggcattgtttggaaggacatttcatacaaaggaaagggctgtgacttgcattttgtttgttagtgctttgatgattcgtagctattttctttttctagtctcatttttgttccccatgcctacttttcatcgtcttagccacctgtacacatgcctcagtgctaaaacctacatttcgatatttgctgtaactataggtttacttctctcctctttggtatcatacggcgctgcctgcctcctgatggtagacatcattttatttctccattggcttttatcactcattggaaacaaaggaaatttatgcccactgacaaaattaagcattggcttatttcatttgctgggtcaggtttgacttttcttttttcccatctgtctccttctgtatgtttttgatttctctaactctagactttttttctacccttccacaatttcccctctgttaactcccacactctggaagatctttttgatgactctttgatccaactctgtatttatatctatcatgcggacctctctcgttccttgagccttttctatt

SEQ ID NO: 20068 - DNA, 1079 bp, Homo sapiens
gcaagatctgagtcagcgatcaaggtcagtctcagttcattaacttcttctgaaggcttatagtcattgcaaatataactgcttataccttatgttatcattatatagtacggttttggaatgacttatgttcacctcaaatgtgtcctagagtaacagaaggatgctgaaatgtctagagtagtataaactgatttctgaccattttgcctagtttcctaatgcccacaaatggaaaagtctcacctctcaaggtataagtgtggataaatactctcacatgtgctgagatcagacaggggcctgcttttaaatgaatcatccaaaaatcattatttattttgaggagcaatatacaaggattctcactgtacttccagccaatacattatttaacattagaatatatttcatattattaaggtctcaccattaagaaagatgttttctcaacagttctaatacctatgtcattcttatgttcagacaataccaaaactctttttaactgtaaattgctacccttaagcccacttttaaatgatgtttaatatattccacttgaaacaaaatggcaaatcatattaagcttaacagtttttgagaagtctggaatgaaggtaacattttatgtgcccagtcctttacatagaagtagaataacttggtttgagatttttgtatgtggataacctagctgtgcaatgagataggattctttttccttttctttccttgttatttaaaaaaaattgagatggggttttgctatgttgaccaggctggtctcaaactcctggccttatgcaatcctcccatcttggcctcccaaagtgctaggattacatgtgtgagcccggccgagatagaattgtttcatttaaggattcctcagtgtactttagaagcactccacaccaacctttataaataaacagaaagtcagaaaaattgttatactttttcatttgttaaacatattttaaagaccatttgattttcagacagtggtggtggtgataagataatgtattgaggttgtttttaagccaagaatatctgtggatatgggaccattt

SEQ ID NO: 20069 - DNA, 1120 bp, Homo sapiens
gtgctatggcgtgatctcagctcactgcaccgactcccgggttcaagcgattctcctgcctcagcctcccaagtagctgggattataggcatgtgccaccacacctggctaattttgtatttttagtacagatggggtttcactgtgttggtcaggctggtctcgaactcctgacctcaagtgatccacccacctcagcctcccaaagtgcttggattaccggtgtgagccaccgtgcctggactacaaaaaaactttattaagtagctgggtgtgatggcatatgcctgtggtcccagctactcaaaagactgaggcaggatgattgcttgagcccaggagtttgaggttacaatgagctatgcatcaccactgtactccagcctgggtgacagagcaagacactgtcaaaataataataataataaatcagcctggggaacataaggagactctgtctctacaaaaaaataatttaaaaaaaaattacacatctactcagaaggctgatgtgggaggactgcttgagcccgggaggttgagactacagtgagctctgattgcaccactgcactccaacctgggtgccagagtgagaccctgtttccaaaacaaaagccataaagtaatactttaatatgaataaagacaaattagaaagtgagcaagtaggagataaattcactcaggtgataggacaataataaaacaattaaaaaatttaagatcctcaaaaggacaaagtaataactttacaaaacaagaaattatatagcaaaagcttgtagaaacgacgcaagataagaacaagtggatatgaaaaataatgacttaaggccaggcgcggtggctcacgcctgtaatcccagtgctttgggagtccgaggcgggcggatcacgaggtcaggagattgagaccatgctggctaacatggtgaaaccccgtctgtactaaaaatacaaaaaattagacaggtgtggtgacgggcgcctatagtcccagctacttgggagactgaggcaggagaatggcgtgaacctgggaggcagagcttgctgtgagccgagatcgcaccattgcactccagcctgggcaacagagtgagactccgtctcaaaa

SEQ ID NO: 20070 - DNA, 1026 bp, Homo sapiens
gggttttggcagcctgtcctcgggttgttcagcctggtgaccctagccgcctgtgatttactaactgttttacaaatgtttcctcgctctgggaggtttgatacactcttcatcctcctcagctcaccagagtcactcagtctctgagccaaacctgcctttgtttacaacttttccggaaattttcacagagggagagaaactctccctcctctttcagtgttttatttttaagtcaacacttttctcaagtttatttgtgctaaaccaaattctcctacaaggtattgctctgtattcaaatgggaattgctgcatttctataaatagaatgaaggtcatgtgaacgagttcagaagattctagatatcacattttacgggacctttacatttagttcactattttttgaaaataatattctatgtttggatttgtctttttttcccacattcatatttgactgcgcattatgtgaaaaattgaatttgggaaacattgagtggaatattttttaagctgaaatacccatgttaaaaataacaaaatgtgttgttgcttcatcattgtaactttcttaaaaacagaatttatagcccctttattaaatatttctagaatataattgcctctgaaaacacagtaccagggtttttttgttttcgtttttctttaaatctcattcccattaattgctcagtctttaccttggcggagaatgaaaaactgccttggaacttattaataagcatttagaaaaactcgacaaaaaattaaagaattggcctggcatggtggctcatgtctgtaatccaagcactttaggaggctgaggcacgcagatcagttgaggccaggagttcgagaccagcctgggcaacagggcaaaacaccttctcaacaaaaaatatagaaattagcctggcgtggcggcacatacctgtagtcccagctactcaggaggctgaagtggaaggatcacctgagcccagagaggttgaggctgcagtgagccatgattgtgcc

SEQ ID NO: 20071 - DNA, 1049 bp, Homo sapiens
gagtagctctttgaaagctgatttaaagtgagtgttgctccacctaagagctgttggctgaaaaaagcactgtctacaacagcagaggtggccgagaaaggcagacaggctctcctgaggctggtgttgcagatttgcattggtctagtaggaattatgcatcattagactgaacttcttatgtttgcatccaggtcatttctccataaaaaaaaaaaaaaaatgccactgacattacagccaaggaaccatcattgtacttacaccagtctgttcccacacatgaagtgttatgcttcaaataaccgctcaacagctcatctgaaggtccagagtatgtttactgggtaaaatatttcaggcatagacttggagagcaagctgcccaccagggcagggccttagcataaagttaatatcgtcaaagatctgactataatccatttcattcactgttgcagtttgctgtgtgggtgtttctacaatgtgggaaacttgtttcattgaagagtctgaatattttgtaaggatgtgaagagttgcaaataatcttttctgtaaggctatgaggagaaacaaagcagctaatgttagaaagaactggtacacgattgttttctgtcatttgtaaaacaaaataggaatattctggtctttacagatttatatcctcaacttgttgctccttaaggattatacaaaaagcatacctatgaaaagatctgttctactggaaggatatcctattttgaagctcaaatagttttatttttatttacgtatttattttcagaaatagcgtctccgtctgtcacccaggctggagtgcagcagtgtaatcatagctcactgcagcctcgaactcctgggctgaagtgatcctccatcctcagcctcccaaagcactgagataactagtgagggccaccacgcccagccttgaagctcaaataattttaaaatataagatgatatatgtaataaagcataattctttgtctatagaaaatgtgtctgtatgttcaaaaggctacctaaattttgttata

SEQ ID NO: 20072 - DNA, 1051 bp, Homo sapiens
cctcacagcagccatatgagattgctgttactgtatcacatttacgtattagggaactgagcttcagagagaaccacatttgttctgactgctgtcagtttgcctgcctatatcctataatatccctttcctttttaatttgttgcttctagtcctgaggaccagaaatccagataaataaaatatgctctggtgggccttcctgatgggaccctcgagggaggagaggatggagactgggagaggagttccaggttggggtgtatgaggtggttaactgtgtgcaacgcccctttcccataggttatggttactccatagttaagctgatgttacgcggttagccagaatgaactgattttggctagagccttttcttgtctaggaatggaggaattacctgaatgagttcccacagactgtcctagaggggccacagactgctctgagaagctagtgcaatttatgagtcctcttctgaaaaaaatgcagatactcatacatatacaatgtcgcatgtgctttcaggggtttcaggacccctctgaaatccatccctggatcccagattaaggtaattcatttggcctctgtgggtggatgttaatcactaatgctgttataacctaaacatgtccctaagaccagaaattataattaagaacagaggaactctagggactgtaagaagtttgaaacagaaaagggctttctttagcttttgggaggaatttgtgtttgcccatgaatgaagtgaaatgaccaggtagacagtagaaccaggcctgtgtgctggggagaccttctgtgccctaaggccacatggccgagagacaggtgggaagccaaggaagaataaattgggcataggtcctgttaatttacaccagcccatcaggttggagcacactcgggaaagttcttgctactccgaaggtgatttttagaatcagaaacctgtacttgagaaacataactttttgtgttatttatattttctgtaatgattttctgttgctctctgcttgattttatgtaaaatttgtactaa

SEQ ID NO: 20073 - DNA, 1023 bp, Homo sapiens
ctctaaagattattgcctccttcactgccttcatgaattaacaccaatttcttccaaatggaattctttaaaaaaaaacaaaaaaacccaaaaaactttattgagatatgattgacatacaaaaagctatacactttttttttttttgagacggagtcttgctctgtcaccatgtcaccaggttggagtgcaatggtgcgatctcggctcactgcaacctctgcctcttgggttcaagcaattctcctgcctcagcctcccaagtagctgggactacaggcgcgcaccaccacacccatctaatttttgtatttttagtagagatggggtttcaccatgttggccaagatggcctccatctcctgacctcgtgatccgcccgccacggcctcccaaagtgctgggattacaggcatgagccactgcgccctactgctatacacatttaatgtctacactgtgatgagtatggagatacgtatatacctatccatcacctccaaaagttacctgctgctctggcagaatctctttcttatttaaagctgagtaatattccattgtgtctatatactatattttctttatccattcattcatggatggacatttagtttgcttctacatcttgactattgtgcataatgctacagtgaacgttccatacagtgaagtggagatacctcttcgagatccacatttcagttccttttgatatatacacccagcagtgggactgctgggtcatatggtggttttatttttaattttttgaggaatgtcataagtgtgtctcaagaaaatataaagacagtataagaagacttagaattgagtacagtttgattgaatcaagggtaatcaccattatcctgattttcaggactttcattcacttccttcatgtagcacagttccctgccagaaatatccatcatggacgaagtgactgctagagacttcagggaaaataataacttataactattttatgtagttgagggatgagtgttttggttcttt

SEQ ID NO: 20074 - DNA, 1044 bp, Homo sapiens
agatgagatttgggtggagacacagccaaacgatatcagtaagtatttatttttatttattttttagagacagggtcttgttatgttgccaaggctggattcaactcctgggctcaagtgatcctctcacctcagccccccgagaagctggtactacaggcatgtactaccacactcggcttaattttaggaagtatttaagcaaatattattgagctgtataaaactgttcattttaaaaagtgaaaagttgtttccaaacaatgtgtcaattagtttttctctttggtagaaaaattgtatatgttcaaatcaaagttgtagaagtacctccctgcctaacattcaagtggtttcagatggtaggctttaacataacaagatgagctattgggctctcagaaaaagcagttcctaagggagcacctacatttagtacttctttttcatgttaatgaagttctgtctcattgaaagaaaaaaaaagagattgttgttgagtggaggtacctactgcctagtgcaaggtcaggaaggctgtggagctgatgggcagctcttcagaatccaggggtccattattggtgcactcagcgtgaggctgaagctggaaggtcacctcccctaacgtgaataaaactgaagctgtgagagctcaggtgatccacccagggttccacagtgattgggagggctgagactttagaattctgccttctaacacccagatttggcctacctcacacactgacaggaattctcttctatcctgggagagtcttacaactatcacgacctcataactgatctaagatggctttctggagatggtcaagtcaggaatagcttttaaataggttgctatggccgggtacagtggctcacgcttgtaatcccagcactttgggaggctgaggcaggcagatggcttgagtccaggagttcaagaccagcctgggcaacatgacgaaaccccatctctacaaaaaatacaaaaattagccagtcatggtggcatgtgcctgtagtcccagctattgagga

SEQ ID NO: 20075 - DNA, 1055 bp, Homo sapiens
gcccaggagacttaatatttaaaggctgtcaattatccccaagttaatctagaaattaaatgaaattcagatgaacatcctaagaagttttgaattactcaaagtcttagcaggaaaccaatggcacacacagaagtgttcaccgaggggagtcaatgaaggacctgtttacaaaggtgtggacaaagcttaaggaaaccaagaaaccaacaggggaaggtgaggcaccctaagctagcaaaagcaaagaagcactgttagcacccctgggcctgaagctgcaagcagatggaaccgttatcagaacccagacagtgctctagctttagctgtagagaggcccacctggcaggccttcggtagaggaacagctgctactaacctggacataggggtgagagagccaaggagagaaataccttgacctgttcctccttttgcccttcattctctttccattgactctcattagctgaatataagaaggagagacccagtcgatgctgcccatgcagaggtcagcctcatgggacacagaacaaggtgaagagtggaaagtgtttctgaaggagcaatcagagaatatccagtgcaggtgtttttcatagtatttttcaaggtgatcttgaacttcatgtggaagatcggaggattaaaaccagcaaggaaagtttttgaagcaacagacctattatgacttttatttaaaatctcaatttctttcctgccagatattaacatgtattataaagctgtaataattaaagcagaatggtattgtttcagagaaagacagacagtggaacataatgtacatatatgtagaaacttgatatattacaaaccagtgctgaaagatggactgttcagtaaattgtgctgcgacaaatgattatccacataggaaaaacttaggatttcattttagggtagcaaaaataaaaaattctgaccatgcatgttggcaagggttggatactcatacactgttggtagaagtataaatcgacataatcctatcagcgggtaatttacaatgtctagtaaagttatgt

SEQ ID NO: 20076 - DNA, 1030 bp, Homo sapiens
ggagccgcgaggccgggcggcgccggcgcgggacgcggggtgcgtcccaggccggggctggactccccctgccggccgctcccgcagctccgcgcaacgggcctgggcacccacccgggccgggaggagagcagccgagcggcctggactcctggcttctgactccctttccgggaaaccacactggaaacccatctcctttcaatgcttctgggtgggtgggctgggaggatgggtgttccttgtccaacctctcccttcggaggaggggtttggctgtgtcccacccccgtactccccgccaaatatcgctgagcctagaattctttcccctctctctgcctcctgaacctcaaagacaaacatttcctccgcgtcagggctgttggctagagtggcaaaatctggactaaaaggtcttactttaactcatctatctaaatccctcttgggagagtggagagtggggtcagtgggctatttccattcctgcctcagtttcccctgtataataatgggcttggctggggtctctccggggtccagctgtgtcagtctccattaggctggtccttccccgagacccactcctgcaaggacagctgcctcccaccccgcgccggtgagctccccctccttgcccagctagcaggtgtctccagcccccacttctagcagtgggagctgggcgggcactcctttagccctgggtctggtcggtcaccgagcacgccacctccttcccagttctctcctctttaagccttggggaccctgaacgccctgccccaacaggctgcccaccttgggcactgcacagggtggggcttggggagggtgctggcttccaaaacaccagggacgttgagatggaggaacggtgatggtgaaggtggaatggacagttgggcccccagactcccaggacgcctttgtgggccgatacatttgcaaggagcgagagagagagaaccaggcccgcctcttcaggatggtgctgcccccaggccacgccgaatgcggctggagc

SEQ ID NO: 20077 - DNA, 1146 bp, Homo sapiens
ttcccagaaaaccaccctgcctccttttaaagtgctgagttaaaatatcccttgaagaagtagattcctgtagacagccatatcattcccagtaccccttgcagcaactgccatagagaggattgcttgggaggtggggtcggccgcactctcagacaagatcctttaccagctctccgtggttgaaagggtctctggtcattgactccaagtgtcatactaaatcatcaatccaaacaaggtttgatttttggcaagggtgccaagatcattcagtgtgggaaggatagtcttttcaacaaatggtgtgggaaaaactggatgtccacatgcaaaagaatgaagttgaacccttaccttacatgatatacaaaattaacccccaaatgcatcaaagacctaaacttaagagcgaaagctataaaactcttagaagaaatcacagcggggaatcttcatgaccttgaatttggcaatggtttaaaaaatgtgactctaaaagcatagatgacaaaagaaaaaacagataaattgaacttcacaaaattaaattacttttgtgcacccaaacacactatcaagaaagtagaaatgcaactcacagaacggaaaaaaggatttctaaataatatatctgacaagaatttaatatcaaaatatataatttctacaacttaacaacaaaaagaaaaataactcaattacaaaatgggcaaaggacctcgaatagacactttttccaaagaggatatacaagtgaccagtaagaacatgaaaagatgctcaacatcattagtcattaaggaactgcaaatcaaaaccacgagatatcactccacacttaccaggatgcctagaatttaaagagagagtgagccaggaatggcagcgcacaactgtcatccaatctacttgggaggctgaggagggaaaatcacttaagcccaggatttataatctagcctgggcaaaatagtgagaccaccatctgtactagaaagaagaaagaaagagaaagagagagagagagagggagggagggaagaaggatggagggaagagggaaagggagggaagagaagggaaggaggaaagaaagaaagtccaaacaaattggcaaggatgtgaaggaaaaaaaaatttttt

SEQ ID NO: 20078 - DNA, 1029 bp, Homo sapiens
ttcttccttctctcttcttcttcttctttccagtgctggctgatatcctttcatttcaacctgaagaactttctttagtacttcttgtaagtagtaatgaactccctcagctggaaaagtatctctccttcctttcttaaaaatagatttcctatgtagaatattcttggttagcagttgtttttgttgtttcagcactttgaatgtgctagaacatcaactcataatgcaaatgttgttttgtttcatgttgtcccataagttacacaggcctttttcatcctttcttcttattgttgctctgattggataatttcaaatgatctgtctttgagtccactgcttctttcttctgcttgagtcccctgttgaagctctctattgaatttttcagttcattcatcatattctacagctccagaatttctgtttagttcttttttatgatttctatcttttggttgaatttctcattttgttcttgtattgttctcctgattttgtttagttgtctgtgttctcctgtacctcagtgagcttaagtcacttattttgaattatttatcaggcaattcataggtctcaatttctttgggatcagccacaggagctttattttgttcctttggtggtgtcatgttttcttaattcttcttgttccttgaagtgttgcatttctgtctttgaaaaagcagtctcctcttccagtctctactaactggctttggaagagaaagacattcaccagacaatcaagagtttgacgtctttcaggccttttctatggattcacctgccccactctcttgttcccccttgtgggggtaaggcttaggattgtgtgcctactctcaatcctgtaaagtcaggccaggtgtggagggcctcctcttaattttctccaggaaagtgccttgaagtgttcaagattgtgcaccttctctcaaccctgcaaagttgagatagctgctgatatctatgtgctgtctgtggggatttgcatgtgtcctctgtggtggcttgcactca

SEQ ID NO: 20079 - DNA, 1028 bp, Homo sapiens
gccaccacacctggctactttttgtatttttagtagagatggggtttaaccattttggccaggctggtctcaaactcctgacctcatgtgatccacctgcctcagcctcccaaagtgctggtattacaagcatgagccaccgcacccggccaggagcagggaactttcttacggcagaagcgggctgtcctcgggccccttcaggctgaaggcagtggatcgaggccacagctgtgagcaggcagctaatgtccttcagttctaactgaagcaagagtagaggagcttagatctcagacttggtgtgtcagttgaggaagtccactggctttttgggatatgctacagggaaagagaaccccgtctttaaggagacctgattgaccgtcattccctgctgctccacaggatgcagaaggctatcaacaggctgagcaggcttctgaaacctggcgggatgatgcttctgcgagattacggccgctatgacatggctcagcttcggtttaaaaaaggtattttgaaagtgctgaatcctaaccactagagatcatgtcctttgcagggacatggatgaagctggaaatcatcattctcagcaaactaacacaagaacagaaaaccaaacaccactttttctcactcataagtgggagttgaacaatgagaacacatggacacggggcggggggcatcacacactggggtctgtctgggggtgagggggctgggagagggatagcattagcagaaatacctaatgtagatgacgggttgatgggtgcagcaaacctccatggcacatgtatacatatgtaataaacctgcacgttctgcacatgtaccccagaacttaaagtataattaaaaaaaaaaaaaggtatttggccactataatcaaaaaatggtgctgccatcagaatagaaactctagaattagaactccttatataaagccatttaatatgtgacagagtagtatattttttaagaaaactgaagaggcttgtataatctagatattgagg

SEQ ID NO: 20080 - DNA, 1049 bp, Homo sapiens
cttactctgttgcccagactaaagtgcagtggtgcagtcatagctcactgctgtctcaaactcctggacttaagtgatcctcacaactcagccttctaagaagtgaagactacagtcatgcactaccatacccagattttttttttttttttttttttttttggtagagaccgggtctcactacattgctcaagctgtcttgaagtcctggcctcaagtggtcctcccgccttagactcccaaactgttgggattacaggcatgagccaccacatgcagctcaagacaccagttgtttttttcttcttcttttattctatttttttgtttttatttttgagacaccattttaaaaatgcttttaatacactgttttcaaatttttttgagacatattcttgctatgtcacccagaatgttgggtggaatgttgactcctgcatcttattgttataccaattccaggctggagcgcagtggtgcgatcaaggctgactgcaacctccgtctcttgggctcaattgatcttcctacctcagcctccttagtagctgggactgcaggtgcatgccatcatgcctggctaattatttattttttttgtagagatggggttttgccatgttgctcaggctggtctcaaactcctgggctcaagtgatcctcctgcctcggcctcccgaagtgctgggattacaggtgtgagcctccgcacccagtcaatacactttaatccaagtcagtgtctatttaaattttaagttagtttaactctgagccatgggcctgtaccttggaaatatgtaatttagagtcataagtaacagttatctagctgagagtcatatgtgggttataccaaatgtactgccatcatgtgattataggttagtagtgtaatttttggaattggcaggtcacagatgagattgccatggcttggtggaaagctctcccaactgtcttctccagacagataggtagaacctggaaccagtgctaggacgtgtgtgtatgtaggaggtagtcattggttatatgaacttaaa

SEQ ID NO: 20081 - DNA, 2064 bp, Homo sapiens
taattgtggctcactacagcctcaactgcttgggctcaagccatcctcccacctcagcctccccaaatagctgggactacaggtgtgtgccaccacgcccggctgattttttgtttgtttgtttgtttgtttgttgagcaaagtcttcctttgccactgaggctggagtgcagtggcatggatgtcagttcagtgcaacctctgcttcccagattcaagcaattctcctgcctcagccttctgagtagctaggattacaggctcacaccactgtgcctggctaatttttgtatctttagtagagacagagtttcaccatgttggccaggctggtcttgaactcctgacctcaagtgatctgcccgccttggcctcccagaatgctgggattacagtcatgagccaccacaccatgtcctaatttcttttgtagagacagggttttgctatgttggccagggtggtctggaactcctgagctcaagctatcagctcgctttggcttcccaaagtactgcgattataggcgtgagccactgcacccggctgagaaagttccctattttgagtttgttgattgttttttttttttttttacataatgaaaagggttttttatttcagagaaattttgttttactgtttctttgattatttcatttcctctgttcttttctctagaaagccattagatagtttcagggtctctgtgctattcatgtttcttttcttttgtgctccatttaaccttttgttttatcttctgggagattttcttattttctttttctttctttttttttttttttgagactgagtctcaccatgtcacccaggctggagtgcggtggcgtgatcttggctcactgcaacctctgccacccaggttcaagcgattcttctgcctcagcctcccgagtaattgggactataggcacataccaccacacccagctaatttttaaaaatatttttagtagagacggggtttcaccatgttggccaggctggtctcgaactcctgacctcaggtgatccacctgtctcggcctcccaaagtgctgggattacaggcatgagacaccgcacccggcctcttctgggagattttcttgacattgtcttttaggttactggctgtgtattcagctgtgtccattttgatatttaacccacctattaaatttttaaactttgataatcttattttgtcaatttgattattcatgttctttacttttttaatttttgtagctacagtatacttttgatcctctctgaacctattttatttttttcatcttaagaacctttaatacagttatctaaatgcagagtttcagtttatgaaatgaaccaaagcagtttgtcatttcatactataaactattgaaaatcaagtgctaaactgatactttacttttaaagttgtttattgaattatcttttaactcttatgattaggtattgttttttcgtcttggatttttccttttgtgctgttggggttgtcttgaaaatgtatttagcttagtggaatgagggattagagtgattaggtgttggcatggattttttttttttttctttttggtaacatagtctctttgttttccagtttggcatttctagattttaacacaggaccaggcacagagggtcacatttaatgttgaatgaatgatcagttacagcatttttttctctaacggatctgagcattgtcacatgagatccctatattgtgtagtaccttttaccttttgaaaacattgttttcattttcatgaggattttctgcttcccaactgaggaatttcctaactgccaacgtcctcagttaacttttgcatttttacttatcaatgagctatttatatgtgtatttttacagaaagctttaatttggaaacatctaacacccttagtttgctggaagacaacttagagtcagaaataagcatatttaaacccatataccatatatcaagaaatctgtaaagggcctttggatccctcttctatgggatctggcaacacagagccattcctacaactcccaaa

SEQ ID NO: 20082 - DNA, 1002 bp, Homo sapiens
actgggttttccatatacattaaatgatctttgcttcgtagattctttactatgaatttggtaatcacacttacccaaatgtagttacactctgtctttgataatatggttctgtacaaaaactaacaggaagaaattatgctgatggggagaggagaaacatttggagacagaagctgtttctcatgggttactttaaaaatgatgctatattatacaaaagaaaaaatgataaaaatttttaatgaagctacaaggtctcaaaaattgagtatcgtgtgatatcttctgtttgtgccttttagtattttaggaacacataacaggtttttctttttcataatttaagtgagtttttatgaggtaacattatttgctagaagagctgagatcttttttttaacacaaaaggaataaattcaggacttgcaagtcaaattcgtccttgggttagtggttctttccttctctgttattgcaggaggctttaagtttttagtccacactgtaggcttctgaccacagctaaattagctgtatatttacattctggcattcttgaaccaggacgttgtttgtttgttctgtcttttgtgggcatgggcgtgcctggcttctctggtgaggaacatttatgcaaatttatctttcttaaatgcgactagaaaaagaacaaagcaaacataaaattcagtaatttttttgtatgtgcttaatcactctttgtattttaaacattcattgtagtttattttttttttattttttatttttttttttgagatgaagtcttactctgtcacctaggctggagtgcagtggcgtgatcttggctcactgcagtcttcgcctttgagttcaagcgattctcccgcctcagcctcccgagtagctggaattacaggctcccgcaaccatgtgtggctaatttttttatatttagtagagatggggtttgaccacgcaggccaggctggtcttgaactcctgacctcaagtcat

SEQ ID NO: 20083 - DNA, 1079 bp, Homo sapiens
taatttgtaaactagttaatcacagaaaaatgtgacatcttattaggaaatactctaatggtaatggtgttagattaactgcagttgtaaaatatgttttatactaattcattttgtatactattccctaaggagttcttactagttggaagacttcgttgtgctttctccaaatgtatttttcttttaaaaacttaatctaggtgtcactgtatcagtgggcggggttgacgtgtagagtagtaatggctcccttagactagaataaaggataggtctaaaaagaaaatcttgtttactttctttagcatcctacaaacttggtatctttttacgtaaaactgagaagctttcatccaaagaaaaataaaatagaacttggaactttttacaacttttaaaatacgatttacttttaatgggttcagatcagagaattgtttccttagctgttaaaaaggaatcagaaaattgttccttctgagtcagaaaataaggtcacaatagaaatttgatatgttccttcctgtccactctgaaaatagtaataactagtgtcttaaagcacagactcattcccagaaaacatctatcaccaattatttggcccttccaatctgaagttaaaatcaaatctctacttgacttaaaggggcttattttttctgaaattggatacacaagtgacaaattgtgtgtgttccatagctgtggtaaaacttttgactttctttctttgtacaacgtcttttatatctctaggcaacaggaaaggataaattcacagagggaagagatagaaagacaacggaaaatgttagcaaagcggaaacctcctgccatgggtcaggcccctcctgcaaccaatgagcagaaacagcggaaaagcaagaccaatggagctgaaaatgaaacgtatgttctttattgacgtgaacgctgagacaccacaccctgcccccaaatacaaatgttgattgtcaccggcaatagttttaaattcttgaggtcactcaggtttaaaccttcttttcagttacattaatggatttgctcaactcatataaatgccatataaa

SEQ ID NO: 20084 - DNA, 1029 bp, Homo sapiens
gaattgctttgttccactgatgtcaggttttgcctatatctccccaagcttctgaacgttggagttcatggctcatttgctttagaggctatgcagacttaatttgctattaggttccccactgggcttagttttgtttccttgttgttggtacaagtattgaatcagacaagtcctgcccttgaaaggaggggacaggcttttttgacaaagcaaacacctcctttctataaaggcagtcttggttttttttggtgttttgtttgtttgtttgtttgttttataaataataatttggaaggggaaaaacagtggtctttgaagtagccctttagttggcttctagcctggtccaaggcaactcttgctctatacctcttgttcatcagggacccagaagttcttcctgttccagacagatgggcagtggtgctcagcactggagaagggaaggttcctgctacattaagagcaacagggcttagcagagggagaagggatgacctgtggcaccctgcgtgtgtttcttaggtgacaggcagctgcagtccagatgctcctgaggagcagttacattattataagaacattccagtcacttgatatgtagggatgagtggcacaccgtagtgagtgccaggagcacttcagagaaggaaagcacatgttgttctgaccagttataagtgagcaatgccactactgtattgagaccctaagaatgcctaagggtgttggaccagtacatgcttctctttaaaaatgccctgtagggcatttttatacatatacagatgtatatgtataaaatatacgtatacatctgtatatgtataaaatatacgtatacatctgtatatgtataaaatatacgtatacatctgtatatgtataaaatatacgtatacatctgtatatgtataaaatatacgtatacatctgtatatgtataaaatatacgtatacatctgtatatgtataaaatatacgtatacatctatacatatacatatttttatacatatacgt

SEQ ID NO: 20085 - DNA, 1034 bp, Homo sapiens
gtgctatgatcatacctatgaatagccactgcactccagcctcagcaacacagtgagaccctgtctcaaaaaaagaaaaagagaagggtggttgtgaggtttaagaggactggtagcacctaacccttggcagattctctagctagctgctctcactacccatgccacagctgccacccagagtcgatactgagggacttgaatacattgtctggtagatgtttaattctcctaatctgtcaggtttttcaagactatttctttatataacttttgtcaaattttcatgtttattcaataaataggtgaacaaatgtctccaaaactttagagtctgttagatgaacttgttgtgaagaatacagaagtatctccaaatgtttctgtgcattatctcctgtgtccctgtttctcctaatcctaccctcttctcttcctgtcctcccacaacaaatatttactgaatgcctgtgaaacactaagacactattccgggtagtggagatggaatcgaatatgtagcagtgaactctgcagaacagttccctacccttaaggagtttatattccacttatgagaaaaacaataaaacaaaaagtggatacatttcagatggtgacacatgttatgaagaaataaatcagagtagggggatgaggaggtggaaacctctttttttgatggcatggttagggaaggcctcaaagatgaagtgacagtttgagcagtatcttgaatggtatgaaggtgggagccatgatttgcaggagccgttagatctgcaggggaaagtattttagcagagagaagctcagatgtgagaatgagctttttgcaggtccacagagcaaatgggaaggtggtaagagaggcaggagggtgagggtaagtgtgagggaaggcagttgcaggttttaatcagggcaactatgtgagttgattgctgttttaagagctgacactggcagctacagagaaaattcaaggtaaatgaagtttacttggctgagtgccatggatcacacctgtaatc

SEQ ID NO: 20086 - DNA, 1007 bp, Homo sapiens
agaatgtcagtgctgcctattccctaagccctctctgctcctgtcatgctcatagattaggaagccataagcctgtcctgcccctagaaactgcatcttcctgctccggagtgtcctaattgggtaagtgagaatgggaccctctgccttggcttccttaaggttgctgtaaggcataaaggggttgtgggataaaacagagggtgaggctggtggccacttccatgtcacagtggccccaggagagatgtccagaggacatagatgtcccccagtgggggtcttggcttgtcatagtgtcagacgtgagccctttagcctggctcacatgccctaagagcagggcttgcctctgggcagcacatccaggaaggccttgctcctttgcatctgcaaccctctcaaccctccccacaaccttcacaccaatacccctcctccggcattctctgccacgtcagctggacaaaagtgcccagctttggcatcgtagaacaaggtcatagtacagccctgagtgaggactgcgctcacgccacaactccacaacttgctgtgtgaccttgagccaagcactcccactctgagctacaactgctgcatctatgaacttcatgcatccactcagacacacctgttgggccgttctgttaatgcactgggccaggatttgtgggtgataaaaaggcccctcagcttggctcctgccttaaggaagcttacagctgagaagctgagtgggagctgggaggtggggagttgcgtaagagcgagatgagaccctggggatggagagagggcacggagctgggccttgagagaggagcagagttcactaggctgaggaggggaacatagcagcaaagggtcttagaagcttcacaaacaatgtgtgtcactgcagggcccctatgatctcacacatcctggcctctgccagtgccgttccatcgctttggccgcctgagcatcttggagaactcagcttaggcgtcacctccagcctt

SEQ ID NO: 20087 - DNA, 1045 bp, Homo sapiens
taaaactcgtctccgcttttctgaaagcgggggaggagaggggaggaggagcgcgcctagaggtgggggaggacctgagtggaaccagatgtggcgggcggcgggggaggggagcccgggggactccagcagcctaggaggaagcgggtgggctcttgaggacccccgcgcaccgcgctcccggaccacccggcgccggcccgtcctcggcaggggacctgcagggcgcgcccggggagccagggctctctgtccgggagttcccgggcccagtctcctcgctctgccccaggactgatgcgttaggacggctttccaactatccgcgagggttcgtttcccccaccttccccccgccccctgcatctcgtgggcgttgatattttcttttccacacttagtcttcaaggaggcttgtggcgcgcggcatccgccccgcgtgagctcggcagccctgtgaggaggctcctgccactgggacgcagcaacaggctgggcgccgccgtgctgtgatgttgcgtagcgtgggcagctctgggcacactagtggccctccagaggggacagaccttgagcggcaaaagagctgctaaagattttaaaacccaacgaacaggaaacaaaacaaaaatcagaaaaccccaaaactgtgccattctcttcctgctccttattcaggggtaacagtgaagtgtggggacagacagatccctcgccaagaatctaagagttgaaaggaaagatccacttcctgggggagtgggggtgggggtgtctggagtgaccgggggaatcgcccggcccagcttggtcctgctggctgtttaattgggggatggggacagtccgtgcagtgtctgcagttttgtgcaaggaccagacagccccctggagagtctggggcctccagcctggcccgtgcttgctgggttggcctggcgtgacgtaggcacaagacacatatctgccagatgggaaaggtgggggccacggtgacccacattcacaccaaccggagacccccggggcaattctgggcccacct

SEQ ID NO: 20088 - DNA, 1053 bp, Homo sapiens
ggcgaggctctgcctccgcccccgcgctccgggtcccattcccgaattctgccctcagcggcctggtcaatgaggttggatcgttggcccagaaagccacttcctgccgcgactggagccagccgtcgttgtgaaaattccccccacggggaaggaagtggctcttgggctgtttattttggctgcgggctagcagacggcgccaggggcagcggccacgcagaccgggcatttgtctagctgggcgggaggcggcggagcgggaagtgccacagattgaggggcgcacggcggtggagggaggggcgcccagtggagagggggctcacggtgacagaggaagtggcgccgcttgggggggtgcacgatggcagggggaggggtgctcggtggagggaggggcacacggtggcggggggaggggcgtgccgcagattgagggcgaacggtggcttggggaggggcgctccttggagttgggggcgcacgatggcgggggcaggggtgccccttgggagcagaagcagagaagactcggaactccaagagcaggtggatctgggagccccagatcctgggcactgggttgggggagaaaggggtcaaggtgtgcccgcccccgggatgctcggactctggggatccaggcctggtgacccccggtgaggaagagccagtgggaggaaagggccgggcgctgcccggagcagaggctggaggcgagagcgattgctgcttgctgtagcgcggccgctctccagttcctccggcaaggggggcctgggggaggactggccgaaaatactgtgatgctttggtctaagacaaaagccagcaggggatgagatcaaacaccatgacactgcgaaggggaaggccagcgcgggtgaggatttgccttcccagagaaccccaggggcggggctagcttccactcagcccgcattacccccacccccgcccccacccccggggcggggtctggaggatcagcaaaaccgcgggaaaggtgacagtcgccttccccaccaccgcctgcatttagtaggtgga

SEQ ID NO: 20089 - DNA, 1049 bp, Homo sapiens
gggaagtttcctgggcagataaaggcagctcaatgaggtcacagattgttatcgttgccatgtcttcattgtagagcccagcgccctgccagaccatatggtgataagggctgggatcatgtctatattgttcacaataccctcagtgcctgatgccctgctggcatctatgaaattctcaatacatcattgttggatgaatgaatgaataaatgaatgaatcacacccagccagtgctcagtgcacagctccctgcctagcttcattcatttctccatttactcagtaagaacatattgagccacagcttgatgcgtagcactgtgctaggcatgggttgattgcctacaaaatgcaagaagtggtctttgtccttggggaggagaatcccaagatccttgtgaggggccctgcaccttctgtggggggcacttttgctccctgcactgacacctgatgctcccatgcatatggatgaggctggggggtgggtgaggctggaggggccctctctggatgggggtggggggcatcaggcctctgcactctgagctccctctgcccgctttgtatgtgcttgatgaagcacgggtacaaagaacacagagccagctctcaggacgccttttctctttccccagcagttccagcccagcctgagcgtgcactccccctccactaggccttggagaaagagcctcttttcattgagggcccaggcccaccggccacttcgggtggaaaatgctctcaagaaccccctgaccccggcttggcagagtccccccggatccacctacaggaatcccccctcagcttctcctttgctttgcagagctcctgcacgcctctcctctgctttttgattcctcagccttttctcatttgctgccaaatgagaaaatgcaagaggttgcctttgtcctcttttgctgccaaatgagaaaatgtgacctgtgttcttcagtgcctcctccacattgcagtcttcagatctctgcccagcggagtctctcggcccttgggaggcacagagctccttgtaacg

SEQ ID NO: 20090 - DNA, 1113 bp, Homo sapiens
tggaaaaaccccatctctactaaaaattcaaaaattagccaggtgtggtggagcatgcccatcatagtcccagctacttgggaggctgaggaaggagaatcgcttgaacccaggaggcagaggttgcactgagctgagattgcgccactgcactgtgcagcctgggtgacagagcaagactctgtccccccccccacaaaaaaaaaaagaaaagaaaagaaaaaagaaaaattaacttcaaagcatttaatttacttttgtaaaaattgcaaaatacatgcttgtaaagtcttcaaatagtatacaagtatataacataaaattaaatgaaaattcccttcccccaggcccactctccaggtgaaaccccattgtagccccccatgttgtcttaatgcctgtcttgcatgtggtgaatggggaccagagtcaccatgtgaggggctggcctcttgtggtggacagccccgtcctgggggggcctttcctgggagaccccctgagttccgagatagaactttgtggggacacagagcccatgggctgggtagctgagcagagattccaccgggctcagccctctgtgggtgacttggaggccctcttgcccagctggagtttggatgggattaggggtactagggagccccttcccagccctatgaggtgtgcagcaagacctctctctggttcctgggctgactcaacagcagaagaagccttaaagccactatggggtgccattgcctctcccacctgctgatccctgtgaacacccagcactctgggttttaggggatttctcctgagggtcgaggggcttggcagcctctggtgtccagatgccaagggcctggcccctgtccaccccctgcagaggtctacaccatccagggaaactcccacggaaagccgtgcaccatccccttcaaatatgacaaccagtggttccacggctgcaccagcacgggccgcgaggatggtcacctgtggtgtgccaccacccaggactacggcaaagacgagcgctggggcttctgccccatcaagagtgagagctgttggagccgtgggggcgggggcagtgttcctggagggaggctggtgctgagg

SEQ ID NO: 20091 - DNA, 1030 bp, Homo sapiens
ttttctctgttgaaggtcatttccttcagttgtccattagaacctaccccccctcaccttctcaaggatatgttcctgtaattcttcctcttttctccttttctgcattgctgtgaacataactctcagaccactagacctattattccccatttgcagctttcacattattctccttctttcttccctgaaagtctctagctttgtatctcatgtcatctgactatattacctacaacctcttattgttgttgactgtatctcctggttcattgtagggcattccctacaatgatttctgatactgactaccttgaattaggccagacttcacaagttaagggcacagtcctccgtaagactactcttcaaacactagctgcaaacttgggggatttcagaggcaccctcatttttgagcaactagctaaaatttagggattcttgctactccctcacgtttgataattcattagaacaactgatagaacaggaaagcactgtaggtttgattatggcttaattgtgtcataaaggatacaaatcagcatcatccaaaaagagacacataaggccgggagactcctaaatgtgaagcttctgatgtcttctccctgtggagtcaggatacatcaccctcctggcacaaagacatgtagcaaatcatacgttgtttacacagtgtccacaatcttctgtggcatttcatgtgtaagcatgactgattgaatcattggccgctgatggaagtaagtcttcatctccctgccccaccttggtcagtctcctatgggtcaaaatctcaactctttaattatgtggctgggttctctagcatagccagcacctatcctgcatcattttattaccacagactatttagggacctatcatgagtcatcttgttagcataaataatcagagctcaccatgaataacaaagacactcaggaaattcccaggatttagagactacctttcaggaactggggacaaaggttcagcaaaattctctattacacaggattcc

SEQ ID NO: 20092 - DNA, 1886 bp, Homo sapiens
tgaatgttactacatttgtttctcacaaccacatagagcattatgataacaatttcacagataaggaaactaagatacagataattaattttcctaaagtcatataaattgtaatagttcaaagattgagtccagctcaactctgctagacacccagcacgtacatattggctataatttcattatacagtcaagtggagggagctacattttatgcagaggagagagcataaattgatagcggccttataatatgtttgctttttgaatgtcattgagtagtttggtgctaccatagtataggggagtatattatttaggatttttatggttgcaagtaacagaaaatttgaatcagaatagcttgatataaggggttagcaaactttttctgtaaagtaccaggtagtaagtgttaacttatatcctatggtttattccctcttggtttataagatagcagccagcatattcaggggctccattgatcttttcccatgtttagggagatacataatcttttccagaatttctttctaatcacttgaacttaatcccatctttgttacaactactgaactctgccattgcaacacaaatacagtaaataatttatttgctgttatgactgtgtactaataaaactttatttgtgaacactaaaacttgaatttcaaatattttttgagtcacaaaatattgttttagttatttgcagtcatttaaaaatgtataaactattctgagctctccggctgtgcaaaaataggtggcaggccagatttggctcgcaagagtgtgctgacctctggtttttatgatgaagataatttattagattgtataactctagtccagagatagggtagttttcttcagtaattcagtgtcaacaacatccttgttatgttccatctcttcatataatctttgaaagtgttaatttatatctcatggtttattcccttctgtgtttacaagatggcagccagcatatccagggacctaccgtctttgtccatgtctagtgagagataaaaccttttccggaagttctttctaatctctattgaacttaatcccatcgggtttcacccctgccactccacagagagagaccatgctaaaccatttacactggctgaatgcagtgatcaattctcaatcttcatattacttgacctatcaatatttaatatttgatcttttccactccataaaaccccttctttgtttctatactctccttgtcttgttcctattctcacagtattctccccaggctttcagcctctacatgttcgattccacaccaagtcttagtcctctgacctcttttctctctttttgtgtctcattcttgtatatactctttccttggggatctcatgcagtttcatagtttaaatgggatttatttactaatgatttgtgtgccgatggcatatctatatttctatgcctatttgtctaataagcatttgaaacttagtatttccaaaactgaactccgcatagtctcctcatccccaaatcagttcttttgcagtctttcctgtcttagtaagttgcaagtccattttttaggcccaacatattagaattgtcctcaatttctttatcttactcttctgacagcagattctctttgccatatcttcagaatatatccagaatccaacctcttctcactacctccactaaccacttagtccaagtgttcattcttattctgaatttttgcagtagcctcttaattggtctctctgctttgtctacttctgctctcttccccttcagcagtagagagccttgaaaaagaacacagttttaaagccagacaattttgattttagtattgctacttactagtggtgtgatattgg

SEQ ID NO: 20093 - DNA, 1034 bp, Homo sapiens
ttatgctttgttcactgctgtatccttatgtgccaataataagtacatagtatatagtagtcactaaataaatggtgaatgaatgatctgaaagagaatgagttgagaacccaaaatgatgaaaaatagattataaaatttcagacaatcatttattgagtttggttttcaaagaatctttaatagcataaaataaaataaagctgagatttacagatgtgcagtttttaatcctgtaaaagcttcagatttatttattctataatcgtgtccctctttttctccaagtttgctcttcccagtttttagagctgtactatttttataaaactgtttgttgcagattaaaaagaggaataatatgagttgaaaattttaacttatgctaatacttaatcatacttaagtaataagcatgtattatgactatgtctggaatttatcttattcactcttattttccctgtaaacatattttgatataaaaatgagattatgtaaaactctaaaaataaaattagtacaaattactactaaaattgtaattattaaatgtcaaattttattaagtatcaaatatagatgtttgaaatcacttatctaatttactctgagctttgtcagttaaaatatttttcaaatcaatgagcgtaattgaattttattaacaaagctaaaacttcaaacaacaaaaccagggatttctgtgatccagaggacaactacgtgatctcaatttgaagtcaccaggaattgtatcattgttagagttaattgatagtaaaagcatgtttcttaactttttagagattttatttgtaatatctctttattcaaaagaaatatatatatttttttatatggaatcttgctttgtcgcctaggctggagtgcagagtgcaatggcttgatcttggctcactgcaacctccgcctcccgggttcaagcgattctcctgcctcagcctcctgggtagatgggattacaggcccggctttttttgtatttttagtggagatgagttttcaccata

SEQ ID NO: 20094 - DNA, 1046 bp, Homo sapiens
aaatttaaataaaagtataaaataggctgggtgtggtggctcatgcctgtaatcccagcactttgggaggccagtgtttgcggatcacttgaggtcaggagttcaagaccagcctggccaacatgctaaaaccccgtttctactaaaaaaaaaaaaaaaaaaaaaaaaaaaaaaaaaaaaaattagcccggcatggtggtgcacagctgtaatcccagctactccagaggctgaggtgggagaattgcatgaacccagaaggtgaggttgcagtgagcctagattgtgccactgcacttcagcctgggtgacagagcgagactctgtctcaagaaaaaaaaaaaagtatttttatttgtcgttacatagctttttttgaaagtgaggtaattgtttttagagctgtgtacctcacattagaactgggctctagcaagaagttttgcatcactaactaaaagaaataggccatctataagacccaacagaatgatcccatttcatcagtctttctaaaacaaaatttagggatgttttctcttccatttaaatactcattttaaaaaaaattgttacatttaattcttatttgagtgccaaataagatcagagcaaaattaaaagtttgtataaagctctataagaaaactaccgtctatagatgtaatgttggaaaaagtttttaaacttttttacttgataaacattaaaatggtatcattaatttttaaaacaaggcaaagtgtgatgatatttattttaattgattgaactaagttagaacaaactaaattcataagccagacattgctacagatttcttatacactgttggtataaagtctagccacatatatctgaagtaacttgattttctaagtcacttgctcctgtcccaacttctttcttaattttctggtggagtttgtaaaggagtgctattatttcttcttaaggcagttgttaggattcaccagtggtgacaactgagactgggcttttttgtggtaagatgtttaattactaattcagtttatttacttgtt

SEQ ID NO: 20095 - DNA, 1050 bp, Homo sapiens
tgaacatttgttatgtgtcttttgatgcacctattagtatacttttccttttttttatacaactagtagtggacttgctgagtcatatggtttctgtaaaatggcaaacattttccaaatttgaaaccatacattttttaaatgccaaaccttttatccaaatttgatgctaccagtttacattcccatcagcacagcagtgtttcagtgttcctttgccccctactgtcagatgctattttgtttgttttgtgtgccattctgcactgtatatgtgtagcagtatctcattggagttttgatttgcatttcccaataatattgaacacctttacatgtgcttattagctatttggatattctcttttgtaaatcctgtatagatcttttgtctattttttaattggattgtctttcttgttgatttgtagtagttatctcactctatggcttgcccttttaccttcttaatggtgtctttggtgaaaagattgactttgccaatcttttttcttaatggttgttgccttttgggcctttgtaagaaatatttacctagttctaggtcataaagttacactaaaaggtcgttttccagaagacttattgcttcactttttacctttgggtctataatctatatgaaacttattcttttaaggacaggatttacttttccatatggatatcatattgatctgtcaccaatacttgaaaacactctcatgttactgaaacactgcagtgaaacttttgttctgaatcaggtgattatatatagagagagatctgtttttggatttttaaactctgttccattgaccacctttttatctatgcttttgtctagctgtgtcttaattactttagctttatattaatctcgatattaagcagtatgcccttctctctctctctttttttttttttttttttgagacagtgtctcactcttgttgcccagcctggagtgcaatggcgcaacctcggctcactgcaacttccgcctcccaggtacaagtgattctcctgccccagcctcccgagtag

SEQ ID NO: 20096 - DNA, 1093 bp, Homo sapiens
acgtctttattagcagtgtgaaaatggactaataacagtctccataaatgttttgtaaaaatcagtgattttactattcttccacccaggcttcaccataactttgctgtttatccttgcttcaattttagcagaattcatgttgctctgatgagggcttttttcacactaatgtcttgttcttaatgcctcaaactatatcctgttcagacatcttataataagttagtatgaatttattttgatgcaaaaaatttttgaaattcatccatagttttttcataagatgcatttcaatgaactttttgaagactctcacatgtataaaaataattaagctatacaccaaagatttatatactctatatatgtaaatcataccagtttttaaaatatataaaatgtggcagggcacagtggcttacacctgtaatctcagcactttgggaggacaaggtgggtggatcacttgaggtcaggagttcgagaccagcctgaacaacatggtgaaaccccgtctctactaaaaatacaaaaattggccaggtgcagtggctgacacctgtaatcccagcacgttgagaggctgaggcagacgaatcacgaggtcaggagttcaagaccagcctggccaacatggtgaaactccgtctctactaaaaatacaaaaacttagctgggcgtggtggcaggggcctgtaatcccagctactcgggaggctgaggcacagagaatcccttgaacccgggaggtggaggttgcagtgagctgagatcgtgccactgcactccagcctgggcaacaaggcgggactccttatcaaaaaaaaaaaaaaaaaattacctgtgcatggtagcgtgcacctgtaatcccagctgctcaggagactgaggcacatgaattgcttgaacctgggaggcggaggttgcagtgagccaagattgcaccagtgcactccagcctgggatacagagtgagacgctgtctcaaaaaaaaaaaaaaaattatatgtatgtaggcctgttgtctctgcagaaggattttctcttttctttggtatagaaatagcagtcctaggaaacataacaagat

SEQ ID NO: 20097 - DNA, 1073 bp, Homo sapiens
tatctgttttttcttaacaaattaatttaaatttaattaattaaatttcttaacttaaagttccttgtagatgctgggtattagacttttgtcagagacatcgtttgcaaaattttctcccattctgtaggttgtctgttgactctgttgatagtgtcttttgctgtgcagaagctctttagtttaattggatcctgtttgtcaatttttgcttttgttggaattgcttttggtggcttcatcatgaaatctttaaatctttgcctatttctttatccagaatggtattgcctgggttgtcttccaggtttttatagtttggggttttacatttaagtctttaattcatcttgagtgaattttcttatgtggtgtaaggaagggatccagtttcagtctttgcatatggctagccagttatcccagcaccacttattaaatagggagtcctttccctattgcttgtttttgtcagttttattgaagaccaggtagttgtaggtttgcagtcttatttcctggttctctattatgttcggttggtctatgcgtctgtttgtaccagtaccatgctgttttggttattgcagtcctgtagtatagtttgaaatcaggtagtgtggtgcttccagcattgttctttttgcttaggattaccttggctatttgggctctctttttggttccatatgaattttaaaataattttttctggttttgtaaagagtgtcattggcagtttgataagaataacattgaatcttaccaattacttttggcagtatggccattttaacgacattgattcttcctattcatgagcatgaaattttttttatttgtttgtgtcatctctgatttctttgagcagtgttttgaagttctcctgatagagataattcacctacctggttaactgtattcctaggtattttattctgaaatagttttttaatcacaattctggttttaaatgatcctagagatggtagttaatgcttatatacactgtagtatacccagtagataactaagtttattgactgactgatttcaagtgtagagagtgtctg

SEQ ID NO: 20098 - DNA, 1030 bp, Homo sapiens
agtaggtctcagttttttagtgagcttgtgcctctgaactgtaagcttcataagtgttcctcaggtattgttttccttcccccccttcagtgggagaggaggactagagtgggagacagttgggtatttcccttctcccacaaggaatgcttcccttcagttaggcactgataatactccagcaggttgggctctggtgaactaggttcccctgagggcaggccttgttaagagcattgtgctttggcatgtttcaaaatggttacttttccccttcttctgctagaagcttgaggggatttttcttcagtatttactgtgagaacctggttgggctcctagaggtaagtcacacaaaatggtggcggcccccatctctgagtgcccctggagttgttaactctcagacttgtccacatggagcctccagcaatttgtcagtagcaagtcaggttttcctaccctggctctggttcccactgcattttccactctggtaagctgtgactccctgactgtactcagtgatttgccctgtgccctcacctcttatggatcctggaattgttgaatttttagtctgttcaggtttttacttgttgttaggatgaagtggtgacttccaagctccttacatgtgaaactggaaactggaagtctcccttcttacattgtggcctggaaatgctttcaaggcaataagtgggcagtcacaggatttgcctcatttgttttccatctgaggaaccactgtttttcattgccttatgtctgctgtcttaaaacctattgtttcatatattttgtgtaaaggtttgtttattgctttaggtgggagggttaatctagtgccgcttactccatcttggccagaagtggaaattcatgtcaaatttttaagaagaatgttatagatggagtagaccagaacataaaccagtgtctcattagaaggtaaccgtcttggtagttagaattaggttctccataagctacaatgcatattgtacttacaataatgaagagttaa

SEQ ID NO: 20099 - DNA, 1091 bp, Homo sapiens
ccttttataacaaaaccaacaatgcacagaatggccatttgctggaggacgattattacagcccccatgggatgctggctaacgggtctcgtggagacctcttggagcgagtcagccaggcctcctcctatcccgacgtgaaggtagctcggactctacctgtggctcaggcataccaggacaacctgtacaggcagctgtcccgagactctcggcaagggcagacatcccctatcaaaccaaagagaccgttcgtggagtctaatgtttaaaagacgttttgttggagtgagacccatatgttttcactgcacattttcaggcttggtttccacattcgaggtagttctctggcttaatttctcatgtagtttctgtgtggtgttcagaggtggcagcccacatgctgaaatcctttgcatgcagccgactgggaagcggcctcccgggagccaggacttcagtttctcttgtctgtgcccagccacatgctctctccctctcttcagatgccaacgaggagattttcgtgctgtgtgctttaacccagggagatcagacacactggtcagctttttccaggagacaatcgctttcactgatgttcttgttgtgtaattgtctttttccttttttaaaaaataaggtgttcttgttcgttttcttctagaaactttagaaagagtgcgatgcccctttgcctttgcatccttagccagtgtcacccacacagccagccgcagcgcattctcatgctgtggcccctccccagaccgccagcgccctgcagccaccaggtctgcagtgtgcattaggattattgctggtcttcctagggggtaaaaggatcagagagagaagaattaagtgctaaattggaagaaaaccccaatataattatgtaaaatgtcactacattgattttccaagaggcattgtaggaacatgtcaaaaacagccagccctttaaatattgcagtcagccaaggaaattagatgagaattgtggctattaagagaattcactgagagttattctctagatttttagccgacaattaaccactaaaagctgctgcttttccagggtg

SEQ ID NO: 20100 - DNA, 1025 bp, Homo sapiens
ttggcctagaacttggaggcccgctgctacagcacgctcgcctccaggccacccacgcccccaccacccgcactgagccgttatctgcctgactgacatcttggccaaccaatgacctttggggctgccaaagcgcctgcctccgagagttgggcggggcgagtagttgcaatgacaaacatttaacccaatagcgaggagatttcagacgctacggccgcaataaccaatgacaagaaagaatcctttcgaaaggacgtgtcaggcaaccaacggccggtgccgctgcgggggtccggcggcttccgttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggtgggccgggcaggggctcggaacccagctggcggggagcgggccccgggagcgccctttccgggccggagcccaggcctcagaaccctcttgcggactcgccctagggccacggagcggttcctctgtctggccctgtgctgaaggtttcgtactcgttgtctgtctcctttaatccaggcagcattcttgtgtagtcggcagtgtagtggggaaactgaggcacggttttgtgacttgcctgggtcaggcagctatttcggggtggaaacaggtcttaaaaccgggtttacgccccaaagatactccatttattcatcccgtgctctccactcct

SEQ ID NO: 20101 - DNA, 1050 bp, Homo sapiens
caggaggtcaaggctgcagtgagccaagatcttgccactgaactcccgctggggtgacagagcgagaccgccatctcaaaaccaaaaaaacaaaacaaatggaatcagcacaatagctgtagaaagatgctattagaaaggatggggggaaatggaaaataagtggcagataaagtacccatactaaaaagatgtctttagcttggttgaaaaataattgtcagtcctaccactgtgagttcaaagaacttaagaaaatacagaacttcaagcagagatatagaggattgggtaaaataaggcatggcaaagagaaaatataacatcagctggcagagcacacaggaaagtagtggaagagaaaactaaaattatcacaggattaaaagccacattggaaacagaataaaggctgggcacagtggttcactcctgtaatcccagctacttgggacactgaggcaggagacttacttgaacctgggaagaggaggttgcagtgagccgagatcatgtcactgtactccagcctgggtgatgaagtgagactgtcaaaaaaaaaaagaaagaaagaaacagaataaagatgaacacacagtgctgaaaacagtaaaggttagggaggacagattgaaaaatgaaactgaagaaaacaatgagaacataatagatgcagaaagtaaaagagatctgacgtaagtataattggtgtccctcaagaagaggaccaaagaaatgaaacaaactcaaatatatggttaaagaagaacttagaagtaaagatttgaagtgataagttcaaattggcatgatttgaacttgccaaagatttgaagtgataagttcaaattggcatgaagtgataagaaaaattggcactgaacagttggcactgaaacatttcctaggaaaatttcttttttaaaaaatttatcttatttttcgtgtgttttgttttgttttgagacagtgtctcactctgttgcccaggctgggtgcagaggcatgatcccagctcactgcactcttgacctcctaggcttaatcgat

SEQ ID NO: 20102 - DNA, 1007 bp, Homo sapiens
aactatggactttagttgatatatcaatattgattaattaattgtaacaaaaagaaatataccatactaatgtaagatattaataataggggaaactggctgggtgtggtggctcatgcctgtaatcccagcactttgggaggctgaggtggacagattgcttgagcccaggagtttgagactagctgggcaacatggcaagaccccatctctacaaaaagttacaaattagcccagtgtggcgacatgtgcctgtttgtagtcccagctacatgggaggctgaggtaggagaatcaatcacctgtgcccgggaagtcaaggctgcagtgagccgtgatcgtaccactgcactccagcttgggtggcaggagtaagaccctgtctcaataataacaataataataataggggaaactgtacaaaggggagaaggatatatcagaactctgctctgtatgctcagtttttctgtaaatgtaaaactcttctaaaaataaaatttattaattaaaataatagagctacagcaaggtatgctgggctgtaggcaggaacaggtaaaaggatgtataaccctcccacaggggcagacaggactacaaacttcatagagcacttgggatactccagatccagttgaggaaatagtgtgggaagctggagaccacacatcagagcatggcaactctgctttagaggactcttgtcatggtaactgtttagaatttcaggggaacgagaaaaagaagatagtgaaaaactgctctcagtgcctgtgtgacacttaagttgtagcatagcatggtagttaagagtcaggcttccagggttcaaatcctacctcttcctttacaagcgatatgacctgaccttgggggaacttacttaatcttattgtaactcagttattttctgtaaaatagggataataatggtacttgttttgaggatcagtttaattaatatatgtaaacatgcttagaacaatgcttggtttgtggtaaat

SEQ ID NO: 20103 - DNA, 1031 bp, Homo sapiens
ggcttcagaaacacctctatctagagaatccatctagatagcacctaacagtatcactgcttgggacagttgatttggaagaaaaaaatataagaattacagtctgggccgggtgtggtggctcacgcctgtaatcccagcactttgggaggctgaggcgggcagataaaaaggtcaggagttcgagaccaatatggtgaaaccccgtctctactaaaaatacaaaaattagccgggcgtggtggccggcgtctgtagtcccagctactcgggaggctaaggcaggagaatcgcttgaacctgggaggtggaagttgcagtgagccgagttcgagccactgcactccagcctgggggacagagcgagactccatcacacacacacagaaaaaagaattacagtctcaatgggtttcctagtggagatgaaactaatttggttagcagtataatttccaaaaatgaaaggtggtgatggacaaaggaaaaaaacaggaaggaattaccttcttgagatgttaggctttgcgtgaaggatagattatggtttatattaatagtctatcaatgttgccctgtagaactttctgctataatggaaatgttctatatctgtgctgtccagtacacatatggctgctgtacatgtggctaatgagcacttgaaatgtggttggtgagacagaggaacctttttcttttaagacagggtctctgggccaggtacagaggctcacgcctgtaatcccagcactttgggaggctgaggcaggaagattacctgaggtcaggagttccagaccagcctggccaacatggtgaaaccctgtctctactaaaaatataaaaattagctgggtgtggtggtgcacacctgtagtcccagctactcgggaggctgaggcaggagaatggcatgaacctgggaggtggagcttgcagtgagccgagatcgtgccacttcagcctaggcgacagagcgagactccatctcaaaaaaaaaaaaaaaaagtagacaggatctctgttgc

SEQ ID NO: 20104 - DNA, 1145 bp, Homo sapiens
tgttcttttgatttcaaatctgtcatggacttttttttttttttttttttttttggagatggagtctcactctgtcgcccaggccggagtgcagtggcgtgatctcggctcactgcaacctccacctcccgggttcaagcaattcttctgcctcagcctcccgagaagctgggattacaggtgcacgacaccacgccccgctaatttttgtatttttagtagagaaggggtttcaccatgttggccagactggtcttgaactcctgaccttgtgatccgcccgccttggcctcccaaagtactgggacaggcatgagccactgtgcccggccgtaccagttctttttttaaatacaaaaactgagaagtgaaatggaaaaataaactagaggtatataaattataaggctacagttttcattagtagattcaataaacataaaatcactctgccaaattgctctaaagtttttcaaagggccctctccatttctttacttacttggtggaagagcaggacgagcagtataccagtgtgtggactggcaccagcccagatatcataccttaagtacactgctccaggatactatatcacctggtcttcatcacctccgctgatactgtcagtcactttgtttctccactttgaatttcctgcatttgtagcagttgcctcaccgccttttgttaccacctattcctttatttccctttttttttgagatgggatcttactctgtcacccaagctggagtgcagtggcgcagtgacagctcaccacagcctcaacctcccagactcaagttatcttcctcccatctcagcctcacaagtaactgggactacaggcgtgtgcccccatgcttggcttttctttttttttttttaattgtttgtagagacagggtcttgccatgttgcccaagctggtctcaaactcctgggctcaagcaatccttctgtctcagcctcgcaaagtgctgggattacaggtttgagccaccatacctggctgtttctcttcttgttcctgttttgaattgtgctatctctttcttctctttggattcttcttcttcttcttcttcttcttttctttttttttttatttgagatggagtttcactcttgttgcccaggct

SEQ ID NO: 20105 - DNA, 1041 bp, Homo sapiens
gcttagatcatttagctaatgagtggcaaagcctgatctgaacccacgtatatctaatttcaaagcttagtcttttctccgtgcacctcacttacctccttagagttgcttctgctgctgacaaatgttgctgacatgtggattgaattgccatagaacttgtggactaccaagatgtcatccaaagctaaaagtaggaagcaggcagtaggctaatttttataagcaaagggttaaatagtgctctctctgtgttttgtgacatgataagacttaggaaaaccatcctttttttacagttgcactggaattttgtgttacagtagcaagggaaacagccaggtacatgggtctgtgaggtctgggtcactggaaagtggagtagttcccttggtccagatttcccctaaacctccatcttgtctttgcctacaaaccctctgttggccaagcggcattttgtattcctggcctctgactcccaaatgaccatggagaaaacaactctgaatttgagctgcatgaaacatgccactgtggatgtggctcacacctgtaatccctgcactttgggaggctgaagcaggaggatcccttgagcccaaggagtttggggctacagtgagctatgaacacgccactgcactccaaagaaagaaagatacatggcactgtgcttcccctgtgctgccaggaagtccccacgttagcctccctcccacacctggcaggctgtcatatttccttgtggatgggatctccatcctccatagggattactcatgggggacagatggcctggccagttcaaggagaagttatgtcttgtgccactgtgttgagcagcatgcctgccctttttggaaataaattatggtccccaaattgccttggctgaactgtatgagagtcacaaagcctgttttctcgcttcggccccaccataaagtcactttatggctttggggcttgggtttccctctgcgcaatgtggatgatgataatgcaccaccactgcaggggtgtagtaagggttaaatg

SEQ ID NO: 20106 - DNA, 1143 bp, Homo sapiens
cgcacagcaggccggaggcacagccggcgagagacggccactcgctttggagcggcggcgaggccggcgccttcccgggcaccagggactgcgtggcttggccggaaatcaggctagaagcagctccgggaagcacagcccttagcccagcgccttcccacactgtggcaggaatagcactggcggcccacgcgcttgtcagggaacagaacagctctcgcccgacgcctggcaggggagcagggaggctgcagcttccccagcgaccagctgtttcccaggctggcggactccacggaccggctccgcgtctcctctccagccttctgttctctctagaggaagatctgcgttttgtctgcactgtgggccgactctctagtggggagcgtcagaccctctaaagtggctgcctctcgggaaagcttccacacctgtcatcagattctccaaaggggctgtttgatgcaagaaacgggaagccccgggggtactaggagcagggcttgctgccattgggcatggtgaggccccggcaccctgcccaggacgggcctgtgggctgagctgcagatgggcattgaggatgccccaacagcaaggtgcagaaggcatccagaagcaaaggaaactgatgaccagcgtcaaaaacaaacaaaaaaagggaacttggctcggcggtggctcacgcctgtagtcccagcactttgggaggcagagacaggtggatcacgaggtcagaagtccaagaccagcctggccaacatggtgaaatcccgtctctactaaaaatacaaaaattatccaggcgtggtggtgtgtgcctgtaatcctagctactcgggaggctgaggcagaagaatcgcttgaacccgggaggtggagcctacagtgagtcaacatgaagccagtgcacgccagcctgggcgacagactctgtgtttgtgtgtgtgtgggggggggagggcggggcgaggcgaagggaacttgaggtttaaagcagggggaggagggccggaaatgctccccgccgcccccgacactcactcgccccaggccccatcctagcccagggtcagtgtcattcccttcaccttagcctctcactgcccaaagaggcttacttttcttctttaaactgct

SEQ ID NO: 20107 - DNA, 1884 bp, Homo sapiens
cctataggcagttatccaatttcttgtggcttccctgtgttttctttttgtcaatgatgtttctatgtctgtcctctctcgtatacacacccaggacttcctcaagcgcagggactatgtcttaaggcgctttgcagagccaagctcatttctggcacataagaggtgagcaatgagtgtttcgtacaaaaattaatgtttatattttgacagctgggaaaagaaaatatatcttcctgtacctggaagaagcattgtgtagcctaatgtgcaattcgttcattcaaggggtatttttattggtgcctattctctagcgccgttctaggtgatagggataggtgttagacccctgcctttggggaacttaactttctagtagcgggaggagaggcaaacagatacatatattatactgaatgttagaagatgatcagtatcttagggaaaagaaagctggaaagggggttggggaggtggtggtgttggaatttgcaataaagtggtcagggaagtccatacagacaagctgatatttaagcggactagaaggtggagtgagagcctacgtttatctggggaaaggaacgttccaagctagagaataacaaacataaaagccttgaggaggacaaagctggcccgttaagagtgtgaagaccaacgcgtttggagcactgtgagctgagggagtattaggagataaggtcagggaagaattgggggaagggagtgagcggaacaaccaaagccttttaggctgttacttaggaaggatctgagggtttcgatcagaggaatgataatatctgatttatattgtaacaatttaatataagagaggagtgcagttatttaaatttgttttgttacattgatagtcatataatcagctcttagttgctttaagctgacaggagaagggatgcttctaaaataaccataacctagcatttacttgtatttggtttagaagaatgtgattacgttcttgagtttttatttagattctcatcaaagaactgacctgtatatagtgtgtgaggtactctcaaagtatatgtagagtagatgctaatcactgtcactagaactcttccttccacctccaaaaatacaagtgataaagtaatgtggcttatataatcagttgtttttagtccactatatttaaagtcatttagatcatatcttattttccgccattgccgaaaacacaaactagctaaattgtcttcctttataagtgtgttccacatttattctcacttcctagcctttgctagttcagtctttctccctggaatgtcttcgtctgcacgtctctacccagctttcatctttctgtgcctagcctggcttctgactctgttatgacacttgcccttgcttgttagctcatggtgatctctgacatcttcagtgttcttgtggcgcttatgtatgaaatacctgagttgaaagaagtctgatagtctcaatttaccgatgaagaaattggttcttcagaaataatgtaataatgaaaaacacgatggtagctgacatattgaacaagtacatttttgtgtatgaacttaatttttcacgccaactcttgagataggtgatagtctcatcttttttttttttttttgagatggtgtctggctgtgttgcccaggctggtcttgaactcctgagctcaagtaatccgcctgcctcagcctcccagagtgctgggattacaggcgtgagccaccacacacagcctcttaccattttttatagatgaggaaactgaacccagagaagctaaataacttccctgaggttcatatcaagttagtagcaaagatagtttacacatagcctgtgctactttactattctgttaagatttcc

SEQ ID NO: 20108 - DNA, 1030 bp, Homo sapiens
tcctgcctcagcctccggagtagctgggactacaggtgcccaccaccacgcctggctaatttttttgtatctttaatagagatggggtttcagcatgttagccaggattgtctcgatctcctgacttcgtgatccacccgtctcggcctcccaaagtgctgagattacaggcgtgagccaccgtgcccagccaggagatgccatttctttggggatatcatattcatgtctttaggagttggtatttgagatatgctttgaaggataggactttggtaggtactcacagtttataggaaagagatttgatgtgaaggggatccagttagagggaagaggattcactagagtgcttgttttcctggaaaactgagtacgtgtggagagaccctgggaaatatgaatggtaaagtagtttgatgccacaatggagggtctcattccagcatgattaactgtggagagctatggaattgaggagagtgacataatcagaaatgtgtgttctggaagaacctggaaagggttttcgataagcatctgaatactgacctcccttctgtgagactttttctggttccacggtattaacacacactatgctactctaccaaaggaggtaaaacttgcttttctcttttcactgtgtgtctcactattacttcatcattttatgctttactaaacagaatcacttctcatagactatggaagatttgctggttttagatgaagcatctggatgtacatccacattacttttccaataaaacagacattcttgggacagtagtcaggggaggattacctgtcaaatgtcattcatctcagagaggccttgcctgacttaagtctgcaatagcttgcctcttaccctcttgcttgcttttcatagcacttttgctacctggaattacatgatttagtttttctttctcctgggccagactgtgaactctgagtatggctgcatctgattccattactgtatccttagcaccttagagcagttactggcacaaaataggca

SEQ ID NO: 20109 - DNA, 1028 bp, Homo sapiens
tttatacctgcgttgctgcaacagccttctactttccttgcctctaccatgagtatctctcattctgtctttcaaaaacactgatctgaaaatttcccttctgtgtaaaattaacgattctttgtagctggcagaatacagttttgtatggtacgtcgttagcatagccttctaagctgttcatcttggccctacctgtctttctgaacatgtgtcctgcaaatttcccaaatgtgctactgaactctagctgcactgaactatttcttgttctctgtggtaacacttaacagatccttccatctgaaatgcccttctttaatgcctctttgatctaatgcctcttgaggtttcaaaatttaacatgtcatctctcagaacacttctatgcctttgctcccactcatggaccaccagtgaatgcactctgtatagtacgtctgttagaacgcatcatgttgttttcagctgcctcagactgcactgtctactccttgagaacagggactgtatctttcatgtatgaatgcctagcacatcatataccacctgaccttctcagcaagctttcagtaaaccattgaaagttttcctgctaggagattgtgtgattcttaaaatccacctgaacgtaaatgtctttccactatcctttctttgccttctcatccttatggcttattagctccttgttatacattgtatacactaggaaaaatgagattaaaattgagcccatcctttttgttgcttgggaacacctcttgtaaagatagcttatagattagtttaaaaacgtcagatgctgaaattttcttgcttgtaaagattcttactaaatttcatcacactggaattacgttgattccttgattgaaggaatccccttatgggattccgaaagacagcaggagatgaagttcaggtaaattagtacttactaaatacataccttagtcattctcactgttagagaaggaagtccaaaatgagtaaagacagtttctatctggagttaagggtctaag

SEQ ID NO: 20110 - DNA, 1018 bp, Homo sapiens
agctcctgagacatacagcaagtggtgatggtccccttctccatgtgaactgtttaagcgttttattcccaaactcataaaggagttaatgtagttttcactctgtccccatccctaaggtaactgcttttggctgaaaaccatttaccctagagctagaaactttggggacaataagaaggttgtgacctttctagtatatgccaaatacaagattttttttttctttttagtatgaaatacttttcacaaccgcattgtttgttgtatggattcacaaaactaggaccatttggtatctgtcttcagaaagtttttacgtctgatatccttgttggtaaccgctgtttctaggggtatcatatcatcccatttaaaagaaatgcaaactgcagattatagagtgcagctacacatatatataatggggtggatagtttatagtgtgctcattgctgctttgttattattagtgttgagagttcctgtgctgtgtggaattcaacactaatctgctgtaagtatggagctgggtatgtggaacatttgcagggaagtttgtttctccgcttgtttttccaggggtattcgagatgacattgaagaggaagatgaccaagtgagttcctatgcagtatttctatcttttatttttatccacaaagtctatactggggacaagctagagcttgccttcactcaaaatggccattcctgacattcagcagggaatgtcatttgatttgctccttttgtacctgtgtgaccaattggtaatacatagattcacatggctttcccccatattgaagatggaatttttgatcaactgtgacatccaaagcaaatacgagctttattcagcttgcttctttttaaatccaaaattaatgtttattctgataaatcaagtggtagagtagtgtgggatctattgatggcctctggtaacatctaacctctgtctcttagtaagtgtcctgtttgtggttcttgtatttcaagctggaacattaat

SEQ ID NO: 20111 - DNA, 1047 bp, Homo sapiens
tatactttttaggatctaagctgagaataaattaatttttttgctttctctagctggaatggctttacttgtgtaaaatttggaaaagattattttgcaataaaatcaaacttacagaattgactcttgaattctagactaactttgaataattggacctgcagattgactatccaccatttgaaaaaaacttttacaatgagcatgaagagataaccaacctcactccacagcagttaatagatctccggcataagctcaatcttcgggtaagcatcattaagctcaatattcttaatattaatgttaattagtccagatttagtattattggttatctaaactaataaccttgaatttcttttctaatggtctctgaactgtctttgccagagtaattattatatcccttctgttcatgtctcttaatttgattgttttagtcttctagatgctgttttaggataggatcattttcttgtttcatatttcagtcagttttatatgttctgtgctggatgggctagtgatgaagggtgggagtccccatctaaaggaagaggaaacaaaaggaatagatgttaacagatgatatcttagaatattttgaaatgaagataaacttgtctgtcaaattacatatagtatgctttattttaaaaattagaataaactaataccttttaaaaatatgcatgtactaatttcagaatggtttaaactgcctaccagaaagttttgggctgcacattggctacattggtttaaggtgctgatagatggtaaatgaaacacacagaaaaaatatgctatgctatctactctaatatagacaactttctcgcctgtgtgcaccttatcagttgctacacgatgtttaaactcctgttttccaggaggggtgtgtatttgtgtgtgtacacttgtctgttttccaagaggttactcatctccccagtgacccaagaaaaattttaagtaaaacccctgaaatcctgattggaaatatcaacatcaccagagaagcattgaaaggttaccactttg

SEQ ID NO: 20112 - DNA, 1021 bp, Homo sapiens
ttaaacaaaatggagttgtttctgttctgtaagtggtggctgatatccacgtaatgagaatgatgtcatttcctataaatcaagaagttaatgagaatgttggatattgatatttctatttcacaaccagtatgcatagcaccaggtatgttttgttccattgcaaataaaaatgttagtagtcatttatcattccccaggatttgcttcagtacatctttagaattgaaattttagagtggttatattttactttttctccagggtgtgcctgtggcattaagtggtagagacatgattggtattgccaaaacaggtagtgggaaaactgcagccttcatttggcccatgttgattcatataatggaccagaaggagttggaaccaggtgatggaccaattgcagtgattgtgtgtcctaccagggagctttgccagcaggtatgtgctttctatagaatgcctccttccatatgtggactagcaagggaccagccagtcaagtgaggtagaatgaccaggaaacttttttttttaattgtgataagatacacacaaaattgattatcttaaccatttttaatgtacagttcagtggcattaagtatattcacagtgttgtgctaccaggaaacttttggaaagtattatgtgttaaatattttctatataaccaaatacatattttcccctaaaaactactgtttttatttatttttatttatttgctttttttgagacagagtctcactcttttgcccaggctggagtgcagtggtgtgatctcagctcactgcaacctccacctcccagtttcaagcaattctcctgcctcagccgagaggctgggatcacgggcacacgccaccacacctggctaatttttttatttttagtagagacggggtttcaccatgttggccaggctggtctcaaactcctgacctcaagtgatctgcttgccttggcctcccacagtgctgggattacaggtgtgagccactgtgcccggccagaacta

SEQ ID NO: 20113 - DNA, 1075 bp, Homo sapiens
attatacagttttatcagtgggtagaagcagtgtacagtacagatctgctgatttgaaatcaagagtctttttctgaaccatactgacaacttgtcttaactaaaaatgtaataaaaatagaataagagcaaatctttccctagtgaatcagtttctaaactaaatttaaagttcaggtgagcttatgtaaaaaaactgaataatcctgaatgccaaagaagcttaatgggtatgcataaagatatcatattgtttctctaacagaatttatcttaccttttagctctcttatttagtgcaacttttcggaagaagattgaaaagttggccagagacatcctgatcgaccctattcgagtggtgcagggagatattggagaggtaaccctaagcagggctggatgggaccttaatgggtttatttctcatattatggaacacagaattaatttctcactattgagataaaaaaaaaagatgttatgtttatagatgcaacatgcttgagattgggtattttgcaagttgtggggatagacgtaacaagactggcaaaatgttgggaatcattgaagctaggtgatgggtatgagttgattttgttcattttgtgttttttttgttttattgaatgtctcaaaacttacaattgttttaaaaaggcttcaaagagacaaaaagatgtgcctggaagcatcagcgtattaggttggaactgacgttttaattattgtggtaggggcctacgcaggagggaaagggtgacctggaaggcctggaaaaaatcaggtttcatttcttacctgtacatatgcgctatgtgaaaaattactctgaattgggacttggaattcagttatggctgcttagagaatccttcagttgcttgccatggttattgttaaggaaagctctacaaagtagtggggcatacaaattaggtatgtacaccaggtggagagcaaggtgattggaaaggagaggtgagttttgagctgcacttgacttgctgaaggcccaaggagaactgggattgttcaaggtcttctcgatgcaggtagaaatataatgcct

SEQ ID NO: 20114 - DNA, 1050 bp, Homo sapiens
tttagtcctgggaaaatggagggttccaagggagggagggattagaacccagatcctgagcctccgaagtccaaactttttctactacgcaaagctacctggtgtcaagccttattcaaagtgccctgcaagtggctttaccccctcggatgtttaacctgtcgtttaagactcactctgtgtcttcagatggagctggaggaggggaaggcaggcagcggactccgccaatattatctgtccaagattgaagaactccaggtgaggacggactccagagggagctaggaagggtgatgatgggggatggaaacggacttccacaaatccatctaattcctttgggagtgcagtggaagaagctgctgcttctcctttcttgtttgtttcttagctagtagggtgtatgtatcagaagtaagcaatctcttgttctcctccagtcccatctctttgagggtcttagtgttcacagtttgttacacatcttcgagtcaaatcttaatagtaaaggtacctctagccaaaggtcaacccttttggaagaagcccgaatgaaaaggattcttataaaagggaaacataagctcaggagttgaaatttatcaccaagaggttgggtgagggtgaagtgagaatgtgaggaagggcatcattgagggatctggacaatgctaattccatagagactgaatgaaagaaattgggcaacccagagccctagcctaaagcgctaaaccatagaaaaaggaccgtttatgttgttaatcaaatgtttgtgttaccagtaaggcttccagcagtaaggtatggcttccagtagtaagccttacagacaacataaacagtagtctgttagtgttacgttatactgttacggtaggctgttagtagtttaactttggacaggtccatggattttcaatttcaccctaaccccctgcgttgttcaagtgtcaactgtaatataaattggatgggggaaagccacaaaagacaattctgaattccaagtgcatttgcaggtattatgtttagtttaccattttt

SEQ ID NO: 20115 - DNA, 1285 bp, Homo sapiens
acaggttattttgcacttggggacagtttttaactttccattctcaactcctatcctagctcctggcacagaacatgtcatccaagttaggcatcatcgtcgcctgctcttggtgaagttttcttttgcgtactgcggagagatgcgctcattaccagctggcggtggagtcgctgaaacgcaaatggatttgagactgagcgactcccatctctatggttggtatgtgacccatctatcctctggaggactcagcaaggactaccagtcaccagacaactttacgcgcacgtggtcgcaaggtgaacttgctattggttaatggcagtaaagcccgcccatcagcgctggtctgctcctttaaaagaacgccatcgacgctcccctgtctttcagcgcctgcaggttccgggaggtcaggttgtattcctggcgggtcgtctggctgggtgggccccggaggtcgtggctcgggagcagggaggcgtaggggggccggcctgctgtgatgacattccaattaaagcacgtgttagactgctgacgcgggtgatgcgaactggagtctgagcctgcccgagcggagctgggagggggctggcgggcgggcgcgcgcacacccgctgatctatcactctcgttcttgtagctcccagccgaggacgtcggatgtcatcgtccttgctgctttgccaccccattcccgtcaataaagtggtttgaacccaaccctggtgtcggtgtgtgtcgttggcgacgcgctgtctttgagcccccgccgagcttcctcgtggcgccgggggtcaatctgcagcgctagagcatgtgcttgcgcataactggggccgcctggcctcccgcgggcggcctttttaaccgcgagcgacaagaagtaacctgactgtccggctgctaggctgggcaattttccagctgttttgccacgacaggcctcaatccgtaataccaaggctggaatggcgtgttaggggggcggtggctgacggggatacgcggactcttgatgcgtaaggagtgcccctctgctcccatacgttccccagcccagccttccctgagtgtatcgcgcgcgctgtgccttcgccgtgagttcgacataagtcccaggctgtcgcgtctgccatcagacgcgcagatttagttgaaggcagcgtggaatggcgtctgcagggctgttgtgtacttgacataaacagattcggtgtggaactgcattgagttaactcctgactaaagggtaatcgacctgtttacaaataaccat

SEQ ID NO: 20116 - DNA, 1043 bp, Homo sapiens
taaagtgaagacaggcctaggaaatcacaagggtattgattggggaagtgataagtgtccatgaaatctttacaattcatgttcagagattgcagtaaagacaggcataagaagttataaaagtattaatttggggaactaataaatgtccatgaaatcttcacaatccacgttcttctgccatggcttcagccggtccctctgtttggggtccctgacttctcgcaacacctggccgtattgttttattttaaagcatactaatgctacttgtttgtgatagctaaaaattagaaacacctaaatgtccattagtagggattggttagataaatcatgatagctgcatacagtggactgctctgtggctgtaaaagatgactgaatatgctctttgtgcacaatgttccgtgttgggaacaatctctagcatatgtgatgcgagaaaaatgtagtacaattataatggtaatgtgcagagtagtatgctagtgtttgtaaaaacaaaggtgtgcagaagtatttgcagttgtttgcaatcggaagaactctctagaagcatatacaagaaactcgtaatactgattgcttccaacaaagggaacctcagggttgcaggacaaagggacaagaactttcagtgtatactttttgcacttgctgaattttgaaccatgttatctattcagaagtttttttctgtaattaaatctccaaaataaagtatactatactgtattctaaaactaagcataccaaatatatttataaatcactgtattatgtgtatttcatttatgtttagaaatgaatgattattccagtaagttatttcaagcttatgaatagagggaatattgacaatgtgaaactataatcacaaaaagaggatttatactgttgatttattctttgatagttgtaaaaggagataaatgttaatcaggataagtcctgatttacatctcttaatttgatactgacaagaacaaatttttgcgaagagaataaaatactcttctgtcttaagttttttaatgcag

SEQ ID NO: 20117 - DNA, 1086 bp, Homo sapiens
ttttgaaattatttccctagtgagttatagctactggtgaaagtatgtattcttcaagtatggtggggtggaaaaagactgatggtcttaagaaaaatttcatccaagccctgatacagcctgactcagcctaaggcatgattatcttggagcttgcattatgttgacacaatcacgttttctgtcaccttgatatacctcagacatcctttacagatggagaggtataaaaatattgaatggacctgccactgacttaaaaaataaaacattgctcatacaactgtagaccctgtttttaaagcaatattcttgtttctttgttactcgaataatacatgctcattacaggtgatttggttctttctgattgcactttcactagaaccctgtttaccatggcaagttaggggtgcctcactgtccttacctttccctgcctcttacatagaaaaagtagtattcacttaggggttttttggtattgtttttatctgttctgaacaggtgaaactgaacagtattttaaagaatctgatcgaggagaacgtttggaagagccagaaagtactaaagaatctaaatcatcatggaaaagagtttcttttgggaggtagcacttagtgtctctgaatttgatgaaaacaagttacgctttttggactaagaattaaaatcacacgtaatataccaagatggcaccaaaaaaagctaatgtgaaacttctactaacttctcatattttaaactttcctgagggagttttaagaaccttgagttacatataatacctaaatctcagtatcaactatctactcatttttatatttttctttttttttcttttttgagacggagtctcattctgttgcccaggctggagtgtggtggcatgatctcgactcactgcaaactctgcttcccaggttcaagggattctcctgcctcagcctcctgagtagctgggattacaggcacgcgccaccatgcccggctaatttttatatttttagtagagatggggtttcaccatgttggtcaggctggcctcgaactcctgatctcaggtgatccacctgccttgtc

SEQ ID NO: 20118 - DNA, 1541 bp, Homo sapiens
acatgctaagcagcaaaagggagagtcttttcctttttctgcacccagcagctctccaggtcctcaggggaagggccctctggtcaggctgggccctgagtgaaggagggaacttttccaggtgctccttgtcttctgagatgttgggcccctcttgggatggagatgaagcagaatccactggtgaaatcattagacttggagacacagcacacaccttttctctaagaagtaatggtgagtagttaaacctgaagtatcagttattattcaacatacaactataaaaatgtaaatggtatgtaggagtgtttaaaattgagaagaatagagtgctaactggacatgggatttgaaattccagaatatcccactacccattaaatatgaacacttatctgaagtcgcaggcatatgggcagataagtccaaggcaaataagtgtatgcaaggttattaggtaatttgcggttccttataacctgggaagagaattatggatgcagcttatagtctggtcacgctttcagggtattctttaattgtagtttcctgaactggtggttgactcacttttttcattgtttgaaccaataagttcgtatatgcagtagcaatttttcttctaggcttcaggccagatttccaacagcctattgcttgcacatagtagacccggatatctttcaagccccaattttgagcctccaaccttgccctcctccaatcatcctactccatcctgtccaccgtggcttcataaattactaaaccagtatatggaccacaagtcttggaatgttctcccttacttttggttcctggcaaactcaccctccagtagaccaaaaagctatgcttgccattgggataggcacagaaacggaaggaccagagtcaagtgtggatactacaaaaatgtttcttgaagtaggagaatcagatggattgattgggaatggaagggatggtgattgcagaaacgggttctgtgatgtcaagtgctatgtaaaaaagatgttactgtaaaatgaattacttattttaacattataagtagagaggggaattgtgtttaagagtaatgcaattaaggcaaaggaaaaaagattcagagagatgcctggccaaggtgtttgggtttgatgtgataaaagggcttatggcagcttcctttcatattgagatttaaagtgtcagataactgtcatatacattcacaggcatctaatttaagcttcaatatatggaccatagtctttttttttttttttttttgacactaggtcttgctctgtcacccagggtggagtgcggtggcgcaatctcggctcactgcaacctctgcctcagcctctcaagcggctgggattacaagtatgtgccacatgcccagctgatttttgtatttttagtagagatggggtttcgccatattggctaagctggtcttgaactaataacctcaagtgatctgcctgccttggcctcccaaagtactgagattacaggtatgagccactgcgcttggcctggaccat

SEQ ID NO: 20119 - DNA, 1032 bp, Homo sapiens
tgttagaccttttatttttattctgttttatatctgcttctaaggaaaaaatatacagaggagaagctgttcgtaaaggaactccagaatgtagtcagccctggaagatttactctagaaaaaccacaacgcagagtctaagaggtggcctcccaaagccaaataaagcagttccaagtaagaaccacagaattgtactttatggaaaactggcaacctttgaaagcatgtgcaacattccaaggacacagcactgaaagctaacatccaccagttagccgaagaaagttttttttttttcccaatcactgccatgtggctggttttccgtagagggctaaaactcttcaataaggaagtacttcagggaggcctatatattggcacccaaggaatgccaggactgccacctgctgctccagcgttagcctcactcgtgtgcttactcactttgactgcctttttgtctatttctgggaggttggtagaatgaaagggatgctccaaggcaagcagatggcctgtccacctcctatatattgacagtgccaatgagtgtagagtcttgttacaagaaacaaagtcatgagaaatgccaggcttcctgttacacccaaagactgctggccctcctactctatcctttagaccagaaactttttcttctaagcacttgcctaccgggaaggttgaggagtcttgttttaccgtacgtagagaatctacccacaggcactgaagcggctgagcaattaggatggacttcccaggaccagcatggcatcaatccagaactattgagcttatttttatccttaccagtagttggcttactccaatcagaggagtaatgcaaattattataagtacatttagaattgttcttttcaggatcaaaaccacatcacttacataagctttgatctaccagggatgttggatgacagttcttgtccacgtctcagattaagaacatcttattttaccttgcagtgaaagtaagtgaacacagtctcctgccccttatgctgg

SEQ ID NO: 20120 - DNA, 1123 bp, Homo sapiens
agccaggcgtggtggcacatgcctatagtcccagctatttgggtagccaaggtgggagaattgcttgagcctgggaggtcaaggctgcagtgagttgtgactgccccactacactccagcctgggtgacagagcaataacctgtctcagaaaaaggaggtacattttatggtatgtcaaaacatctgaataaaactagtatttaaaaaaaaaaaaccttgggaaatacaatcagtatatacctctagttggccaaaatgatattcctcaatgactatttttacgattaaataactgacagatatttaagaaactgtttgaagaaggtttaaacattcaaaagcaaagattacgagacctaagaaactatgccaaagaaaagcgagatgaacaaaggagacgccaccaggatgaactggactccatggagaactactataaggaccaggtgggctcctggcacttgcttacgctgttgtgcttagtcctgaccacttgcccttgtggcaaaacttgcttagtctgttgacaataaaccttgtgttaactgaagtttgcactctacagattagaggaccccatttcaagattgaaatttaagatcaaataatacctgaccatagtacagtatatttccctatttccattaaaatgattttaagcctgtgaacattaagaaatgttacatttggactacaaacattaaatataatatttgttttttttcttcctataaacagttttcattgctggcagaagccatatcacaggaacatcaagaacttaaagccagagagaaatctcaggcccaggtaataattaagatagaagccaagtcatgcactgcatggcaatgtttctttcagcaagggacctcgtacattggtggttggagcaataggctgtatcatatagccccggtgtgcagtggactgtactctctaggtttgtgtaagtacactgacattttgcacaacaacaaaatcatttaatgatgcatttcttggaacatatctccatcattaagtgacacatgactaatttacatttttaggaagtagaaaaccaaatgtattatacctgtaaagggaatggagagaagactaataaggcaatccatctat

SEQ ID NO: 20121 - DNA, 1032 bp, Homo sapiens
agactgttatggagagtaatttcttttttttttttttttgggcggggacggagtctcactcttgtcgcccaggctggagtgcagtggtgcgatctcggctcactgcaatctctgcctcccagattcaagcaattctcctgcctcagcctcccaagtagttggattacaggagtgcgccaccatgcccggctaaattttgtatttttagtagagacagggtttcaccacgttggccaggctggtctcgaactcctgacctcaggtgatccgcccacctcggcctcccaaagtgctgggattacaggtgtgagccaccatgcccagccaatttctttcttttaaagctctattaagtcattagtataaagttaaaaaggcactcaaaaagcaatggtatttgcctgctttatattgtatattaaaataagtgatagtagcatttcattattactgtatccctgtcagttatgatttctgtattcattatgtacttttttactgaaagattttaaaagtaggcacaattataaactgcactagtgctttaatataaaagagagatgggtctgcaaccagtaaagtactatcatgacagctgaacattactgattatcaaatagcatagaaaccacttccatacatttcaagatgctcttcagtactcagaatgcaatgtaaaaaaaacaaattgtttgagaggaaaaaggtaggcataagcatattaccactgcacagttacaactatgactagcttgcttgtggcagttgaatttggccaaatgaaatacattaaaatacttaaaaactacacaagtagttctcaacttttttaaagcagcaaaatctccactttttttatcccatccattcctccccgccccactgcaccccatgaaagcttacttgaaattccaatatacataagaaaaatgggctgttctgggtaaagggggtggggatatggagcctaaggcccctgctcaaataccaactaggccttccccctcgctccctctcattgcccctcttctc

SEQ ID NO: 20122 - DNA, 1023 bp, Homo sapiens
cctgaattcatatacttcttttttttttttaattttttatttgagacagagtcttgctctgtcgctcaaggtggggtacagtggtgtgatcttggctcactgtaacctccgcctactgggttcaagggattctcctgcctcagcctcctaagtagctgggattacaggcgcctgccaccacacctgactaatttttttgtatttttagtagagacagggtttcgccatgttggccaggctggtcttgaacacctgacctcaagtgatctgccacacttcagcctcccaaagtggtgggattacaggtgtgagccactccacctgcctcttaattcatttacatttaaatactgacctttgttgaccttcttggtgaatcctgttgtcatagggtcaggaaaagccctgttgttagaattttagagtaagaaaggaccgtagaggctgtctagcccaggttcttgaatttatacctgtagaactggctataagagttaagtgacttgctgtaaaccaaacccccagagagtggccacttaagtctccagcccctacctcctataggatgaccctgtgctatgaacctttgtacttgtactctgtagtcttgactctcaaatgccattcccagtgagtacaagtgcccatccaatactctattttttttttttaaaaaaagaaagcatgagggaatctgcaaacaaagcagacgtgagattccttttattttctttgaaaaacggcagtgccttttagagtcaaatatgcatctaaactctaggagttttaccaggtaaataaggattgtatatttagctttcataatttataggtgaacagtctagtaacaacataaagaactcgtattaaagaatattaaaaatgcttcagacttttgatttgtattggatgagaattcatgggcaaggaagatgaccgttcacgaaattgtatattttttctctctaattttaactctgtgattctctggcaacaggctatacagttctggtgttacttagt

SEQ ID NO: 20123 - DNA, 1138 bp, Homo sapiens
cttgatttgtctccagtttaggcctttgtcctcatctgtgtaaatgagggaattagactctagtagggatagcaaacatatgacattcttgccagatactatggcagataacactcattagtcacggtcttcattcagcttcagaattcttctcaaatttagggctccagtggccattacatattggttgattggaactgacatgggagacaacaatttgccattcctaggctacatcctttccaagtcccttcctagctacagatctcctctgtgaataaagaaaaatccttggaagctctaaattaccctgctagtcagtgtttctataacatatttcccccacttcttttaattcttccctggaagtgcagcatctcagaaaaacaactatgccagtaaaaatttttcctaaaaatgttatccattgaaatattgaacatttcatccaaagcaaaccattggtcattgtggattggccttaggccagaattgagttggtttagaatgggttggggagtgggggaagccaacaatcctttttatcccttgatgttatttttctttattagcagcatgtaaaatgttaaatttttctaatttttgttgggcccaagccgatgtttattacattcaatttatgggaactctttgcagttgaaatttggtatttgagtcacgtattgctttcatggtcttttacagagctctgtgacccaagtagtcactctgttgcctcccgccccactttaaaaaaaaatctggacaggaaataacaaaatactaggagtagacttgtgtttgaccttataggaaccataattaagggtgaaatagtgggatcctcaccccagcaatgcttgatgatagtaggggtagagtgtcctattcataaatccacaggagagaaagtcatgttggaaacagcaagtcaggaggctaatgttcctaaaaaccctttgagaacagggtgtagagaagagagaaaaagccctaaggggcgggtggttgtgatttattgaaagcttactccgaatcctttgagctacctagagagccctaggattactttgagtttataggactgcaagcttttgcatgcacaactcctatttttgaaaatttgacctttaaaatg

SEQ ID NO: 20124 - DNA, 1103 bp, Homo sapiens
tttttttttttgagacagggccttgctctgtcttccgggctggagtacagtggtgcgatcgcggctcgctgtaccctcaacctcctgggctcagttgatcctcccatctcagccttccaagtagtgggacaccatgcccggctaatttttgtatttttttgtagaagatgggatttcgccccattgtctggtcttgaactcctgagctcaagtgatccgcccacattggcttctcagagtgctgggattacctggctgacagcatttgttttaaagcagtaaatgaaaatttgggtattccttttaagtttttcaaaatttcaatctgcagtttttaatctatacaaaaaactgtggtaaaagacgcctaacataaaaattacaatcttaaccacttgcaagcctacagtttggtagtgttaagtagattcaccttttgaaacagacctccagaactttttcatcttgcaaaactgaaactgtttgcctatcaaacaacagctcttggtttcctcttcctcctaggctttggcagttactattctactttgtttctatgaatttgactgctttaactaactcataaatggactcatacagtatttgtctttttgtgattcgcttgtttcacttagcgtactatcctccaggctcacccacattgtagcatgtgacaggcttcctttccttttcagggctgaataatataacattatatatatggatatgtacattgaatatcccttatctgaaatgcttgggatcagaaatggttcagattggggatttttttagattttggaatatttgcataattcttccaggttgagcatccctaatccagaaatctgaaatgctctaatgagcatttccttgagcatcatgttggtacttaaaaagtttcgaattttggagcatttcagatttcagatttttgtgttagggatcttcaacatcattctatttttttaatctgtcaatgaataaaattacagttttaaccacttgtacacatacggtttggtagtagtgttaagtatattcacctttttttgttgttgtttgagatggagtctagctctgtcgcccaggctggagtgcag

SEQ ID NO: 20125 - DNA, 1077 bp, Homo sapiens
atgaagataaccagaacacagttcccgccctcaagggactgatgagaagtagccacgttttgtaggaacgggcaaatgaagtggcaaaggaaggtggccatgggttgccataggagcgcaggtgagggatgaggaaaggaagcactaaaccaggtcagcttgtgacgtgggataaagaaggcttcttgcaggtaaagccagagctgaatttggaagatggtaggagttcacctgctaacctgggaggtgtgagtggagtgcctgcggctggacccactttgagcaattggaaagcctgtataggaaaccataggtgacatgatgccaagtggacatgacattcagggagatgataggcagaaggtgaggccaaagaagttggctggatgtatgtcagagaacgtggtttttatgcaatcattgatggaaagctcatgacgcattcagtgatgtggacggctttgtgctctctgcagaccactctgagggcaatgtggaggtggaggcagagagattaggtaagaggtttttgtgaaagttcaagtgagataaggaatgaactagggcagtggtagtaagaatgaggagaagggagaaaacctgccaaatacttaaaaaaattagcagccatatgccggttaagtgtatgagtggtgagacagagggaacattgaagataacccacagatttctggcagtggttccgtgatctgaaattaggaatataagaatagacactgagggtggacaggatcaattcccttttggacattttgggtttgatgtgtctgtagaagacacaaatggtgatgtccagttcaccttgggtttgtgagtcaaatttgacagattcagatagagacacactcttggttcttattagatgtatgcagtagttaaaactatgaaagcagatccatcccctatgttggaggggcacaaagaaaaggagcagcccaccaaggagctggagaatgagaatcggggtggaccaagagggagtcgtgtctcaggggctggggaaagtagaaaggttccagaatgagtgagtggtcaggaacttcagatgtagcaaaa

SEQ ID NO: 20126 - DNA, 1067 bp, Homo sapiens
atttggaaggacgtgcaggtgtgaaggaaggacagttcttgctgaaaaagatgggaatggcttgcagatgtctgtggattaagcagatctaaaagctatgagaaaactgcctacttgtgtgtgtgcgcgtatgtgtatagtaaatgtatatatgcatatattttatattgacattctgtagatatgtttgaatacagaaacttgtttttactccgactactgaatccagaagtaccaaataatatacagtaaacagtaaaaccaagatttaaggttgtgtcaaaaaggtacagtgattcagtcatatccatttgtcatttgttttagccttttttttttttttgagatggagtcttgctctgtcaccaggctggagtgcagtggcgcgatctcagctcactgcaacctctgcctcccgggctcaagcaattctcctgcctcagcctcctaagtagctgggacttacaggtgcatgtcaccacgcctggctaatttttgtatttttagtagagacggggtttcaccatattggccagggtggcctcgatctcctgacctcaagtgatcttccagccccagcctcctaaagtgcgggattataggcacgagccactgctcccagccggtttcagcgtttttctttgtttgtttgttttttaagagggagtctcactctgttgcccaggctggagtgcagtggcgcgatctcggctcactgcaagctccgccttctgtgttcacgccattctcctacctcagcctcctgtgtagctgggactacaggcgcccaccatcacgcccggctaatttttttttttttttgtatttttagtagagaaggggtttcaccgtgttagccagtatggtcttgatctcctgacctcgtgatcgcccacctcagcctcccaaagtgctgggattacaggcttgagccactgcacctggcctcagcattttttgagtgtttttctttctgcagttgatcagttggatcctccatatcttgcgtatatacatgggctcaattattatgttaggataatcaaataagaatactagttcaatga

SEQ ID NO: 20127 - DNA, 1051 bp, Homo sapiens
ctgcggttggaagaagacctcagcacaggtgcactttttctcttgtggattagttattaccggatgactttcatccacacacttaacactctctttgcagggacagttttggggaagggtaggcgtctgctttcacagaaggtaattaccgcaaaagctggtaccagctcatgctgttctgatgttttggttacgcaatcatgggcccctgtactagtacatttgtcttcataagctgtgctgaattattttttaaaaccgctaactgatgcgattagtaaaacattttggtttttaacttttgatgaaaatagcactgtttggaactgtgatgcaggggtttactgctgagtgaagttctagaattttgctgaaagtaacatgacctgctctgtgggtctcactctgtctctctgttaagattgttgagtgaatggaagaaaaggaagacttggtgtgtttccagtgatctataaagaaatgatgaagtgaatatgttctgtggatctctgttctctctttgactctattaaccaagtaatatcttaatttaaaatgatgaaatttaggaaattagacattgctattcatcttagaagggaacaaagtatccatgctggtctagtgaagccacatattaaatcctcttaaaacttaaactgtgccttttttccagatttgatctacgtgtggatattctaatgattgaatataataggattccattctttaatttcaaaacttttagaatacggagttagaatttatttatttatttatttatttatttatttatttatttattacctaaaacaagttcagtggaagatgctttttgattattatcacattttgggcttttgtttttggtaacatgcaggccatatatgaatgaaattttgctctttcacagaatgatatgagcatctgtttcttctaattagaatacatctacaggagaagagggattttaattttcatgttgtagcgaatgtctaagggttgaccgggtattttggaggagtagttgtactttgatcatatttgtatt

SEQ ID NO: 20128 - DNA, 1047 bp, Homo sapiens
agagctgggcatccactggggagaaaaatcagagtagggcttcctgggactcttctgggttgttctgactaacattgggttttactcaaattttctctccctgatgtaaacacgcagatattttttaaggttttaagtgtgaccatttagcttacatgcaagtcagaatactttgggttttttcagatccaatagcaggagcatccaggcttttaaagctgtgggatatgatttctgtgtatttgggctaaattaatttgtttattgataacctcagttgttatcatgctaaactgtcagaattggatgtgaagccagtgcttatgtagactttatttatgtctggcttctttctgaaaacaattcctcctcatgccctagtttcatgttgtgattttagcagaattaatctgaaatgactcaaaattatacaattaattgcattcagcttcaattacagtctgctggatgaaccaagcccactgccctctctgggcagtcacttgcatgtggcagctttgtaggtgctaaggccctgtggactccctggtcagtgtgctggcttcctggggaaagcattttggggttgacagtcccaggggcctaatgcctcagttgcagacaaatgcaggctggacctggggctgcaaaaatgccaggtaacagcaaagaccatggaggtgagtgtcatggaatttgggataaatgataaaacattcttttcttttttagtagaaaacccagatttgggtgtttagggttggagaaggcaggatctgggtaggtgtattagtctgttttcatgctactgataaagacatacccgaaactgggcaatttacaaaagaaagaggtttaatggactcacagttccatgtgtctggggaggcctcacaatcatggcggaaggtgaaaggcacatccacatggcagcagacaagagtaagagccaagcgaaacaagtttccctttctaaaaccatcagatctcatgagacttcttcactactacgagaacagtccaccatgattcaattaataactccca

SEQ ID NO: 20129 - DNA, 1046 bp, Homo sapiens
atggtgcaaaatgttctaaattttgtttcccggtttctactttgggaaactgtcttacaatctgattctcctctccctcaacttcagagagtaagagccacagtttgtggccctgtcagtgctggcattttgggactctgttatctatgagtctaatcaataccaaatgttgctgattctagaatgaaatgccttctgattgctgtttataagattctgtctgtagtgaaattaaattgacttctaacagcaagtatctctgtttggaaaataaagctcgtatgttaaatcatgtctattctaattttagtttcctttttctctaccagtttgctgttttgtggtccacaagaggtgccatgaatttgttactttttcttgtccgggtgcggataagggacccgacactgatgtaagtagtcctgaaatcatgatttgatgtcaatgtggatttctgagctttaatttttttaacgcctgtgcaactgttagttttggcacttactgttaatgggaagactcaattctcatagagcgttggcttgtagtaatgagcagatttatagcccatatgagctctggactacatcttagagaatttctcagaggagaatttcttggtagcatgtactgttccactttgggcagctgcattgactaaatccaccaaatttattgtaatagctttcacaaacacaatgcagttgttgacagattttacaatgaacatttatcacccttcagtttatttccgttccctcccctcccctccccacccctcccgtcctcttcgatggagtctcactctgttgcccaggctggagtgcagtggcacgatctcagctcactgcaacctccgccttccaggttcaagcgattttcctgcctcagcctcctgagtagctggcactatagatgtgcaccaccacgcacagctaatttttgtatttttagtagagatggggtttcatcatgttggcaggctgttcttgaactcctgacctcaagcaatccactcgtcttggcctcccaaagtgctgggatta

SEQ ID NO: 20130 - DNA, 1031 bp, Homo sapiens
ttattgtgtgtgaggtattatgggaggcaaaggttaaaaaacacagttcttgtcttcaaacaacttatccttagtgggaagtcatgtatatgaataaatattactattcaaatagtcacttcagcggataacatacataaatgcactaggtatgcattattgttcccattgtacagatgtgcaaattgaggcttgaggtagttaagtgattctcccgagtgcagtagtaagtggagcactaagctttgaactggacctctcaacttccaaacctgttctttttccacagtaccacgtgactgaacagcaaagctaacttaggggcagttttctgtcagtgaaggttccatttttgtgggtggagtctggggtcattgtgactatgagaaatcttaaaatggtaaaagaaatttggaatcatacaatcctgagacattaacagtaaaaaccttcacaaggcagattagcaacgtgaactagtaaagacaggagcatgtagggctgatgggaccgggtgggagctggcagcagtttggagacttggtttaggtccttctgaagagggtacagagtgggacttttcaggacattgggtttctggaaagatccgtttcaagtgtctacaccctaagctgaaagccagcccagagagctttttggctcatgctggggcttattcctggattctgatgagtcatgttttttagaagctgaacttctaaacttctaagccgagtcccattcagttagctggtaccttcctcaccttggctttgttttctgtttttgctgcttaatacatttccagcaggagatttaggaagggtctgtggacagagaagtagatttcccaggatctaagaaaagaaggttggtttactgtgggtattctagctgtcattataactgtgttattttatttatttacaaagggatcatgagccagaaccaatcataacaatcaaatgaacccactcactgtttcagcctctgatggtggctaagagaaaacagcaagtggggagcacccc

SEQ ID NO: 20131 - DNA, 1029 bp, Homo sapiens
ctgcctgcaaaccctggagtggggcttgacgctggggggacggcgtgtgctggttttgctgctttgggggtgaggagaggatgaataatccaaagagggacgtctcccgagagcagggaccatctcataaatagcccagagcagtcagttgggtggcgggctgccgtgcgggggctgcagttagaagcagcactcggagtggagtggggcctcccagcggggccctgctgcactttgtgagtgctctgtggtcgaaggccagctgggcctgaaggcaaaacatctggattttgcagagggttcctaggctgagacggaattcaggctgtaggctctgtgagaccttgtgtgaaacccccggttctgtctctgtcacttgtttgagtctcccatttctctgtctatcaaaagattgaatatggtggcttacaacagaggcagtcgagggtaattattagtatcatggtttgacctcgagatctggcacttcctggacctattccgttgtatatttctctgtgcactccctgagcctcccttttctcagctgagaaaatggtcacacctatggtatcccacactgtggaaaatgaccaaataagacaaggtatgtgcaagtatttggtagaaccctacagaggtaggaagtggctgttactagctgtttccactggtattctctggccatctcagagctgtttagggaccattccagctacaggggagggcaagatttagagtagactctcaaatgagtctatctgattctttggaagcacgagctctagtaagatagtttgaacaaagatgtgaccatgaggggttttgttttattttttaactagattttgatatgttgtgtgccgcttctccactgcacagattgaccaagagttagctgcagattgtggctcagtaagaaggtcttgtggtacgtgctcctgcggcccccacctcaaactcttgcctctggtgttcttgaaagaaatgaggggacctttgcccgagccaagggaaaatgcaagattt

SEQ ID NO: 20132 - DNA, 1049 bp, Homo sapiens
ttgccgctaatcctctatgttcattggcttgtggctgcatctctccagtttccgcctctgtgttcacatggccatcttccctctgtgtgtgcctgccatttccaaatctttctttccttataaaaatagcaatcattggatttaggggctaccctaatccaatattggcctcatgttacttcattacatttgcaaagaccttatttccaaataacgtcacattcacgtagacctggagtaaaggcttcgagatattgttttggggaacacaatacgacccgcagcattagttttacctcttcgtgttttgttttgttttgtttgtggttgatctagggcttgtaatgtaaatctttaatcaatcagtctactttccaacaatattataccacatcacatatggtgtaagaaccttacaacagtttacttgtatttcccctcattttgccaagcataaaatactattgctttaagctactgtagcatctcccatatctgtcccctcctctgtattcctactactactgactaaggtgagctccttgttatttcttgccttttgtcttgagtagtctggagtttcaccagtttaccttagcgatcttgcccttacctatctaccttcctttctcacttaggtatcgtgtttatgtctccagatatgcctgtgtatgttacatctctgtactttgctcacactgaacttgaacaccctcccctccacttatctttcaaacagttatttccctttcaaaaccaagacaagtcttgccttctttgaatcactcaatgcagtcagctgtggtctccctctgtgccctgctatggatgacacacaatctcagtcccaatcccaggtcctgttacgttttactggataatttgtctatcctcttcctcccaaggggataggaaccttgtgagagtcatctcctagcatctaggatgtcaccagactgataatcactgttccatgaatgtacactaaatgaagttatcaatgaatcagtaagttgagtgctggtttcactagtccttactgtttactg

SEQ ID NO: 20133 - DNA, 2014 bp, Homo sapiens
gcactcttgaacacatttcctctatggcccctttcagatctgctgatgatacctggattccttctttcagagtgacccagccccatcccagggaacgggcagatgggctctgttgcccatctcaaagttcccttactttttttcttttgaggttttatcagtccagaagtggaaagaagatggatgccattagctttagaaatattttttatgttttagggagaaagaagcagagaatatacttttagatgagcacactttaaaataccagtaagacagacttgttggaagacaggcattgtgaagaactgttgttgttttttggttttttttttttttttttttttgcaacagctttccccactttgggaaatgagaacttatgccctcctgaatgttgtatttgatgggacttagatccatgggggaattttattttattttttaggaaaaggtaacctactaagtatagttatatccttctagcatgaaatataatcatttattagaccagaactgtttgttaattcagcagtgtgtcttgaaaaagagccaccctcaaatttaaagtagaaatagattcttcattctacacctttttgacatcagatttgctttcctggtctcagtgcaggtgcccctactgtttggtgtttgggacacagcctccgagtaagtccaaggagagcttggggttaggcagtataggccatgagccccttgccagcctcccagggactttgagaggagctgtttggggcaagatgcttaatgaaaggatgttttgtaatttagagagaaaaaagaaatttatcccatagataactaaaccctcaatgggaatattagaaaatacaattgtcacattatgtaatatttgtacattttccactgcaagtaagaatgcgtcctttccttaattttaaaatatggaaaaggtcgacctttctgctaccgtaaggaaaatcaagggaaagggaggttttatacatgatatggggaacttggtataattatttagctcagtatgaaattctgccacaggaatataaggtaattaatttctctaagtatgaaatgcaatcttgaaaaactaggaaacaggtgccgaggtgacaagataggaagagaagctgagtgttgtgcagtggcaccgaacaacttctggaacattccagagcgtggctttgtagctggagagagcctcctggcttctgtgtggcgaccgagactgacccctgctggcagattgttgctaagccgtggctgttaatgaagcagggcaataaggcccttaagcaggagatcctgccaggccacaggcaggtctgtctccgaggctatgccttgtaccagcccttgatgctgttgcctgaattcccagtgggaagaaaaatggacccagcagtttttagtgttttggtctcagtttccaccatctctcccctttcccagtctgggatgtcagtgtttgctctctcctccctaccctctgttacctcaagatttcatggaaataaaaagccctgctaacatcacaaagaggctgaaaattccagatccacctcggagccagacacttgagaaatttgatgccaaggtaacctgcgtttgggaaaacatccttattaggtttatttaagaacgatttgaaaaattcctataagtgaaaatcagatgggaagaagtccaaaaatctgattcatgccatgactgtgatacaaccaagatcttcgtgagccagtggatggggaagagagataatgtacaatatttctatgtgtttcctggaaaaattcttaaacggattataaaaagcactaagtgtaaaggaaaatgttaatacattggactgcattaaataatagaccagcagaggtctggcgtggtgactcatgcctgtaatcccagaactttgggaggctgaggcaggcagatcacttgaggtcagtagttcgagactggcctggccaacacgatgaaaccccatctctagtaaaattataaaattagc

SEQ ID NO: 20134 - DNA, 1033 bp, Homo sapiens
aatttttacaattatgattgcacttctaggatttagtaaacctttaaccaccaagagactggacttgggggtgcgttgcctgtgataggatgccaagttgtttcttggcagaaacatggagattgttaaaccaggatggtaaagagtgactttgtctgtgtcagctactctgaagctatccctgagtcccctggaagacataagcatcccttcctccatgaccccaaggctccttgtgaataataccacattagagcacttgtcacgtcatggtggaattttcatgtgtacatggggtttcatgtacacacgtgtgtatgtaaagggcacagactgcattgttttattccaagcatggggccaatgtattgcagtaacaaggacaaccttttattagatggctactgatcacagtgagaaaggcattagcaccatttcacaactgaggaccaagtagtttagaattccctctggtcactcaactcataagtggacccatgagacctgtgggactccaaagctggtgcttttctcattagaacatgatttccatgttggtgggaatacaccatatgtctcataaaagagttaattatcaaaatcacaatgacattcttcacactcactgggatggccatgatcaaaaaagataatagtaagtgttgatgaggatgtggaaaaattgaaaaccttgtaacttctggaatgtacattggtacagctcctttggaagagtatttggcagtcactcaaaaagttaaagttgccataagacccaacaattcctcttctaggtatataccgaagagaatgaaaacatatgttcttacaaaaattaatacaagaagggtcatagcagcatcattcatagtagccaaatgtccatcagctgatgaatggctaagtaagtgtgatatattcgtgcagttgaacatgattaggcaacaaaaaggaatgaaatacaacacatgctgcaacatagatggacctcagagacatcctgctccgtaaaagaagccagacgcagaaagtc

SEQ ID NO: 20135 - DNA, 1027 bp, Homo sapiens
gatcacctgaggtcaagagtttgaaaccagcctggtcaacatggtaaaaccctgtctctactaaaaatacaaaaattagctgggcatggtggcaggcgcctgtaatcccagctatttgggaggctgaggcaggagaattgcttgaacccaggagatggaggttgcagtgagccaagaccacaccattgcgctccagcctgggcaacaagagcgaaaatctgtctcaaaaaaaaaaaaaaaaaaaagactggaaaaaataacaaatattttaaacacccaagagacattattaacagtttgattgacttatagttccatgtaacctaattttagggctcattctggtagtggaagaaacctgacattggtaatatataaatagagtgcacacacagaatcctgaatccttttaatgcctattaggatgggtgctaagcctgctgggagaatactgagttagtggagataactgatttacattgagaacgttctgatatttgtgattttctcatactatataaattagagattcatatgtgcaattgagaatatttcactgattctgttggaggtttttttttttttgtctttagctaagttgtatggaaactcaagagataagtacctcatttgtggtattgtgaatttttccaggggaagaaaaccttttttctcttacaaacagttgaagaaaattatcttttctgtttttaaattatcataattgggtttctccatcacagatttgtcaaactatagagtatgtataaagtcatgtttattcatttgatattctcaacataagtattctaaacttgattatgttaattcagaagaatagaacattaagcttagaattaggcaaatatatacaagttgcaattgtgtacagggattgcttatatttccaggataaaatcaaatcttatccccaaatctaattagcagctgttcattggtgtatttgacatacagcagccgacttttctcacctcaataaaccactacatcatcaacagatgcagcg

SEQ ID NO: 20136 - DNA, 1044 bp, Homo sapiens
caagcgatttcgtattctgggaaatgttcaaattctgtactacatgcctacattctgcagggttaggctgggaacatagacctttgctgagaatctgaagagaattgctaaggcaactgtgtcccatatcctcaggtataaatcttccctccctccctcccttccttccttccatttgctcatttattcacctacccattgattatcataattctatcaacttttagaatcttgagactttccccaggaaatagatgaggagggggaacccatataagtaaagttgatctcattgggcataattagctcaaatattatatactcttccctcaagaactgagaatgtagggctttatagattttaaaaaatctcatagtcttggcatttttttttctggcaatccaagtcagctggagaagctagggtcgggaaactagttttgcaaactggcagaagtagtggttctttactaagatggctcaattgagtctctctcataaactgttagattatgggcgtcagagctgtttccaaaaggaaacaaattggagtccctctcctcactctctttcgtatcatctaggtaaattgtttaaaattggtctgtgactctggcaggtgtcaaccgctccaagtgactgtaggtttggggttgccctaaagccaaatgcgtagatgatgaaagcattaagaacttctaaacatgagagcaacagctgacgccatctacacggggctgttgggttttttcctctggaaggaagtgacagttggatgcctggcactttcacatggcctattttccccatgggaagttttataaaaatatccattaaggctggtttgtatatgcaacagaagggcataatatgcccctcaaatgaatatcattatctccatccatgaactaaaagcgtttgagggatggcaatgctgtgcaaattccacaaagccacagcttttggcagagctcaactatgtggaaaccgatctcttctctctccccgtctcagtgtctcaaggaaaaacctcattaagcagac

SEQ ID NO: 20137 - DNA, 1022 bp, Homo sapiens
agagcgtgtgtgcaggcaagagcacctgtggcggaataatagtgactctagaaagtgatataggtgttcactgtactgttctttcaacttcactcccaaaaacttgggcaatgatatctatgtctgaagctttgtttcagttgatcgtatttaaatgtactctgtagaggtcattcttggctagaaggaagcccctgctgaagcagccatcagagcgcctcagcagttaagcttccctgcctccaccctcttactctatgaccctcccctgcctctgtccatggccaccaacgcctttccttttgtggatggcagaccaaaggagacaattattctgcctcaacccaacgctgtgtttccttgtggttctgcactgaggctgggcccagaagcctggttcatgaagagcactcacctggcccctggcccctggcccccgttaaacaggtgagtcactgaccatttccttagagccacctgggactggctgcatgggacttgccatgacacagccggccagactgccacaggcaggttctgggaactgtacacttacatggatgggcaggggctgcctgggattgggagccactagtggtctatgtccccaagagcttgtatatgacccccattttccaaatagctcaggcagaaaagaaaatgtgagttaaacagctaaaggagtcatatgtaggtatgtgtacatatgtgtaagaagtaggctggacatggtgactcattcctgtagtcccagctactcaggaagctgaggcaggaggatctcttgagcccaggagtttgagacaagtctgggcaacagggcaagacctcgtctacacaaaaagaaaaaataaccagatgtggtggtgtgcacttgtagtcccagctactcaggaggctgaggcagaaggatcgcttgaacccaggagttcgaggtaacagggatctatgatggcgccactgcatgccagcctaggtgacagagcaaaaccccatctccaaaaaaatagtagttgtgggca

SEQ ID NO: 20138 - DNA, 1073 bp, Homo sapiens
tccctgctccccagagaacgtctttttaacattcagctgcagttacctttaggaagcctctcctcacattttatgccatgcctgaaaccaaccactttctctccatgccctttataacatgtattatgagatttcacctgtgtgtttatttacatgttgatctccttccactatgtcataagtcctttgaggtcagagatagtgtcttatctcctgtacccagcccagtgcctcaaatttgtaccaaatgtgtgtctgttgagccgatgatgatgatgatggaagtacacaatacagcatagaaactgactcaggcttttactgcactcctcaccccaaatccaggtgactctccccattttagccctacatctggatcaagttaaaatgatcctgttttaacccaattcataaagccacatggctctgggatcctttagagaaacatctatcagctaagaaaaaggttgcatcttctcagagacacatgattatttacattccgactgtggtacctcgtcctgactgatctgtggctcatcttaatgtcagatatgtacagacttgcagcatgccatcccacagattgttattcatgcttggttctctgtgcggggactccaacagagcttttcactctgggtgcttagtcactagatgtgcgtgggaggcagcaagattggaacaaggggcaaagagttgccagtgtcatttccttcatgcagcatttgtctttgttgtaaagcaccctggtatccatgctcatggtgacatagtttctctttctcctgcttaagataccccaagtccccagattctttatagggtcatcagtcatctgtcgtctttgacttcagtgactgctgccaggaggaagcactcttaaagataggctttgaatgcttacatccctggaagaggagaagcaaattatttctggggcctctttcaagattaccccattagcatacagagacattgatattgactgagcaggtcattcttgtgcaggattttaattgcttctaattataggattatcatttaagcacaagattaattgctgtgaaatt

SEQ ID NO: 20139 - DNA, 1058 bp, Homo sapiens
gcattcgagcaggaaaaggaataggtttccaaaaatgattaagtgcccaaagttctcgaacaatgctatgtcatggctgttgcagtgcgcactgggccttcctctaagccgggcatcagacgcaagtgtgccatcagctagctccctggtgggagaaaaacattgttgcagatggaaaaacttaaggtcattggtggggaatcctcatgtaagcctggagatttagcaattggggagaacgcggtacaagggcaaaccgcctttccaggaggtgtttagcaggtgagacaaggcgtgcaccaccaagattagcgatcctaacagatgtgtcaattatcaacagacaaatctgggaaacagggaaaaatttggttggctgcaaagaaaatcacacaccgggatactagaggtgaatattatgtggtatgaaaagaaccaagcacttcgcagtttccacatctggcaaagtgccaacacgtcagggtcccacgtttctccttggagaatggctcagttgccatgacaacggaggccctctcgctgcctgtgaatttattttaaccgtggcaacagccaaagtgggtgtgtccatgaaaatatttcttgttaagaaaacgattgaatgtgttgcccttacattttgctctgctgaatacatacttcattcaccaccattgtatggctgcaaaatttccttttcctgtgctgcctggcatagcaagcattgtggaagagcctgaatagtgatttaattctagtgctcttgagattcttaattgtcgctgttgtgatagattaagaagatacagacattgtactgaaatctaactgcaaatgaggatgagtgatttgagaacctgcgtgatacagggcaagggtcatcgaactgcaatccacagcccagaccccagcggctgcctgtcttcaccattaaggctttattggaacaccttccctcctttactcacttttgcagctttcgagctacaatggcagagttggagagttacaacagagacagtatttggcccacaaagccacaaatatttactatctgg

SEQ ID NO: 20140 - DNA, 1136 bp, Homo sapiens
aatttctggacagagggctattgtattagaggtcagaaatttctatttttatggtctgtctgattttccatatagtgtatattcattatataaaattcaaacatagcagagtgtctatggtattaagttaaaccctttgaaattgctgttaaggtgggttagactgtcacactgtcacagcttagcagctgcaaacttttaacctattagaaaatgaacgtctccagccatccagcccctcatagatatacaatgtaagtcatttgtcacaaccaccctcaattttaatttgaaaaaacccctaatagggagctgaatgtggagagcttctcacattacacatggatagcttcagacacagatgtttttacacatgtaccataacccccatgtaggcgaatttgggtttgcaatattcagattcattttgtatgatttgctttacagaatgccactgcaggagctctttgaattgttaatagcttcagtgattgcaaactattgtgacttttcaagaatgtatctgtggtataaagtgagacgtgtcagtcatcagtaaattttcaaatgaggagggaacactgcctggtctcacagcctggtcttccaagtggcatcacaatgccaaacttgaaccaaacgtgaatatgccattttttgaggaacctaaaaatcctggattctgggttgttgaatcatagccaataaactgtgaggtactttagtcccattttgaaaaaaagagcatgctacagcttctgcatttaatgtcacttcattctattcacaacattacatattgtagttcccatttttatttccttttaaaaatttgtgccattttattaagtcagggtcttttcctactgcagtcttaacccagaccccttagagggcttcagcaggctttccggaagtcagggtggatagctagagccaagacccattgcctctcctgccccccttaggagggtgtgggagcccacggggatgtgcctcaacctcacaacaggtcatgagctcctgcaaagcccatttgtagcctcacacatctctgcaggtcacaggtttctggtctgtgagttagcccacagaactctagcccaggcagcatgcagttgctcattgaatcccag

SEQ ID NO: 20141 - DNA, 1031 bp, Homo sapiens
ttgcatctcagtctcccccacaccctatcacagaatgaaaggggctgtgagcaatgtgtttgccacacaaggctccagtgggggcacactgcaatcccagattccacccagagtccgtgtcattcatgttttgtaacatctttaccaatgcctgatttctcttgggtccgttgcattcattgaagtttgaccaaatgggtaggaatatcaaaaacgacaaaggagttcattcctgaatccagagatcagaaagagggaggtagcttattaataacgttccttcgtccctcagagatcgatcacatgccttttacatgctagtgcttgcttcgcagggtgtaccctatgtctgtcctgcctcctcgctgaggaagggcctcatgcccactagttccctggatcctcacaacagcctgggaaggtggatggtcacatcaccatcttaccttcgcagagagatgcactgagtttgccaaagctatatacattggggctcttgatctctggccacatccttctcccctctgtgtccccactttcccttgggtgccgacatcgcctggtctcagggagttcagcagtcacacgctgactggttgggtctgaccaccccagtgccctcttcccctttatctctgtcccatacccatcgtgtggtacgtcacatcccagagggcaaaagcctcagtcggcaaaaggcgcgggtgacctttggaggtggagacagtgcgcacccagcccagttttgctcacaaggtataaatgttacttttagtggccatgtgctgttgggtggcctacagctctgaggccatggacagccacacctgcccgctgtcacagactgctgtagaggctgcccttccaatggaggtggtgatccacctgcctgcctcatccctgaggagtggcgggaggctgcctgcagtcatcttttactcattcacttggcgttcatgcagtcatgctaggtgccccctcagccctttagcctctttgcttcttcttgctccctgctcagctccaagatg

SEQ ID NO: 20142 - DNA, 1049 bp, Homo sapiens
tggacgatgattcatgaatgccataaagacaggactaaaaggaaagggtcagacctgtgcactctttttgcagaacacattgataaatttagagcaggacagacatccagcctagacgtctatctgtgcagccctaaattcatcaacgtgtcctgtgaaatggggagagaacattttactttgctttgctcatccttttagggactcagtccttttattagattttttccagaaattccttcttgctcatctttgcatggttagtgagtatcaagagaagcacagatgatctctcattaaaggagcacacatcccagcctctgggagccctgactgttgattcacttgaattcttccaggcaataagcattgatgaatcaggttccaaaaggatgttcccaatgccgactctactgagctgtcacacttgctccaaatgcttttgccttgtgacttctgccgcttctccattctccgctctcacatacggctgctcctgcctgattccctagtttggcttcatgtctgccctcactctgatcttaggacctactcagcctcacacagtagtcttgttatatccctgagtttctcagcagcaggtactgttgacatcttgagccagtcattctttggggcgggggcagtgtcctgggccttgcaggatgttccacaccatccctggcctctgcccccagatgccaggcttgtcccacccaagtcatgatgaccaaaaatgggttccctgggggaagaatcatccctggttgagaaccactggtataaccagaggagggctatttctttggctgttgtcatctgaatgtggaattccaaggaaagttggtttctgtttgtttaactgatgaattaagtacagactcccgattaatttctaggaagaaacagcatgcccttatttatttttcaaagagcctttctccgtgtttgcaaatggcctgtgcacatagggtgatgtgaattgcagattctgcctctgctgaccttggctttgaggtactttgtgctcttccaaggaaatacaccat

SEQ ID NO: 20143 - DNA, 1056 bp, Homo sapiens
ggcttttcagaaaataggtgtcaagtccactttataagaacctttttttctaaaataagataaaaggtggctttgcattttctgattaaacgactgtgtctttgtcacctctgcttaactttaggagtatccattcctgtgattgtagacttttgttgatattcttcctggaagaatatcattcttttcttgaagggttggtttactagaatattcaaaatcaatcatgaaggcagttactattttgagtctaaaggttttctaaaaattaacctcacatcccttctgttagggtctttcagaatatcttttataaacagaagcatttgaagtcattgcttttgctacatgatttgtgtgtgtgaaggacataccacgtttaaatcattaattgaaaaacatcatataagccccaactttgtttggaggaagagacggaggttgaggtttttccttctgtataagcacctactgacaaaatgtagaggccattcaaccgtcaaacaccatttggttatatcgcagaggagacggatgtgtaaattactgcattgctttttttttcagtttgtataacctctaatctccgtttgcatgatacgctttgttagaaacattaattgtagtttggaagcaagtgtgtatgaataaagataatgatcattcctttgtgtagttggccttatttacatccctttgcggtatggcaattatttttcctccagtgttcaaaaaatagcatttgacttcagacacactccgcagaacactttcatctcttcacctgtttttcaggcatgaccctccatttatagtggcattttttttttttttttttttttttttttacttaaaaaatatatcttgctttgaatcaaagcccagacagtgactgggatggcgttctggcaggtcctgcgttcattcattcatgcactgttcacagagcccctgcttagggccaggagttgtgtcaggccctggagaagaagaggctggcatggcccctgcctgcacggagcttacagtcttctgccccaaactgcaagggatgcc

SEQ ID NO: 20144 - DNA, 1032 bp, Homo sapiens
ccaggtggacgttaccccgcaaacccgaagcctggaggagaggagggaggggatttgcggcttccacttgtcaccccagcgggggagggcggcgctgggtggggcggcggactccgggtgggcttttcgggggcgcccagaatccagactgttggggatcactatgagccaaagggagtgggtgcgccccctccctccaaataagaaaatgaataaaccaaacccaagagcccccggcgcgcgctgtagctggggtttggggggcatcccgtcctggccgtgggcccagcctcccctccccgccctctgcggtcaggtaggggtgcgaggaggagccctgcgccctcgggatctgcacgccccgagccccgcgggaggaacctctgagcccttaggggaggtccctgcggggcccgacttctcgccgtcgccgcgggcttgggcgcagctcccggcacgtccgcccttcgaggctcgggacccggctgtgtcctttcgcaaaccgcctggctcggaaactttctgcgtctcttgtttcttccgccgcggggagcggcgcgcgagccgggagcggcgggggctgcgacgcggccacaggagggcgctccagcacgtggtgccggggccgcggctgccggctgggggcgccgggcgcggggcgggggctcgtcctccaagcgcggctctgctgtccttctcccgatcctgcgaagccgcgagctccagtattcaggaagtggtgactcagataggattattccggccccggcttccctttcttccccttcttcctccccacctttgtggtgattccacgactgctgagcgtctctgtccagggacagcgagggagcccaaagccaagcaaggcaacgtgaaactcactagtgtggtttggtgtggcaacacacatgaaatcagccacccagaccgtctttatatttaaatctggtgcctcgaaactatcagatatgtttttgagccactacttggtgagaggggcgatgtgctttgggagagaaaaagatgcat

SEQ ID NO: 20145 - DNA, 1090 bp, Homo sapiens
ccctcagaaatggtcacagcttattcaagtcctaaacccttgctatgggcaagggttgacaaactttttttttcttttctttcttcttcctgtcttctttcttttcctctctctttctctcactctttctctcccttcccctccctccctccctccttccttccttctctctcattcgctatttcttttctttctttcttttttttttagagacagggtcttgctctgtcacccgggctggagtgcagtggcgcaatcatgcctcattgcaactttgcactcctgggctcaagcgatcttcctgcctccacctcccaagtagctgggaccagaggcacacaccaccacgcttggctaattaaaaaaaaattttttttttaaagagatggggtctcactgtgttgcccaggctggtctcaaactcctagccttacgtgatcctttcacctcagcctcccagagtgctgggattacaggtgcaagccaccatgccaggcagcaaagtttttcttaaaaggccagaaagtaaatatttttgcctttgccgatcataaggtctatgtcacaaccactcaactctgccattgtagctcaaaagcaaccatagacaatagggtcaaggagtgagtgtgactgtgtttcaataaaactttatttaacacataggcctccctcctgcaatcccttttgctgatcacttcatagaccatcatacacttcctgtgctctttggagcttgaaaatcatactttggagtaagaaattcttttgaatataaattacatatgtttggctgtggagaaataggaatgcttttacactgttggtgggaaggtaaattcgttccaccattgtggaagacagtatggggattcctcaagactctagaaccagaaataccatttgacccagcaatcccattactgggtatatgccctaagaaatataaatcattctactataaagacacatgcacatgtatgtttattgtggcacgatttacaagagcaaacacatggaatcaacccaaatgcccatcaacgatagactggataaagaaaatgtggtacatatacaccatggaatacta

SEQ ID NO: 20146 - DNA, 1049 bp, Homo sapiens
ttgaccaggctggtctcaaactcctgaccttaagtgatccatccgcctcagcatcccaaagtgctgggattacagagtgagccaccgcacctggcctcatgtcttgtcttacctacggctttccccctctttctgcgttttctccaccctttaccgctgagtcagcctctgtataccattattcatgatgggaactcagcttgtctgacagttggttttaaggcacaattagaaaatattccttgatagtacaatgagtttgcagtttttaagttgtggttttggccagagatattaataagggtttggacgttgagtggaatactaagaataagaaaggggatgtgcttaaaatacatctcatgtgccttctgtttaattacacggtaatttgtaaaagagactggtttctgtggccttgaatactaatatagactttccctcaccacagcttatcttcgagtcataaacacagaggcatgcatagttcacacatctccatgtattttctgtttccaaggaagatatgatcactctgaagaaccaaaagatgagtcactctgaaaacttttcttcctttgtcttaatgtcatgactgtcttaacaattgactgtgtttatttcagcaacatttatctttagtctcttctctttggctcagtcagatgttttcagtttcacccagcacggaccacagccatattacctcctatatcccagtggataacttctgcaggaaaacttcagctacttgacactcttgggaaacgagctgggtgttcctgataagaaaggtttaccagaatcttgtaaagatggtttctctaataatagctaacatatttataagcgtgctatgttttagaacatgggtgtccaaacttttggcttccttgggccacattggaagaattgtcttggaccacatataaaatacactaacactggccgggtgcggtggctcacgcctgtaatcccagcactttgggaggccaaggcaggtggatcacgaggtcaggagatggagaccatcctggctaacacggtga

SEQ ID NO: 20147 - DNA, 1046 bp, Homo sapiens
tttgtatttttagtagagatggggtttcaccatgttggccagactggtctcgaactgctgacctcaagtgatccacctgcctcggccttccaaaatgctgggattacagacgtgagccaccgctcccagctgggtatctacatttttaaagctttggtgtatcttgcaaagttgtctcctaggaaagttgtatagttagtcattcccagatgatgtatggagcactgttgtttcaatgcccctcttatatttttacttggttactgggtttgtgaacttaaaaaattaaaacattcttattttaaaaacaattcaaatatataaaacatgtacagataataatgaaacgtacacttatgtacccagcagaaagattaaatcggtgttaacattttgctgtatttgcatttgttacttttaaaaaacacattccagattcaaaaacaagtctattattatcatcccattttacaagtgaggaaactggctcaaaaactttaagtaacttgtctaattcttaagaaccagtaagtgggctgtaaagaaccagttgatcctaatgatgcttttaccttaggcttttactgatattaatatagcccttccagtcttcttcccctttttggtcagtttctgtctggtacatgttttctaatgtctctacttttaagttttgtatgttgttgtattttagatgggcctcttgtaaatagcttatagctaaattaagaaaaaaatctcgagtctgggtttttaaaccagctattaataacctgttttttaaccagctatttcagtctgtttgcatttatagcaattgttgatgttttttgaattatttgtcttatttcatgctttctatttcccatactttttctgttttttctccatttcctgtctcctactgaattgagttttaccaggttttctctttttctctctactagctttgttatcctaaaaatattcaatgtgtatacttaaatagcagtcagaaattaccctatcacctcccccacccagtttttttcttatttagtgtttta

SEQ ID NO: 20148 - DNA, 1046 bp, Homo sapiens
ctttccctgaattatttattatttccaaaaaagtaacaggtttgttgaacaagtaattggcaacacagatgtagatcaaggtttgtcagcaggcaacaagtttcactactgtttccccttttgtgcatgttgataaccaggatggcattgtctaggagcgggggtctgcctgataccactgcttagggagtcattgacccatcctgttgctgacttggagagctggaaccttagttggtttccaggttgtctaacgatgaaacatgaatggaaattcatccaaaaatgtaattaatgaatgtaggcttgtaaatatctcgcagacagaatgacttaatacaggtgcccagaaagagggaacatctttgtttgcagggatatgttaagaatagagacctagaagaaaaataatttgacagatatgtaaaggtttatgtataagaatgttctctgcagtgctgtttatgacagaatttttgcaaggagacaactcaacgtccaacaatgaaagactggttagataaattctggtagatccaagcagtgaaatattatatcaccactgtaatgatatatatgtatttttgatctggaaaaatgtcaacatattaaataaaagatgatattaagtgagagagtctataaaccgatatggcttatttctgtaggaaaatacatgtatgtatttttttttgtaggcatagggaaaagtctagaaggaactaccccaaaatattaatagtggttatttaggggtagtaggatccagcatgacttttcttctgtctcacatattttgccatcattttcactgtaagtatgcttatgttatgaatctcagttaatacgactttctttctcatagaatgccatacctcttcttggaacaaagcacacatgggtagaaggctaagctgctgtaacaagagatccaacaacattgtgacttaaagaaataaatctcaggctgggtactgtggctcatgcctgtaatcccagcaatttgggaggctgaggtgggcggagcacctgacatcaggagttcg

SEQ ID NO: 20149 - DNA, 1031 bp, Homo sapiens
ttttgccttgaatcagattcttcaactctggagtttaggttagtagaacccaaaaatatgttgttttatgcacaaagcctcgcaaagtcaagtggtagattttgacctcttctttaacctaccctgaatgtagtcccttaaaacatgatggaatccacatttggtatttccctgctatttcatgagatgcaacaaaatgtttcaagggagacagtaggaaccatttggtgctttggtgatcttttcaggaaaatctggtttcggaagccccataaggcgagaattattgcaaataaggcccagatttgaaaattgctgttttgcaaattgtgcttattctaggaataatgatttctacagctgggaagaactttaaaaattgggtgaaccagttgcctgctttgacagatgaggtactgcaatgcagagaggtcaagctagttgctggggtcacctagctcatttgtgacaaaactaggaaccgtgggtctgactcagtcctctgccctgccgccctgtaccacagtaggcctctctatattatgccgcttggtagtcacccaccttgcttcctaccatcaaaaggaacttctggtagaaactcctttcacagcctcctgatctgcaggagtgatgaatttagcctgggatgaactgggagtggcagagccatctttaaaccccaggtcctttctggatgctttgtttgcagaagagctgcagagatcatgagggacatttcttgattcatattaatcagaaactcatttggggcagaatttgaacttgtagccaattttataaggaagtttcacagctaaaacctctctgtgttgtaaaaggaggtcatactaccctaaaatgtcacaaaacattttacttcttccaaaagtacaagtaatcctggtatccagataaagaagttttaatttgtttttattggtttaccttgcctcagagttctgagtgttggattttcactgtgacaacaaaaataaaatatttcctgcttattgtaaagcggtcaaaga

SEQ ID NO: 20150 - DNA, 1051 bp, Homo sapiens
ccttccttttcaggagtgaataatattccattgtacggatataccatgttttgttcatccatccatccctccgtggatggacatgggttgtttccaccttttgactattgtgaatagtactgccatgaacacagttatacaaatacctgtttgagcctctgctttctgttctttggggtactttcccagaattggaattgatgggtcatacggtaacagactccttttttaaaaaagaaaagtatcttgagaacttgggagagccaccctaggagtacttactgggctggattgtttgctccgtctccttttgcctccaggtacagcccataggcctctgtcctcacagatgtggtatggaagagtggccctgttccagggtgagatcaccagtgtagaccttctcagtttgaccctacatctgatgaacccccaaaagcacagagaggatctcagaatgaactaaagatcatgggctataaatgactccttccttctccttttcttccttggatgacaaagattgtggtcactatacagttatggtggcctcaagtctggtaaatcaatgatgtttcatgttagctgctcacgggattcaccttgtggcttattgatgtccagaccccgcctctgatcccgcctctagagattctgatttcattggtttgagtcctggcctcagcatggggacttttgaaagcttccaggcgagtctaatatgcagccagggttctgtagcacccaagtgaattactgaacccgaaccttttctcaatccctttcatgctgtctgttgtctttttggttatttcttttttctttttcttttttaatttgagatggagtctcgctctgtcccaggctagagtgcagtgataggatcttggctcactgaaacctcttcctgccaggttctagcaatcctcccaccttagcctcccgagtagctggtattacaggtgtgcaccaccacgcccggctaatttttgtatttttagtagagacggggtttcaccatgttggccaggctggtctcgaacctcaagtg

SEQ ID NO: 20151 - DNA, 1013 bp, Homo sapiens
cttcatggctcagcgacaacaaagtaataggtcattggctggcttacgtcgataggaattttactcttaagaagggccagtgtatagctgactctacatataatgtgtaatcagataatccaatagagaggaattgtccaaatagttttagtacctttctgatcatctgactcagtaggctaggagacaatctgtcatctgagccatagttcttgagatttaaaaagtctgtccagtgactgcaatctgattatgaataaactattttaactattcattcttgctgaaactgaagtgtacacaatagcacactgttggcatgctgaggcaaaacattgggttcttttgtgttctaccttcaaaacaatctgtttgcatttgaaatataagtgtttaagctttttaggagttagtgtaataagagaatgtgaatatgttgggaaattttcagatgccattaataattgtaattttgttgttaaattaacaaggactttaggataagcctcttgatgttttttgctttaaattgaaagcatgtctgtcaaattgcaagtctcccttcagtttctatatatcacccaggagagggtctctgagttggtgttgtacctgtaccactcacatgtagctcaagtgtaatttgtagtgtttacattcaagctgggatcttgattggttaaattaatccacataccactgccactgctgaaggaccaggtgttggaatacacagcattacagactataagcaaagcaaacaaaagttgatccttacatatgccatccttctgtgtcattttgtggctgttctgtgtttttcttcctagttatttattattgttaataacttactttttcttacattctgttgtaaataaaatacaaagcaatcttctttgcaagcgtagcttcctctctctctctctcgctcgccctctctctctctctctctctctcctctttagctattctcgagggaatgttagtaattgttcacctgtgggttgatg

SEQ ID NO: 20152 - DNA, 1034 bp, Homo sapiens
ccttcacggtgtaccttttagtcttccttttctttttcatttcgttattacccagactaattcattctctttatcagcatactcaattttttttgtgccttcctaattcttcttgaattggtttttatttttattttgcattgatctttcaaaaacacttcttgctatcaccaccatgctcataactatgtcataaagaaataaaaatggcgaatatactagtcaccatcatactagcctgcaggtatttgaaacattagtaagcctacatttgaggattggattcttggcaacatttcacatcatggaaatccactggacatgaacaccttgaaatgtgggaactaatagtgtacctttggactccgtgacttctgaacaggattctcatcgccaccttgcctccttacccaccaactccccgccagacttcctagtcagtcatgaagaacacgattgctccttgccagtgcaggatagcagaccccagccttcactagaaaactcagactctgtcgtttagcataagtcccttcacagcctagacctgtccaccttttccaaccttttctcccaaattctgagcaagaaccctctgctttattcaggcagtgctctctattgaccacacatttgatatgcccatcctcacctgtgtactttgttctgtgtttctcctgcttattattaacataggagcaaggctcaatgcctataatcccagcactttgggaggcctaggcaggcagatcacctgaggggagctcgagccagcctgaccaacatggagaaaccccgtctctattaaaaatacaaaattagctgggtgtggtggcgcatgcctgtaatcccagctactcagggggctgaggcaggaggatcgcttgaacctgggaggtggaggtcgcagtgagccaagatcacaccattgcactccagcctgggcaacaagagcgaaactccgtctcaaaaaaaaaaaagataggagctcctgccaggcacagtggctcacgcctgtaatcccagcacctggg

SEQ ID NO: 20153 - DNA, 1051 bp, Homo sapiens
atataaaattcttcttgaaagttgcttactttgcctcgtttttaatactgagcacttatacagtgagtgataaggctttattgagtcataccttagaagagaaaaaaatttgcttatgtttttgataactttttttgtagctctggtattatggagaacatttgtttatgctacatggaaaatctctaactgtgattccatacaagtgtgaagtgtcatcattagcaggtgctcttggaaaactcaagcatagtcaagatccaggtagaaacttacttctgtttgttttattaatacaaaccgttttattaacttgtagtttcgtacagattcccacagccttctatttgtaaagctttttcttaattttgaaatttaccgctgtttattgaaacttgtgaacaggccaggcacggtgtctcacccctgtaatcccagcacttaaggaggcagaggcgggaggatagcttgagcccgggagttcaagaccagcctgggcaacatagtaagaccctgtactccacagaaaatggaaaacaaaaaaaaaaaagtttgaaacttgtgaacagtccaaattgcaggttctgtggcaagctgaagagctacactgtgttttgaatgccagtgttctgattttaggggcaatgggagaacccccaaacaaaatcagtaatacctctgccctcccttgtttaccgatggcctcatctgttagcttaacgttgttggacatacagccttttcactatattatgattttcttatctgaggttatcagaattacatggacttcaaagcctctcttaaattgtatgagtggttttttttaaattgttctttgattgtttagttgggcaaaaagtaagtcaaaacattccagaaattgtgcattttgcattttcttaggaactcatgtcgtgtcccattttgtaaactgggagacacctcaaggatgtggacttgggttccagaactcagagcagtcaagaagaattgtaagtttcgtagttgaaattgaaacattagtgcaaatgttgaaaaacagaaaaag

SEQ ID NO: 20154 - DNA, 1050 bp, Homo sapiens
gcagtgagctgagatcgcgccactgcactccagtctgggcaacaagcaaaactctgtcccaaaaaaaaaaagcggggggaataagagaatacagattagtgaaaaaatattcccagagaatcccatggtagtccctctttaaaaataatacttatgctgggtgcggtggctcatgcctgtaatcccaacactttgagaggctgaggcgggtggatcacctgaggtcgggagttcaagaccagcctgaccaacatggagaaaccccgtctctactaaaaatacaaaattagccaggtgtggtggcatatgcctgtaatctcagctacctgggaggctgaggcaggagaatcacttgaacccgggagttggaggttgcggtgagccaagatggcaccattgcactccagcctgggcgacaagagtgatactccgtctcaaaaaaaaaaaaaaacttatttaaaaaacagtaagaaacatttaaaaataatgtatttaccctcctacaaaggcatgtctatagttccttgtctttggacatgtaagaattggaggcaaagaaatgtggacttggagaaatctggggccagcttgctctccgcaggctcaagatcaaccatcccacatagaagcagtaaaaacaataaattgttttggtttggtaatatgttattctaacgaaggattttaaacacttaagttggctattcttcatataaaaaataacttctttttttttttccttttcaagaaggcaaggtctcgctcaaccacactggagtgcagtgggaatcatagtttggggcagacatgaatcctgccctgaagcagtcctccccacttaccctcccaagtagctgggactgctggtacatgccaccacaccacatgaaaatacaatttttttttccttttttgagacggagtctcgctctgtctcccaggctagaatgcagtggcacgatctcggctcactgcaacctccgcctccagggttcaagtgattctcctgcctcagcctcctgagtagctgggactacaggcacaagccac

SEQ ID NO: 20155 - DNA, 1033 bp, Homo sapiens
accccatctctacaaaaattgctaaaaagtagctgggtatgatggtgcatctgtaatcccagcaactctggatgattgcagctactctgggaggttgaggcaggaggatcacttcagcccaggtgtttggaggctccagtgagctatgaattgtgccattgcattcctactccagcctgggtgacatagcaagatcccatctctaaaattttttttaattagaataaattttttaaaagccagaaatgagcctttttatatttcgtagaaattgctccatctctaaacaaaaatgttcagattttatttataaagacttatttttctcataactgtttatttatggactttgtaaagtgaattaacctgaagttaaatttaaaatcttaacttccttttcctattcatcttcagattatggattggatatgtctacttctggatgcaaattttactgttgttgtaatgatgccagaagcaaagaggctactgataaatctttacaagcttgtaaaatctcaggtttgtgattatttgatatatactgattttatttgtacccaagtatcacctgaattacaattattcttaaaatttgtccttaaataacttactcatggaagatttgtttctatgtagacattatggtaaaagttactctgaaactcttttctttagatatctgtttattctgagctcaacaagattgaagtaagttttcgggagctacagaaattaaatcaagaaaagaataatagaggattatattcaattgaagtgctggagctcttctgatattatcaattctccttcatagacattttataaagctcttttatgtgaactcttgcttcatccaggcaagaacggtgttttgtttgcgaccatctcagtgtcaagagaaacgtgtcagtgagtacctggaccatcacttaactgatgctccggggtaggactgcaggtttcacatgaacctgttctaggctgtggacattggtgtggagaggttctgcaattttttaaaaatatgtaa

SEQ ID NO: 20156 - DNA, 1021 bp, Homo sapiens
cctccaccagtggagagcagctgcctcatgtgatgggaagcagcagcagggccaagccagccctggagccttgggccagagcagggcaacaggactgatggtgttgttaacatggcattgtccatcaggctgcggacaaagggactaaaagagctaatttgcatgccgtaacaccccctctggggcttcagggtcatgggcacccctgcctgggtgccaccgtgttcccctcctctggatgccagagtccaccatgggagtcacttgtgacatgcctggtccagctacaagccccacatggagcccattcccctgccagcacttggaacggccagccagaccccacactccctcactcacacaccccgtcctgccaggggctaagcacacagtagtggcagctatgggacctgcactggagtgcaagccaggtgcagcccagcaggctgagtagacagggtgtctcctgcagcaagcccaggcctgagcaaggcctgggcaggggagttgccagctggaaatctccagctggcaaagtgactaagaaaaatcctgcatcaaaggtgggaggatctcttgagcacaggagtttgagaccagcctgggtaaccccgtctctacaaaaaataaaaaattagctggtcccagtggtgcctacctgtagtcccagccacttgggaggctgaggtgggaagatggcatgagcccaggagttccaggctgcagagagtggcatgccaccacactccagcctgtgtgacagagtgagagcctgtctcaaaaaaaataaaagagtttgatttctttgatgttaagtgtcctcaatgaacaggagcctgacccactttgttggttttcttttcttttcttttttttttttttgagacagtctcgctctgtcaccatgccagagtgtagtggcgcaatcttggctcactgcagcctctgcctcccaggttcaagcgattctcctgcctcagcctcccgagtagccaggactacaggtgcatgccaccatgcc

SEQ ID NO: 20157 - DNA, 1042 bp, Homo sapiens
gaggccagaagtttatgaccagcacgggcaacatagggagaccccatctctacaaaaaataaagaaagaaaaactaaggctcggcacactggctcatgcctataatcccagcactttgggaggccagggtggacagatcacctgaggccaggagtttgagaccagcctggccgacatggtaaaaccccatctctactaaaaatacaaaaaattagctgggcgtgatggcgcaaacctgtagtcccagctgcttgagaggatgaggcatgagactcacttgaaccctggaggcggaggttgcagtgagccgagattgcaccactgcactccagcctgggtgacagagtgagactctgtctaaaaaaataaataaataaataaataaaaattaattaattcaataaataaaaagtttccacgtactgatccatgctataacatggatgaatctagaaaacatgacgctgaatgaaagaagccagtttaaaaaggctgtgtgttgtatgactctagttgtatgaaatgttcagaagaggcaaattcatagagacagaaagcaggttaggggttgccaggggctggggctgcagcgggcaggcggtgggtcggggaaggatggggagtgactgctgaaagggtttggggttttccttctggggtgaggaaaaggttctggaactggataatgatgatagttgcacaacattgagtgtactaaatatcactgaattgtacacattaaaatggcaacttttgttttgtgaattttaccatttttttttctaaaaaaggtttaatgacttcttgttgcggtcttaaaatagaagccagggccgggaatggtggcttatgcccataagctgtgctttgggaggcggaggtgggtggattgcttgaggtcaggagttcgagaccagcctgggcaacatggcaaaaccctgtctctacaaaaaattagccaagtgtggtggcatgcgcccgtggtcccagctactagggaggctgaggtgggaggatcacttgtaccctggaggtggaggat

SEQ ID NO: 20158 - DNA, 1019 bp, Homo sapiens
acctgctgatctgaaagatagcgttaattccacactgtatttcatagatgggatgacgtggccagaggtgctgcgggtgtactgtgagagtgataaggagtaccatcacgttcttccttaccaagaggcagaggactacccatatggaccagtagagaacaagatcaaagttctacagtttctagtcgatcagtttcttacaacaaatattgctcgagaggaattgatgtctgaaggggtgatacagtatgatgaccattgtagggtttgtcacaaacttggggatttgctttgctgtgagacatgttcagcagtataccatttggaatgtgtgaagccacctcttgaggaggtgccagaggacgagtggcagtgtgaagtctgtgtagcacacaaggtgcctggtgtgactgactgtgttgctgaaatccaaaaaaataaaccatatattcgacatgaacctattggatatgatagaagtcggaggaaatactggttcttgaaccgaagactcataatgtaagtaaatctggtcttaattttttgtatgcatttaaaattagactagtttccttcgtgattgatgtagcagagctatgctgttgatgtggtataaacctttgtaacttaatagttatacagttaaataatttcttaattgaaggaatatgtgcattaaaatagcttttaagaaggtaaaggaaacatatatgaaagaagcaaaattccattgttttttgatgcctaggctaggaaatagaatgtttctagttgggactgggcacagcagctcacgcctgtaatcccagcactttgggaggccaaggtgggtggatcacctgaggttgagagttcgagaccagcctggccaatatggtgaaaccccacctctactgaaaatacaaaacttagccaggtgtggtggcgcacacctgtaatcccagctactcaggaggctgagacaggagaattgtttgaacctgggaggcaggggctgcagtgagctgagatcacaccac

SEQ ID NO: 20159 - DNA, 1088 bp, Homo sapiens
tataaagttagctgggtatcgtggcacatgtctgtaagtcctaactacttgggaggctgaggcaggagaattgcttgagcctaggagtctgagtacgcagtgaaccacgatggtgccactgcactctagcccgggcgacagagtgagaccctgtctctaaaataaatttattttattctaaaataattctaaatacattcttctcatcatattgttacattgatgatcttaaagttggttgagatgtagctgaaactggcttccacaaagtactctcacgtggttctgaattttgaggttatttttctttgtgtcatgttttttagatatcatttctcagagtaaatcaagtttgagtgagacctgcagggttttcttgtgagcgcctatattgagttttagtgcataagctttgttttaagttttcactgggtagatgaactgtcagataagtggcattatgtctaacatataaagtatttccccccatttttaaacagagaagaagatacagaaaatgaaaatgaaaagaaaatttggtattacagcacaaaggtccaacttgcagaattaattgactgtctagacaaagattattgggaagcagaactctgcaaaattctagaagaaatgcgtgaagaaatccaccgacacatggacataactgaagacctgaccaataaggctcggggcagtaacaaatcctttctggcggcagctaatggtgagaggggcattttctcattttatttttgttaagtctgagctaaaccgttggtatgaaatcactgcaaaatttgaaaatagattaaaattttcaagtacagtcgtgcattgcttaatgatggggatacattctgaaaaatgtgtcatttgacaatgtcatcattgtatgaacatcatagagtacacttacacaaaccatacacctaggttatacggcatagcctgttgctgctaggctgcaaacctgtacgtcatgtgactgtactgaatcccataagcagttgtagcacaatggcaggtatttgtgtatctaactatatctaaacatttaaaaaggtaatacgtataatcttatgtgatca

SEQ ID NO: 20160 - DNA, 1034 bp, Homo sapiens
atctgagggtaaaaaaattacttgattaaaaagaaatatttcattagtgttatttatgaaatctccagttttacttgcaaaatgaaagtgaaatattgcaagcagctacctaatttaatatttctaaagagatcaggataccgtcccctcttataacgtgtgtaacaattgtaatgagttttatgtattagtgaatttgctataatgttatattcatgtctctatttatacttcccattaagttgccatttccctatgaaaaagaactattctttaatattataccagagtatacacttttgtatgtgataaaatgttcatttttatattaattacttaagcattcttaatatattattaaatattcttaaatactctctgaattacctattgcagcaatatccgagaatctacttgctttaaaatggccgttcaatggaagcaggttttttgtgattatttagtagttgactgaatgtggccatttgccctgaagcaattttaaagaatatctttgaagttttgttgtgcattttgctgtagagccaacagaagttggggataaaggtaactctgtgtcagcaaatcttggcgacaacacaacaaatgcaacttcagaagagactagtccctctgaagggaggagccctgtggggtgtctctcagaaacccccgatagcagcaacatggcagagaagaaggtggcatctgagctcccccaggatgtgccaggtacagagggcagcgtatcaatgcctctgtaatggggggaatccttcccttttgtagtaaaagccgaatgtcacctaaaaccttaaactatgtgttcattcatgctgcttgcttacagtgccatccccatttgctaaattgtcacctaacatttggagtttgataaatgtcctcgcagttagtgcttgaaactcatcataattttcatgcttcttaaacttcatttagctgtttttgtttaatagatttatttttatattttatcaccagaccatagtggcagatattttggttttaattac

SEQ ID NO: 20161 - DNA, 1132 bp, Homo sapiens
aaagttgggcaatatttggggaaagattgctactatcacttttaaaagttaaaaagttaatctcttaatacctattcagtttcaactgtctttggcaagaatactttataaagaatgtgctggttaattgatattgtatcccatcaaaaggctcatggtatatggtttttgtaccttcagagatgcctagattgatcaacgagtttaggtggtgagattgcaagattctctgttaacctctcactcattaataatctttccataatcaaggttttttttttttttttttttttttttgagagacagagtctcgctctgtcacccaggctggagtgcagtggtgcgatcttatggcttactgcaacctccgcctcccaggttcaagcgattctcctgccttagcctcccgagtagccaggactatagacgcgcgccaccacatctggctaatttttgtatttatagtagagatggggtttcacatgttggccaggctggtcttgaacttctgaccttgtgatctgcccacctcggcctcccaaagtgctgagactgcaggtgtgagccacccacctggcccagaatcagttatttatttggagactgtaatatggagttttggggattttgggtttttgttttttttttttttttttttttttttgagacagggtcttgctctgtcacccaggctggagtgcagtggcacaatctcagctcactgcaacctccgcctcctgagtagctgggattacaggcgcccacaaccacacccagctaatttttgtatttttagtagagacaggatttcgccatgttggccaggctggtctcgaactcctgacctcaggtgatccgcccacttcagcctcccaaagtggtagaattacaggcgtgagctaccgtgctggccggacttcttgctttttagcagaataaaatgtttgaggcttatgttacacagtacctatcctgacttggaatcatttttttttcctccaagaagtcctggttccttttaatgggaaatgatatttagagaccacagtctagactcagggatactttttgttgttgggctctcactgtccctatgcttttttggtgggtagtgttatgaaagacatatttt

SEQ ID NO: 20162 - DNA, 1004 bp, Homo sapiens
cgccactgcactccagcctgggtgatagagccagacgttgtctaaaaaaaaaaaaaaaaaaagaaaagaaaaaagggctgggcttggtggctcacgcctataatcccagcgctttgggaggcccaggtgggcggatcacagatcaggagttcgagaccagcctggccattatagtgaaaccctgtctctactaaaaatacaaacaaaattagccgggcgtgatgatgggcgcctgtagtctcagctgctcaggaggctgaggcaggagaatcgcttgaacccaggaggcagaggttgcagtgagctgagatcacgccactgcacttcagcctgggcgacagagcgagactccatctaaaataataataataataataatcctttgtgtagttatgcacaacttgatacacagttcatttgtttcagtttaatttttagggattgtatttctataataacttttaattttttgaaaatgtagagcatttacattattataaattgaaaactatgtaacgggagatattcagagaattttgactttcattccttctctctctaggtaaccatgtctttcttttctaagtagccatttttattggtttttggttattcttgaatgttgcttgtttgttttgttttgtttgtgtgtgttttttgagacagagtatcactctgttgcccaggctggagtgcagtggcacggtcttggctcacagcaacctccgcccccctgggttcaagcagttcttctgcctcagcctcccaggtagctgggattacaggcgcctgccgctgtgcccagctaatttttgtatttttagtagagacggggtttcaccatgttggccaggctggtctcgaactcctgagctcatgttccacctgccttggcctcccaaagtactgcgattacaggcgtgaaccaccgcgcccggctcgttttgttttttataaataaaagtaaaatctgtttataaatttgtatttcctcctcttctcac

SEQ ID NO: 20163 - DNA, 1056 bp, Homo sapiens
gcaccactgcactccagcctgggcgacaagagcgaaactccatctcaaaaaaaagaaaaaaaacctccatgatctgagacccaagagaaaattgatagtctgaccaactgctttgctaccacacatccaaagtgacttgctttccagcctggggtggcaagatgctcagtaccctctctccattttgacttattatttaaggagggcaaagaggtgtgttctttctgtttaaaacaaaaatctgtggaatgtgagataattttaattaccataccttaaaaatcggggctggaaatttgtagaaatttctagacctacttttgaattgtattttctttatttccaaaactgtagtagtgtgatattttggagtcaaaatcttaaaatattctaccagattatttagaatttactggttttgatagaaatacatcaaacttgcttaaaaagggaattttattgacatacactattgagaagtccagtgttggtgacagcctcaggtgcattgttggatctagggagccaaatgaggttatcgaggctacttctgattttgccgtttcatatttttctgtttatttcttctttgtgatgggcttattgtttgctgttatcaacggttttctccatgttgtgggaataaaagtggccaacttctgatttacacccttcctgctcattagtacaaaaagcaaagaccccttctccatctctggattttaaaaactggaaaaggatgctgagaggattgagccaaagagccagtcctgggacagtcactgtggccagctagtggtgtgctttgtctggccacgctgggtcctgctgctcgctccaaaggggcaacatacttgatttgcagccctggcagaatcatatgattaaagtgtgggagggcggtggtgagggaagtatctccccaaaggaaagaaggggtatggaacaggtaaaattaacagatgtttacaaaattgtcttaattattttccccaaaatgcatagccagttttcccaatcctagtttttctctatttacttaaaatgccatcttta

SEQ ID NO: 20164 - DNA, 1032 bp, Homo sapiens
cctacacagataattatctaaattccctagtggaaaattcatgacatttatgtttataagctcaaaactatttggtatttaaacagaatttcagtggaaatctttcaaaaacttaaacctttttatacagaaatccatattgaatatataaggcaacactttgttagtttgctttttgagttattattatgtttgttacttgtaagtttgtagcagctcttcctgttttcaaacagatgagtttttaaacagataacccagcatgtttcaattttttgtggaataatagatgactcacagtaaagttacaacatattttcttttaagtaaaaaacttaaggaataatgatacttgctttgccattcaagggcctttttttatctgtttactttgtggatcttacacatacaccagatacgagttttggtgaaataaggtggttataattatttacttattgtcagcaattgctttgtggcctattcatttgacagtaggtgatttcaaatcggagaagtccaacggggagctaagtgaatctcctggagctggaaaaggagcatctggctcaactcgaatcatcaccagattgcggaatccagatagcaaacttagtcagctgaagagccagcaggtggcagccgctgcacatgaagcaaataaattatttaaggagggcaaagaggtgtgttctttctgtttaaaacaaaaatctgtggaatgtgagataattttaattaccacaccttaaaaataggggctggaaatttgtagaaatttgtagacctatttttgaattatattttctctgtttccgaaactgtagtagttaacaagactgaaagtattaggctttataagcatagttgcgtacccaaatttcagtcaaggcataaaaatgctataaatggctgatacactttcttactacatgaacagttttattctacatataattctaaagaattaaagccttctttacacatatgagtaggctattttgggttttatggtttattaaagaactgtag

SEQ ID NO: 20165 - DNA, 1033 bp, Homo sapiens
tttgtattctttggtcttcgttttttggaaggaaaaaactctggaaacaaagtattctttaacagtgacctggtttaataaattatggcatatccatgcaatggaatattttttaattccttaaaaaaatctgtatattttgataaggaaagatcttctagtgtaattatccattgattaaaaactgtggttgtgtgtgcactaaaaagtacatatgtgtgaatatgtaatggactatgtaaagagatacataaatgttggtatataccatatatacatgaaatgttttagaaataaatcataattatttcttatggaaaggatatagtatttcttgtttttgcctttttgtactctttatcttttcttgttaaggaattgtacaactacaactaagttttgtcagttggggttgtctggtttgtaggattataacagtctgctttgttttcctaatttttcagtattgcatttttatcttttctgtttatttttccaagttaacattgtctttctatgcatgaattcttaggttacaccggatgacatcaattgaaagagaagaaaaggagaaagtcaaaaaaaaagagaagaaacaggaagaagaagaaacgatgcagcaagcgacatgggtaaaatacacatttccagttaagcatcaggtaatttttacaacaaccctttaaaatagtgttagccatttctgagacttttattctgaaactttgaatacttactaattttatttttgacatagtctttgtattttatttatttatttatttattttgagacagagtctcgctctgttgcccagattggagtgcagtggcacaatcttggctcactacagcctccgcctcctgggttcaaacgattctcctgcctcagcctcccaagtagctgggattataggcgtgcaccaccacgcctggctaatttttgtatttttagtagagatggggtttcaccatgttagccaggtgagtcttggaactcctgacctcaggtgatcctcctgacttggcctccc

SEQ ID NO: 20166 - DNA, 1063 bp, Homo sapiens
gggcgtggtggctcatgcctgtaatctcagcactttgggaggctgaggtgggcggatcacctgaagtcaggagttcaagaccagcctggccaacattgcgaaaccctgtctctactgaaaattcaaaaataagccaggcatggtggcacatgcctataatcccagctacttgggaggctgaagcatgagaattgcttgaacccaggaggcggaggttgcagtgaactgagatcatgccactgcactccagcctgggcaacagagtgagactccatctcaaaaaaaaaaatatatatatataaattcctcctttcagagtaaaaattacatttatataaatgtctttgtttcacagatgtgaaggagctcttagattctgacagtgataaaccctgcaaggaagaaccaatggaagtagacgatgacatgaaaacagagtcacatgtaaattgtcaggagagttctcaagtagatgtggtcaatgttagtgagggttttcatctaaggactagttacaaaaagaaaacaaaatcatccaaactagatggacttcttgaaaggagaattaaacagtttacactggaagaaaaacagcgactcgaaaaaatcaagttggagggtggaattaagggtataggaaagacttctacaaattcttcaaaaaatctctctgaatcaccagtaataacgaaagcaaaagaagggtgtcagagtgactcgatgagacaagaacagagcccaaatgcaaataatgatcaacctgaggacttgattcagggatgttcagaaagtgattcctcagttcttagaatgagtgatcctagtcataccacaaacaaactttatccaaaagatcgagtgttagatgatgtctccattcggagcccagaaacaaaatgtccgaaacaaaattccattgaaaatgacatagaagaaaaagtctctgaccttgccagtagaggccaggaacccagtaagagtaaaacaaaaggaaatgattttttcatcgatgactctaaactagccagtgcagatgatattggtactttgatctgtaagaaca

SEQ ID NO: 20167 - DNA, 1027 bp, Homo sapiens
ctttttcatgtccttgtctttatcttttcacccctgtaattgagaaggatggaacataaacactgaaaacatgagagttctgggaacatctttagaaatcagaatcagtcatagttgcagttagattttgctaggaccctcaaattatttcagcgagttactgagccgttttcatttccccttaggcttcgtttttgtgtgtcttttaatatttttccaatttctttaaaaatcacacttttttggtttcctttatattaattacaatcagctagaaaaaaaagtaagtactctctataaaggaattcatttattaatacaaccagtcatagtttgtttgaccaagttttttataactcatcttttgatttgaaataaaatatcatcactccattacacattcaatagagacagctgaaaagtacaatttctctgcagggcctgcaatgaaggatttgcagaatcctgcagggaatcaaggaactcttcattacaattcatggatttataggattactctgcacttttctgctttcttcattgagagcggtcccaaaatgtatccttgactgtcctgcaggtaacttctttcccactggaaaagttactatgtacaaatactttaattaaagtgacctggcagttgtggaggccgacctttctgctctttgtattctaaaatggagggtaggctcaactgggaagcactcttctctgaactctccaggagagttaggcactggtcccaatcaagtgttgctcggggccctgttctgcacagctgaatttctggagctgaatttcatgtcttagtatgcactatggtacagtttatattacttgatttcacattttttaatgggaggaaataccttccattaaacattcattttaaactgatacagccttcaaatgtatgctaacgtcttaatttgccaaaacatatttgagagaagcataatcctttctgtctaatggaggcatgggtaaatatgtaaattgatcatgactttagaatgcatttttt

SEQ ID NO: 20168 - DNA, 1859 bp, Homo sapiens
agacagaaaatcaaggagatagcaaagaaacatataaaacaaaattacaaatgcagtgccagatgttcatttattactcttaatgagaatacattaaaactaccattttaaaagttgaagactggccaggctaggtgactctcccctgtaatcccactttggaaggccaagacaggagtatcacttgagcccaggagttcaagaccagcctggccaacatggcaaaatgccatctctactaaaaatattaaaaaattagctgggcgtggtgcctcatgcacctgtaatcccagctacttgggaggccgaggtggaagaatcgcttgaaaccaggaggcagaggttgcagtgagccaagatcatgccactgcactccagcttgggcaacagagtgagaccctgtctcaaaaaagaaaaaaaagttgaaaatgttaaagatttttttttaaaccctatacatttatgagaaatttagctaaaatcaaattactacaaaagctacaaaagataaaaaaactagagatggacacaggcacatgaaataaaggccataaaaagaaagaaaagacaaggatggccctactgatactgggcagaataaaattcaatgtttaataaaaaggaaaaatttatgaaaaagagtcattttttattggcttaaaggtaaaaaagatcagccaggcgcagttgctcatgcctgtaatcccagcactttgggaagccaaggcaggccagatcacctgaggtcaggagtttgagaccatcctggccaacatggggaaaccctatctctactaaaaatacaaaaattagctgggtgtggaggtgggcgcctgtaatcccagctactctactcgggaggctgaggcaggagagtcgcttgaacccaggaggcggaggttgcagtgagccgagattgtgccactgtactccagcctgggcaaaaagagtgagactccgtctgaaggaaaaaaaaaaaaaggtaaagatcatggccaggcacagtagctaaagcctgtaatcccaaaactttgggaggctgaggcaagaggatcacttgaagccaggagttggagaccagtctgggcaacatagggagaccccatctctacaaaaaataaaaatttagccaggcatcctggagcacgcctgtagtcccagctacttggtaggctgagatgggaggattgcttgagcccagacattggaggctgcagtgaagtatgctcatgctactgcactccagcctgggagacggagcacgacctgtttaaaaaaaaagaaaaaaagaaaaaaaagattgcagttaaggtataatcttgaatctttatgaattaagtaacatgtcatattaaagtgtaaaaagcaaaactatttgaaatcaaggagaaattaataggagcatagtaagccacaattaaactatgtatcaacttttgtgccttctgaaatacacattcatttaaaatatttgtaggcttaacccaggcgcagtggctcatgcctgtaatcccagcactccaggaggccgagatgggcagatcacctgaagtcaggagtttgagaccagcctggccaacatggtgaaaccccatctctactaaaaatataaaaattagccaggcctggtggtgggcaccttgggaggctgaggcaagagaattgctcgaactcaggaggtggaggttgccgtgagctgagaccctgccattgcactccaacgtgggcaacaagagtgaaactccatctcagaaaaaagaaaaaaaaaataataattcataggctttttggtggaaaagtagttcttgagtcatagataaaaccttgataaattccaaaaaataaaatgtgtataggcc

SEQ ID NO: 20169 - DNA, 1033 bp, Homo sapiens
acattttatttttaaggagacttcctctcacccccatggattgagaagcagtatgattagattatagttgttcttggccgggcatggtggctcatgcctgtaatcccagcactttgggaggccaaggtgggcggatcacaaggtcaggagatcagaccatcctggctaacacggtgaaaccccgtctctactaaaaatacaaaaaattagctgggcgtggtggcgggcgcctgtagtcctagctactccggaggttgaggcaggagaatggcatgaacccgggaggcagagcttgcagtgagccgagatggcgccactgcactccaacctgggcgagagtgtgagactccatcgcaaaaaaaaaaaaaaaaaaaaaagattatagttattcttttccttatgaaaaacaaaaaggggactgggcgtggtggctaacacctgtaatcccagcacttggggaggctgaggcgggtggatcacaaggtcaggagttcgagaccagactggccaaaaggatgaaaccccatctctctactaaaaatacaaaaaattagccaggtgcggtggggcgcaccagtaatcccaactactagggaggctgaggtaggagaatagcttgaacccgggaggcggaggttgcagtgagccaagatcgagccacggcactctagcccaggtgacagtgtgagactctgtctcagaaaaaaaagaaaaacgggatcgagatggtttgcaggattagcaagtgatagagatatattgaagacatagaaagccagtgtggttgctcacacctataatcccagcactgtgggaggccaaggcaggaggatcacttgagtcaatgagttagagaccaacctgggcagcaaagtgagaccccatctctacaaaaaaattttttaaaaatcagccaggtacggtggtgcacacctgtaatcccagctactaaggaggctgaggcaggagaatctcttgaacccgggaggcagaggttgcagtgagccaagatcgagccacggcactctagccc

SEQ ID NO: 20170 - DNA, 1023 bp, Homo sapiens
cttgagcccaggagtttgagaccagcctgggcaacatggggaaaccccatccctacagaaaatacaaaaaattagccgggcatggtggcatgtgcctgtagtcccagctacccaggaggctgaggtaggaggatcacctgagccctggaggttgaggctgcagtgagctgtgattgcgccactgcactccagactgtgctacagagtgagaccttgtttcaaaacaaaacaaaacaaaacaaaattacaatgtaaagagttgtataagggcaacttgctgttgcctttttagggaatttctattgttttccagatttaaggcagaatgaaacataactagccagttattgaaaattgatttatttatggattttcagaatttcctttgccatattttcccattttatgatctccagcattgtttgcacattgttttcattactgcactttgttataattcatcatttataccatccatattctttcttttcttacagattgtgatatctttagtctgaatttttaactggaatcagaactggatgttggggtcactctttgttttattgtacctcgtgattacctaattcaaaattgccccccaaaaagtcagattagttaatataattttttaatgttaaagatgtatcgtggtaaaaaatttactctagcagccatgttgaacaatgtatttaaaaattgtaaactcttggaatactgtatttatctgctatttcaatataaagtcctttgacttagtcctggtaactgtacagtaatttggtttactaatgaaagttgtgaataaaactgtgaaactagaagggagactttctggactttaatagaaaaatgtgattttaagattgctttttcttttgttttagcgtaatttttccctttatattcccctcatcaatgtaaataaacacacacacacacacacacacacacacacacacacacctttcaccacaatggtaatgcttctgtaaatgcctctatttgtccagttggctgaaa

SEQ ID NO: 20171 - DNA, 1134 bp, Homo sapiens
cgaggagctgggattacaggcatccgccaccatgcccagctaatttttctatttttagtagagatgtggtttcaccatgttgtccaggctggtctcgaactcctgaccttgagatccacccacctcggtctcccaaagtgctgggattacaggagtgagccaccgcgcctggcctagcctttagacatttaaaaattcaactttgatttgactggcctgagttatgcccgagttagttttttatcttaaagaaaactaactcaggaagtcttcattagctatgtactctatcaccaatagttcatgtaataatgctgctgactcccaaaaagcgattctagtaaaatttataagtttggacaaaactcatttttgaaaaatacttgaaaaatccctcagtagtgctttaccatggaacactcagaacctctcaaccctttattacctgtatgccccataattggaacaaataatagtatcagatattgtaatgttgggctattgcttcttggctcctgtgattccctagcgtcccatcctggatgtcctttaggtgcacagtgctactactgtgtgccatggacagtgtcaggacacattctgagcttcctgagtgcatcactgtgaggccaaataggctgttctctctccagtgaagattcctttctgtctttaggcagtcatcttcatctatgcattagtggtgtctctgttcaccatgcttcatataaactaaagtacagcctgatcttccgaaaaaatactcttttgtggactcaagtataaaatcaatatttaatttagctagtgattaaaccatttttttgttgttgttgtttgttttttgagatggagtttcgcttctgttgcccaggctggcatgcagtggtgtgatctcggctcactgcaacctccacctcccgggttcaagcgattctcctgtctcagcctcccaagtagctgggactacaggcacccaccaccacgcccggctaattttgtatttttagtagatacgggggtttctccatgttggtcaggctggtctcgaactcccaccctcaggtgatccgctggcctcggcctcccaaagtgctgggattaccagcatgagccaccacacccggccaatta

SEQ ID NO: 20172 - DNA, 1060 bp, Homo sapiens
agattcaagaacaagggaaaagacagtacagtgagtaccttctgttgctttcctgtggtggtatttaaatgggaagacatttggaaaggggtgaaaactgaggtatttaaaaaaaaaatgccctcacttagcaacaaaaactggtgtgataggtgaaacggcatgttatcttttctcaaggaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccaggtaaaaaatgtattttagtttatgagttacgtgaaatccagaaaatcagtagggacttttcttagaaattcaagtaaacttaacatttctagtcttaacggttttaactatctgtgaacatctttttctctgtttgcaattagtaattgtcttctttcctgccttctgtaatccactgaagctgatttaggatcttcctttagctctgaccttccttcagacttccctgcatttctagctactagctgggtaccttggcctgaccagtgtgtccagagccagccagtttctggtttatttcttcttttttttttttttcccccgagatggagtcttgctctgttgctcaggctggagtgcagcagcacaatcggctcactgcaacctctgcctcatgggttcaagcaattctcctgccacagcctcctgagtagctgggattatgggtgcgcatcaccacgcttggctagtttttgtatttttttgtttttgtttctttgagacagagttttgctctgtcgcccaggctagcgtgcagtggtgcgatctccgctcactgcaagctccatctcccgggttcacgccattctcctgcctcagcctcctaagtagctgggactacaggcgcccgcaccctgtctggctaattttttgtatttttagtagagacggtgtttcaacatgttagccaggatggtctcgatctcctgacctcgtgatccacccgcctcagcctcccaaa

SEQ ID NO: 20173 - DNA, 1050 bp, Homo sapiens
tactgatggtccaaatgaacgaattggcatggtggtgaaaacaggagttgtgccccaacttgtgaagcttctaggagcttctgaattgccaattgtggtaagttatttacttgtagattaggacataagtataagaagcatgatcagggctgggcgtggtagtggtggctcacacctgtgtaatcccagcactttgggagaccaaggcaggtggatcacctgaggtcaggagttcgagaccagcctggccaacattgtgaaagcccatctctactaaaaatacaaagaaattatctggacatggtggcacgtgtctgtaatctcaactactcgggaggctaaggcaggagaattgcttgaatctgggaggcagaggctgcagtgacccgaaatcgtgccattatactccagtctctcaaaaaaaaaaaaaaaagcataatcagttgatagtaatattgaaatattgcctatttcaggccatgatgggcctcttgttaaaacttttagggtatagaatttctaaagtgctggggaaaaaataaccagcatcaacatattttttttttttcagactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggtaacgaagtcttaggatttaatcaagtcatttttagtatttatagaaagctgtgcttgataagcttcttcacgtgcaagaatcttgggttctactaggagtcctttgctgaacaatacccagtaaccccttttacttaaggttggatagaaccttggtactttcagtcattgtttttgtgaaaaagtactcttggaatcttatttgtgcaactgttctgaaataaaaccatttccttatgttta

SEQ ID NO: 20174 - DNA, 1136 bp, Homo sapiens
gatagagaagtaggccaaactcatcaccatgctctgggcctaatacagtcttttcctattgaaaagtgacggttggggaagaaaaaaatctcggcctgtttgtgttactgtagtagctagcatttatgaattggcaaagtttcagagaccctccctcctctatgtcaaatactataatatcatacaggattaaaggtgtaatatgcagatcaagacctagagattaaatacagacttcaggtaggctgctgcttggaatacttatatcatttttatacttattttttaatatatttccaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttttcttgacttcaccatgcctatgtgttgctttctaatttggggcctttaatgttgctagtgaaaggtaacctgtccaaactgatgggattaaccagaggtagtcctggctgcagtttttgcagaagaatgaataacattttctggaaaccctcagccagtgtctccttaagtctccttggccagggagatgggctaaacaccgtaaatttaatcataaatctctgctggagctacaaatggaattctttcctcccaaacttcaaggccgaatggggttccaaggtaaatcacggctgcacatgggcctcatctgggaaagtacccagttctgtttcgttgatgaggggcatgagggtccaccatgtgtcttttttaaaaatgtaattcccaagggctcctgtacagtgtaggttgatagccactactctttgagatggtgtctcgctctgtcacccaggcgaaaccctgtctctagtaaaaatacaaaaaattagct

SEQ ID NO: 20175 - DNA, 1086 bp, Homo sapiens
tgcccgcgtgaaaaacctttactccccgccgccggccaccgctgccagggtcacacaccttaaactcacgtctctctgaggaggggagacaggttgacttccggtgtgcctgtctgatccgacggcttgggctcattgtacactgtgttttggaagtgtctgattgtagggtggcatgtttgggggttgttccttataggccgcagaacttgtgtctcacttctagctccagacctgctttaaaaacacacttttttttttggtgggggggcggagagggtacaattctaagtatgtcctcatacaaattttcgaacaaactttctgttactctccccaccctcccccttcctttttcgaaatggaaaagagtgtccagaggggttgctagatagaagactacacttacaaagtgtttatgattccaggtgcatgaaatctttaacattacaggtacgttttgcttacagtgccatttttggtattcttacagggacatgccacccccgttttaggagaacttgtatttggtttgagaaggaattggaatcacggcgttatcctaccttcaccatttacccctgataaattgtccacgtttatatttgggtgagtggtgagaaagataattttccgtagaggatttgtgtgtgcgtgcacatgtactaataaactgtaattatatttgcccacactagactttgagatttatttggactaattttgcagttgaatgcttgtgtgtcacatcccagtccactggctaaacttgctggatgaaaacttgcagtgaatttggtatttgagaatttagcttgaatgtgtatgttggctgcaatttagataatgtattaccttcatgacagttttcctttccctagggaaaattgccaggaatcattaactgagtggttcttaatggaaaacctggattggaggatacttatattcccccccaccccccattcagtgtccttatattgggaggagtcagtggaaacctttgtaggggatctttgttgctttggagtttatctgttgctgttactatctggagtcagtgattgtggaaagaacatgtgatcc

SEQ ID NO: 20176 - DNA, 1030 bp, Homo sapiens
gcccaggctggagtgcaatggtgcgatcttggctcactgcaacctccgcctcctgggttcaagcaattctcctgcctcagcctcccaggtagctgggattataggcctgcaccaccacacctagctaattttgtatttttagtagagacggggtttcgccatgttggtcaggctggtcttgaactcccaactgttacgtatgtccatgtgaggagagtccaccaacaggctttgtgtgagcaacaaggttgtttatttcacttgggtgcaagtggactgagtccacaaagagagtcagcaaagggagatggggtggagcagctttataggatttgggtaggtggtggaaaattacagttaaaggtagttatctcttgcagacagggcaggggtcacaaggtgcaggatggggagatcatgagactcattgtccaggggaggaatgtcacaaggccagttgattagttggggtggggcaggaacaaatcaccatggtggaatgtcatcagtgaaggcaggaactggctgtttcatttttttggtggttcttcagttgctccaggccacctggacgaatacctgcagatcacaggggttaacgatggcttagcttgggctcagcggcctgacattgaggatccttctttatctttttctgatgcccttctatgagaatgaatatgttttggaagaaaatgcaattaagattatccatcacaacaaccactatctccaaatctgtattcattgcttctattcattattcattataagtctcatctacctgatgaaataacttttttgaagataggaattgtatgctgtttaacagtgctttgattcttccacagttcagtcatccttgatatcttgcaggggattggttctaggataccgctgccacgccataccagaatctgtggatgctcagtcccttacatataatggtgcagtatttgcgtataaccaacacacatccccccatatactttattgacttagagacaagatcaccctctgttgctcagcc

SEQ ID NO: 20177 - DNA, 1048 bp, Homo sapiens
ttttcagtttgtgggttctgaatccacacaaagacaggattgctttctgaaaacctgaattaattattgtccttacctcaataagacaaaaaattagaatcaaaatcgttagtattacagtcacagatatcaccaagattagtttgttgttatagccatatcctggaacttctttcgtgagctaaaaaaaaaaaaaaagaaaaaaggaaagaacaattaaaaaaagagtgaaagctaacttttcaaaaccccagtattctagttgagtagcttacaggttcttttttttttttttttgagacagggtctcactctgtcacccaggctggagtacagtggtgtgatcacagttcactgcagactcgacctccctgggctcaggtgatcctcccacctcagcctctagagtagctggaattataggcacaagtcaccacacccaactaatttttgtattttttgtgaagatagggtttcactatattggtcaagctggtctcaaactcctctgacttcaagtgatctacccacctcggcctcccaaagtgctgggtttacaggcgtgagctaccatgcccagcctacagttcatcctgtgcactaatctgtttcactctctaaatgaacaaagtgggagatcactgtcatggccaaagttacatggccaagacaaactatggcctgggagtcccaggttctcctgtgtgggcactttcctggcatatgctaaatgatgggaaagtctgggtctcatgtttctgtgtggtcctcacctcactcgacttctgctctttctgttcactctgggcttctgtgctttcattaatatagttcttagttttccactggtctgtatcccattctgccttggacgcctttacttcctgctgctcactgagaagcctcatcaggaggcctgtcctggagatgagcttggcacaggtcacttgcacataggtctcggagcagtccgtcttcaaggtccagataacatgagaaatgaagcttctcacatcgttgttggggatgacggactgtagttgatggg

SEQ ID NO: 20178 - DNA, 1102 bp, Homo sapiens
cacacgggagtgagttttatgaaagtggtatttttttctggaatgtactactcgtttagcagccttcatattttttaactctagcctttgcattttctaaaattaaaatggtgtaggctaagtctttcaatctgtctatgacctgaggtagggcttttgcagttgtggaaggcagaaggcatgcccatggagaagggtttcagcaaagaggagactgttggcttctgctcttgggtgaatgaaggcttggtgtagacggcgtttcccgctacgttctcgggcccctgcactatgtgaggctattccagctcccttggggctggactcccgagccttttttctttggcagcattctccccaaatgcctgggcaccctgttccctcctgatactctgctttcccaccgctttgaagggccttttctggatgctccttgggcccatgaggactctgttcactctctgcaggtttttgcctacactttgaacctttgccaggctgttttcctgtggttggacagtttctaatttcttttcaaatatttggcatttaaatttgttacctagaaggctggactgcataagcatggcagttttttcttcccttttaacttcatcgatttttttcttgtatttctgcatctaacatcttttctagcaaatacacctttctcaatttattttcataagttgaattgttggatgcaggttgaaacaaggggctctttgtattgtttttcaaaacaggagcttatctccatcttgcacatttgaaaaaagcagtttaatgaatggtaacaacattgattccgcatctagatttcctgctgagaaataaggcaagatgtaatttagcgcagtgataacatcactcttatcataagtgtctagctgctcactcccaaagactgacaagttgatgccactgctgtctgaggctgcctccggctcagtagtcagctcaatgctcatgtgcttcttctgggcttgtaacaccttcatgaacactctttctggattccctacagatgcttcttcacctgtcaaaaaaaagagactgctttgatcatgaaagataatggaacggcatgcatcagtccaca

SEQ ID NO: 20179 - DNA, 1049 bp, Homo sapiens
agcttaaaattttatcatcaattaaaaataaatttaaaaacaaatacttaaaataatgtaacaatttatcaccaggcaatttggactcacgacaatgtgtggtgtttgtcagacatgcactgttgcaatgcagcttgactgtcttgcagacagcctcaatgctatttttaaattggcagaggcagcaggccatatggctaggtaagatcctataagatgaaaacacaaaacaataaatagtggtaaagcagttacttgagtaggcaaaggaggcaggccaacgctaccacagggctgggcagaaaggtgttactgaggcctgtggactggacagttgggtaggaaccagaagggcaatgggaaggaggacaaaggtgcccaactgaagggtaagcatggcagtgagtatggtatgcctagaataaaagtggttgggattagaattgggtgacactgatcagtagtttaattcagaagtatctcttcccaactcaaaagtctcactttgggctgaaagtacacaggaagaaagtagacttctaagaagagtctgaataagcccccaacttctggagtccctttctcaatttctgttggcagtgggaaatattagaaattactctgggcattaaaaatagctcagtttaacctggattgtggggttaaaaaaataacagattgcattggccaaatctcgacaatttgagcattcaaaagagtaacaataagctacaacataattaatatataaaaaagaatccatgaagaatgatatttaaaaagagagggagttgttctttaatgaaataatgccagctaatgaatgtagaaggaatgacagaattttaaaaagtgttactttgcaaccaccaatgtaataaaaattgattcagacaaggattgtcattgatggacacagctgggtgagaagacatttgagaacaggatctttactgatctcaaagtaccaccacacagatattttattaattaccaaagggaaaaattattttttatttttttatgagacaaagtctcactctgtcacc

SEQ ID NO: 20180 - DNA, 1099 bp, Homo sapiens
tcattaccattaaaaatgatctaacaagctttattttttatcattgttaaaaatcctcgttttgagtaacacaaccacaaagtaaagaatgttatcattgatttaaccagtaaaagacaatacttaacaataaaattttaaaaacatacgccagccggcttacctggtgaaaaaaatgattgcggctgcaagctgcatttgccagacaatggttttagatttgctgtgcacgctgaacgccatgaaaaatggactgcctggcctcttcataaggaaatcaattacttgcctctttctgagtgaaaagaatgaaaggatttaaaaaatcataataaccaaaatggggagaataaaacaaactgggcagagggatgggctactttgcgtcttcagcttctgaagtcttcaaagccctcttccagttcttagaattaggtcacatgaaaaaatctggtaggatgaaatgagtgtcagagcagggaatggaaaggagagtagaaactttatcaatgtgctgtcgagaggtctgaatccacactgattcttgattctttgtggctggaagcttacggaatcttcgctgtctatggtgttctgcagttttacagtgatacgcccttgtgtgggccactttcatccacgaggtatttttggtgggcgttttcaatctggcaattgtgtttgattctgagaacttctcctgacaacttcctcttttccctcttgtatttatcttgagctatgattttattgaacgttggacttcctattttggtcttctgacattcttatcatttctctccagttttcctctttgtctctttttctttttggggtatttgtatgtgttcaggtttttaagatttccttatcttggtcgtccaaccctactatccagtttttcctttctgctaccatatttttattatctaagagctcttttgtttttagaatcttcctttaaaaaaattagtaaaatcctgtttctgtgtcctggatatagtattttctcttacttttctgaggctattaatgacaggtttttttttttctcctctgtgcatggtctgtttcttctaagttgctgcttcctattctt

SEQ ID NO: 20181 - DNA, 1038 bp, Homo sapiens
accatgctcccacccaggggcttgtgttctgggcaagtgacttgtatgccactgaagcaatttcttgctttaaaactttaatatctgcttctccaattggccaggaacttcacacactctgccatctagcaacagtgaaccgatggtacaggtagttctgctaggtttattttgtgatttgggttcctcccccgcagcaccccgccaaatttcacagtttgtaggaaggcagggcccttcaaactgggaaacacacacttctgggagaatttaaagatttgccaaggggttctgaggcacagatagtgatgacgatgataataataatactacagagttgtgtgcatggcttagtacagttgctaagttaactgaattaacacgtgcaaggggcttagcactgggattggctcatggtcaggttccctaactcttggctgcgactctttcaacctgtgagtcctgggggattgaggaggatggcgatcagggaagccttcaactggcagagaggaccttgggagaactggcaaggggtgctgagccaagggagaggtgaacagcatgagaagaaggtaggaggtaggtgaggccattctgtatttggggacagtgaggtcaccttcccactcgtgtgtgtgggcggccgatgattgatttctgtcatacctgttaccatttggtgcagtatcgatgtatcgttggtgtctgtcattaactctgaagtaacttttacttgatcagtactgaatttcattcctaggcttctcagtcttcatagttgactgctcctgtagttttgccatttattactgcttaaaaattaaaaaaaaaaatagagaacatagcctccgggaggcttctataaattatctcaagcctgttgcaaaagtcctagaaaacaaacccaggctgagtgtgataatcctagtgcttttggcatgaaggcaggaggattgcttgaagaccaaacgtttgagaccagcctgggcaacacggcaagacaccacatctaagacaaatttttttttttttttt

SEQ ID NO: 20182 - DNA, 1027 bp, Homo sapiens
cttatatctcagatgaggaaattgaggttaagtaacacgcccagagttggtgagtggccaagccaatattcaaactcagatttcctcattctagagccttattctttcagggctgggcagaactggggaatcagcaaagagaatccatcaagatttggccagctttcccatatggctgtcaaagagcaggaggccaggcgtggtggttcacatctgtaattccagtactttgggagatcgaggcggaaggattgcttgagctcaggagtttgagagcagcctgggcaacatagcaagacttcatctctacaaaaaaatcaataaattagctgggcgtggtcctacctactccggaggcggagtcaggaggattgcttgagcccaggaggttgaggccacagtgagctatgatcgtgtcactgcactccagcctgggtgatggagtgaaatcctgtctcaaaaaaaaaaggagattggaatctcatcattttttttctccctttggtgctaatgaaggatttttgtgctgtccaagcataagaggcaacctgagaaatgggattgtatttagttatttattttaagatgaagtcttgctctatcgcctaggctggagtgcagtggcgcgatcttggctcactataacctctgcctcccaggttcaagtgattctcctgccttaacctctcgagtagctgggactacaagtgtgtgccaccatacctggctaatttttgtatttttagtagagacagcatttcaccatgttggccaggctgatcttgaactcgacctcaggtgatccacctgcctcggcctcccaaagtgctgggattacaaagtgcgtgggtggcacccaggcagaaatgggatttagatgtcagtcatcaaaatggttgatgcaaccatcgttcaggaggctcacccagccagggatgtgtgatggctgcagtttcaggtgcctgcaatcttatcctgcctactccagcttcatctccaaccctctcctcatgttcctcacattgca

SEQ ID NO: 20183 - DNA, 1133 bp, Homo sapiens
cctccattaaaaggaataacaaagaaccactaaaataattcatatttattgacttggaaacatttacatgaaatatttttaaatgaataaagcaggttccagtatggaacaatatgtaaagtatgattttattatataaaaataatcacatgtagactcaaaaaaatcttgaaagagtcaataaagggtaacaaaacattagcaataattacctctgggcagcggagggagagttgaaggggtgaatttccccccacaataaactggtattgtttgtttcatataaattaaatgtttaggaggtatttgtgtccaagaggttcagaggtggacctggcaagtttaccctcattgagggatgtgtggggcagaattttagatctgggactgtgtattagtccacagactaatacacacaatcgcaccattcttgaattagagggaaccaaaaaggtctatctgtctgtctgtctgccagttctatctaactgtcatctatctatctatctatcaattgatcgatcgatcgatcgaaacaccaatactccaagagataaaataaactcacattgctataaagaactacctgagacagggtaatttataaagaaaagaggtttaattgactcacagttctgtaggctgtacaggaagcatggctagggaggcctcaggaaacttacaatcatggcagaaggcgaaggggaagcgtgtatgtcctacatgtttggagcaggaggaagagagtgaaggggaaggcgccacacacttttaaacagccaaggctaatgagaattcactcaccatcatgagaacagcaaagggaaaatccgctctcatgacccagtcgccttccaccaggcccctcctccaacactggggattacaattcgtcatgagatttgggtggggacacagagccaaaccgtatcaggctgttttccctgctgtcaaactcaatcctgacctatgaccctcagctgtctccaggaggtctccactagcactcccgtcatcgtattagtctggcaggataattgtagttacctagaaactgaagcattgtgcgcctcaattctggtgcagagaaggaaatgctgatttttttttttttttttttttttttttttttt

SEQ ID NO: 20184 - DNA, 2091 bp, Homo sapiens
tgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactccc

SEQ ID NO: 20185 - DNA, 1037 bp, Homo sapiens
ttagcatactctttggtttaaatttaatatatacatttaatgttacttagggatacttttatattttgcatatataaagcctcatatataaagccttatttctgatgctcttagatttctgaggagtgagatgattaagttgtattcattagtgtattggtatttcttcacatccagtgaaattggagatatgttgtatgttagaagagcattctttaaattgtgttgctttgaacatgtgtaccttttctagattcagtaatcccttccccccgtcctctggagtatgaaacctttagagtcacaataaaatgtaactaaagaaaatttctctgggttgacagtcctggttatagttgaattctctctaaacagtggcccaagtagactcttttttttgtttcttttattttttaatgatttaaatattgacatttaaaaattgaagtagcatgtcagttttcttcatactactttatctctaaccacaaataatagctgaaccttttgtacttatgttaggccctggcagtgtatgtttagatgggctaagacaacatcaagaagcaatggctagataaccatttaatttgtccccaaaggtacgtttttatctgtctatttgtctatttatcgatctgtctatctaagatggtctcactctgtcacccaggctagagtgaagtggcatgatcactgcagcctctctgcttcccagattcaagtgattcttgtacctcagcctctggaatagctgggactacagatgtgtgccatcacacccagctagttttttgtatttttagtagaggtggggttttgccatgtagcctaggctggtctcgaactcctaagctcagtttgcccaccttagcctcccaaagtgctagcattacaggtgtgagccagcgtgcccgtctcccaaaggtattattataatagctatcagtaaacgctgtagctatgtgaatttcttaaatctcttccttcctatgctatgtgatttttacatagaaagcagcattgttatgtacatg

SEQ ID NO: 20186 - DNA, 1044 bp, Homo sapiens
caccaataccaagtttcctgcttaagaagctttggtgacagtggctgattattttcaaaacccagcagttgagagggaagaaatagacattcttctgcaggtataaacagaagagaggggaatggttagcagaaccagaggtagtgcagatccagatgtccaaggatgaagaaaggtggggtatgagccaggaattggtaatggaaaagtggcccagaaatgcaacttagtatgctggggttgaagaacagaaaagttctgggtcttagggggatgtgggggaaatacgtggaccatcatcccctcagagaaacacagccggatcatgagggctgggggcagctggtgcagaggatattgatttatatacattaaatctctaatgaattcctgaaaagcgccaggctgcctgagagtggtggggcctgctgggtgtgtacattcatgaaagtgctttttaatccttaagggccttgtggtgtgagttctggcctctaggctgactttgcctcgaggctaataaacatggaagaatgatgatcttcgaataattttataatccactgtgtgggactgttgaaacgactgcaaggcgatttagatgtaaataaacgtgatgttgcagaaatctataaataagaagcactggcaatttaaaccgtgttgtgcattttgccaaaaaacacgagtgagtcctggaaaccacagtgaggtgctgccaaaagtagagattctattttaaaaggtgcagccaccgttacagcacaaccctccgtgctcaggcctggccagcttatcatcatcactggatgtccaggctagcaaggacaatccctcttcccagtctcattttaattcctgagtcccatctgtaggaacatatcatctttcagacaccttttaggttcttctaaaacattttctcatttttgtatgatgtaagataagaagtaattttaaattcaaaggttgtttttactttagatcagtgcttctcatactttgagaagcactaatgcacgtctcattgcacattatattgta

SEQ ID NO: 20187 - DNA, 1072 bp, Homo sapiens
gcactcctgcctgggtgacagagtgagatcctgtctcaaaaaaaaaaaaaaaaagaaaagaaagagttgtaaatggtagaatgtaaaattaagaaaggttgtgaagttttcaaggaaagaacagcattggctttgtgagttggtttagatctgatgttagtaaaagttaaaaaaaaaattttcttttcttttttagacagagtcttgctctgtcgcccaggctggagtgcagtggcgtgatctcggctcactgcaacctccaccaggttcaagtgattctcccgcctaagcctcctgagtagctgggattataggcacccgccaccatgcctggctaatttttatatttttagtagagatggggtttcgccatgttggctaggctggtctcgaacttttgacttcgggtgatctgccctctgtggcctcccaaagtgctgggattacaggcgtgagccactgtgcccagccgaaaaaacaataatttcaaatatgttccaatcatttggaatcgatttaaaataaaaaaaaaaaaaacaaatgtgctgccagcattagattgttagactgcaaacaacactttaaaagaagtgaacagctgtcacacttctctgtcctctgtagagatttagctttggaaagataacaagtttgtaaattaacagatctcatctaaattccatccttttcctggagcttctgctatcctaatccctcaccctccaagagcacagccctttgatttacttgatccaaagaacttttacttcctttcgctcactgctggatatgctaataggtagggttaaatgaaaattgataaaaaaaatactataattatttttgttttataatagtgattgtacagtaaatattttttatatagttttacaaaaatacctatatgggagtttgtgctttggttatttaaaccttggaaagaattttaagaattttaagaattttctatcttgtttacaatgttttatcctcagattcaggctcggtgcctggcacgtagtaggtggtcaacaagtacctttagaataaataaattatttttatcagtatc

SEQ ID NO: 20188 - DNA, 1033 bp, Homo sapiens
cagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgc

SEQ ID NO: 20189 - DNA, 1024 bp, Homo sapiens
gtagatgtagggctaagtaaatggcagactgttcaagaagtcagttaaccattctttccttttgtagcataggctctgtgctaattagggaaccacttacttgccgtgaaatcagcagcataaaacacaggcacctcttcgagatcagcctcagaccgtggaggcagtaacagcaaattgcacttaaccaggggccttgtgtctgctgaacagtctgcctgtaagaagcgttgctgagaggggtcaaagtcctggcacataggccttgtaagattaagtggattcactttcactgtgtgtcatttaattggtgcaagttggcaatgtgacatttctttgttcttttagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaaggtaggtgtctgaatgtttgcccattaaaaacacaaattaaacaaaagaaaaccttagcattgtcttgggtttgagcagttcacatcaaagactcaaactgttaaggatcacccagcccaggcatcgggtcctgtaaaaatgctctatcttaggagtagcacccagcgctgtgagtttacttacactcattctaaagggtcagcagatcttcgctaagaaggcagctcagcacagatggaaacaccaagacccagaactttgggaggctgaggtgggaggatggcttcagcttgggagttcacggctgcaatgagcagctatcatctcaccactgcactccagcctgggcgacaaagcaagaccctgtctcttaaaaagacaaaacaaaaaaatcaaaaaacaatgaaaaggatcagagcttcaaaataaaagacctggcttccaacctcagtgctgccactggttcactgggggctccgggcaaatcattaacctccgtttccttagggccaaa

SEQ ID NO: 20190 - DNA, 1049 bp, Homo sapiens
tccgttgggagggtttaactgcccggaaacggaagtctcgttctttttcgtccttttccccggttgctgcttgctgtgagtgtctctagggtgatacgtgggtgagaaaggtaatctggggcaatccactgccaggtgaaatctggggaccccaggtccgcgtggagggtgtcggggaggagaaggggagtgcgatggggccgatatttcgggggagagcgggaaaacggggttcgctgccagcccccgcgccgtgttaacgccgaggactgtttcccgcaggtcctggtccgcgccagagcccagcgcgcctcgtcgccatggtgagtacagtccctgcctggcgccttcccggggtgggctcgtggggccccggggcgagggcgagagagcctcccaaggatctcctgaggccgggagaagctggtggactgggccatcgccgggagacgtgtctctttcctctctgttcacccgcttcctttgtgttgcagcctcggaaaattgaggaaatcaaggacttcctgctcacagcccgacgaaaggatgccaaatgtaagtggttgctccgaaggttcaagaagagcggtgcctagcctggcaccgctccgggagcgtcttccccggaatgtcaggcaggagacggttaggccgtctgggtgtgtgcctggccctctgggagcagtggtttcatcctgtttcccatgagaaagacctgtggggggcacgttgaggccctggaatttctaggaccatctttagctaatcgcgatcatctcagaggccgccctgagttcagttttctttcgtataatatagtaaattgtcggaacggaatctccactccgcgaaagcctcaaaacacacgtcccataaacactgtttaggttctctgcagttgtgcaaaatcttaacacaaaatccattttgtaataaagtgctggatatttgcatgtaatgtatcgagcacggcacactgtgtagtatggtcgtttacctcgtgatcctgtggtcgctggccagtgtcagaaggtatcatacctatctaa

SEQ ID NO: 20191 - DNA, 1013 bp, Homo sapiens
aggggcgggtggggtttggaaggttgctgtgtgtggccatgttgtatcttgttttgaatccctctcagatttcagagcccattttatggtctaagaatctgctcttgctgttgggagtgtgaggaatagttgtgattctcagattatatacagtaccagaaatcatttccttagccagaagagcggttagagctcatttaatcctgttcacgacccttcgaggttggtgctagtactgatagtccccattttttacaggggaacagatgaaatataatagaccaagtctttttatcgaatataatagaccaagtctttttatcaaacactaaatattttaaccgaaacttcgctggtggatctaatttctgaaccttgtgtgctctctttagcttaagtacaaaatttagacaagcagcagcaactcagatgtgtcttctggatggcttacttttgtctctttccctctaggtttggcagtgaaggaactgaaatgaaccagacacactgattggaactgtattatattaaaatactaaaaatcctaagtgtctttcgtctttgcggatgggaaagggaaaaatgctacctcgtagtggcttctgatgggaacaggacgcgggttctgttgctgccttcctgtgtctttttttttttttttttttctttctttgagacggagtcttgctctgtggctcatcctggagcacagtggtgcgatatcagctcactaccacctccgcctcctgggttcaagcgactgtcctgcctcagcctcccgagtggctgggattacaggcacacatcaccacgcctggccaatttttgtatttgtagtagagacagggtttcactgcctgcctcagcctcccatagtgctgggattacaggcatgagcctccgtgcccggtgcatccctaatcttgagcatgatctcagtcggcaaatgaggccatctgttttcagcctgtttgaaaataagatgtggggaggccatgatggaaatagcacgt

SEQ ID NO: 20192 - DNA, 1030 bp, Homo sapiens
cacacacacacacagcttctaaatcgtggataccaggtaagctggaaccacttcctttcagttggcaaagctttggtccaacagcatataagctttagacccagctgtgcccagcaagagagtgtttcgcaccagaagcactgcgggtgaggctgcggctgcacccctgcttgcttcctgggatgacaggaccatcatgccactcatcgggtccagtggaaagcatcccccgacatctctgtctttccctcagcagcctcagcctctcccccatctccaactttcagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttg

SEQ ID NO: 20193 - DNA, 1044 bp, Homo sapiens
ggctgcgacgacactaaggtggagaccgggatgtagcgaggactcccagagttgggagacgttgtacgcttactgggacctaaatcccgcacgagttcccacccaagtgccgccgccccagcctacgcacgcgcattcgcaccgtctccagccccggggtcctcctgcccctcccgccgtctccgggggccttttctccgctcggcaccagggtgtccccggcgccgcctgatcctgttagcgcggtactctgagtgcagtcagtcctcggcgctgttttccctgatttgctgtcgacgccaggaaggaaggacgcgtgcagaggaccgcagaggggtggccgtggctgagaggagacagcgccgcagcactgagggtttgggcttgcaggcgctgcaggagacgcccaggcggagtcttgtctcgcagccagctctgagcgggaggcctgagcgggaagcattggcgtccgagcgacttctaggagcctggggttcggcgctatggaggagctcgatggcgagccaacagtcactgtaagggtaccccgaacaggcttgctcgtccttgcgggttgagaactgcgtctgcttagttacttcaggcttgtctgcttccctagtggtcgcgaggcgctcgtccccttccctcgactcagttgccacttttccggaggtcgcagtgttaacgaggtgcccgccctagggtcgcagtggtcgcggggtttctgccaccagtcacaaaccccggcctcgaaggtcccactccgtccctttccttcctttgtgttcctggcctttttacttcccttgcttttcctcttgggcattagagtgggttcagcccaagcagaggaatttatatttttattccagccgtattaagctctgcatcgcggcacattgagcttctgcctgtgtggcctaaggtttattcaacgtattatctcaggagactattcctgttttatcgctgtgcattcaattccatttgaactttgaagacagtatgtcaactgtggatgatctgtgatgtgtataaaaa

SEQ ID NO: 20194 - DNA, 1061 bp, Homo sapiens
aatatggtgaaactctatctctactaaaaatgaaaaaaaaaaaaaaaatagccgggtgtggttgcacacacctgtagtcccagctactcaggaggttgaggcaggagaagcctttgaacccaggaggcggcgattggagcaagctgagattacaccactgtacaccagcctgttagagtgagtctttgtctcaaaaaaaaaaaaaaaaaaaaaagaatggaacaacttcagtaagaagaacatttttcattttagatttctatgccttattttactagttgattccaggcgtgaattccaagaagaaccaaatgtattttgactggggtccaggggagatgctggtatgtgaaacctccttcaacaaaaaaggtagggttttttttcttccaaattatccatcttggcacatttggttgtttttctgtttattacctcagattttactagttgtggactgaaacagttgaatttattttgtactattttaattttctctattttgttttcaagatacaacagggttttgttgtgtcacctgggctggagtacagtgtgatcatggctcactgcagcctctacctcttgggctcaagtgatcctctgcctcagtcttcctagtagctgagactacaggtcaccatgccaccacgcccagctaatttttttttctttgtagagatgggagtctcattttgttgcctaggctggtctcgcactcctggcctcaagcgatcctgttgcattttggcatttttatttttgaaatgttagctattttagattttcattgatttttgagatcttgaagatgttgaatcccggaaaaaaattaatagttttcatgaaaaattttcttcatatttaaaatgtcaagctttttatccctttttctttgtccaaagtgaccaaattcctatcagtagctcccttattgtgaaccttgcagatgcttggccgtcacttttgtgtccacagcatggattcagctgaataatagttctgtaggctgagctgagccgtagcatccaaggcacagatggagctggagagtgacatag

SEQ ID NO: 20195 - DNA, 1043 bp, Homo sapiens
acaaaaaggaatacaaaaccgtttttttttttttttttttgagacagggtctcggctgggtgcggtggctcatgcctgtaattccagccagcactttgggaggccaagtcaggaatctcttgagcccaggagtttgagattagcctgggcaacaaagtgagaccctccatctcaaaacaaattaataaataaaaatataaaagagaaaagatagtccgactctgttccccaggctgttgtgcagtggcctgatcttgctcactgcaacctccgcctcctgtgcggtcctaccacctcagcctctcaagtagctgggaccacaagtgccaaccaccatgcctgggtaatgatataaaaccaattgacaggggctggggtgcatacagggttggatgtaaatgagcttgcacattactttggatcatcagtttcgaagtcagcatgtcgtatatgtgtatatggatgtattttctatgtgttaggtatttccattcacctctgctgactgacccaattgggaggtggcagggaggagatcgctagttgactgggctaatggaaagtcaactaaacttataaagcctgaaattgggaacagattgtgaggacaaaaaaaaagaaaagaaaagaaaacctggaattcggcccggcacggtggctcacaggaagtagtgggccaaatgtttgagtctctgattgattcgctaaggtttgttgttgtcgtttagagacagggtttcgctttgcggcctgggcgggagtgcagtgatgcgatcatggcacaatgcacctttgatttcctgggctcaagcaatcctcccacctcagcctcctgagtggctgggactacaggcgcacaccactacgcctggctagttttattttttgtagaggtgaggtttcactgtattacccaggctggtcttgaactcctgggctcaagcaatccttccaccttggcctcccaaagtgttggaactgcaagtgtgagccaccattcctggtcattcactgagtatttattgagtccctactatttgcaa

SEQ ID NO: 20196 - DNA, 1031 bp, Homo sapiens
attcacagataaagactgaacagtgaagactatttgcattgagtgtatattttatgttatgttatgttatttttgagatggagtctcactctgtcacccaggctggggtgcagtggcgtgatcttggctcactgcaacctctgcctcccgggttcaaatgattcttgttcctcagcctcccgagtagctgggactacaggcatgcaccatcacgcccggctaatttttgtatttttagtagaaacagggtttcaccatgttgaccaggctggtcttgaactcctgacctcaggtgatccacccgtctcggcctcccaaagtgctggaattacagacgtgagccaccacgcctggcctgagtgtatttattttacatatttatatttgaactgaaacttttatgaaccattttatttaatgcattctgatattttatattatttcattttaatttttttccaaacaaaacttctcacatatttattattgaaccaacctactattgtagagcttataatcagagaaaaaccattttctcaacaaagtatgtccacctttccagatagtggtgacagtttcagcttgatgtgataagatgatagtcttacgtgtagactcatctcatgtgtaattcctggcagacccagcttggttcttctccagtccctcctcttggggttgtagctaactgtattagcaattttgttttattttgttttgttttgtttttttgagatggagtctcactctgtcatccaggctggagtgcagtggcacaatctcagctcactgcaacctccgccgcccagattcaagcgattctcctgccttagcctcccaagtagctgggactacaggcgcctgccaccacgcctggctaattttttgtatttttagtagagatggggtttcaccatgttaaccaggatggtctcgatcttctgactttgtgatctgcccgtcttggcctcccaaagtgctgggattacagctgtgagccaccacgcccagccctgtattaccagttttaa

SEQ ID NO: 20197 - DNA, 1025 bp, Homo sapiens
agttgaaatccggtgcccttagctgagagcaggagcattatggagaaggtacccctgagaggaggacagagttcagcacaaatgtctctcctcagattatgctgggagacgaagctgccttgttagagcagaaggaacttctgagtaattggtatcatttcctagtgactcggctcttgtactccaatcccacagtaaaacccattgatctgcactactatgcccaggtgagtgagctcggggtgggcaagggtgggggtaggagtcctgggggcgccctgatgggtcattctctttgaattcctccctgaggaacaggaagaccctttcctttggcccttagtgaaagaacaaggcaccttctctggggttcgttatacagcagccctgcctgccccgagtctctgcttccgtcctcaggattgagtgtctcatcacctttccacagtccagcctggacctgtttctgggaggtgagagcagcccagaacccctggacaacatcttgttggcagcctttgagtttgacatccatcaagtaatcaaagagtgcaggtaggatctctcccaccccccactgtaaccatttttaggtgtacaaatatcaccaccttgcgtttctagagtggcctgttccttccttacccttcttccctcagacctgctatcttagtccatctcacgctgatattacagaatacctgagaccagataatttataaagaaaaagattattttctcaccgttctggaggctaggaagtccaggatcagggcactggcaatgttgctggtgagggctgctctctgcttccaacatggcaccttgaacactgtgttctcatgtggtggaagggcaagaaggacaaactcccttcatcaagtcgctttataagggcacccaatcacattcatgagggaggatgtggcctaatcacctcctggcctaatcacctcttagaggccctacctcttaatactatcacattggcaaaactggggttttagaggggatcccttcaaacc

SEQ ID NO: 20198 - DNA, 1003 bp, Homo sapiens
tgagactgctgctctgatctctgggccgggccctgcaggttcctcagggattactgtgagcgaggctgcttttctgatttggatctcattgacaacctggggccagccatgatgctcagtgaccgactgacattcctgggtgagtctctgggttttgtgccctgtgctttgggcacaagtgggtagttggggaggttggagggatcacgtcagacttctcccagcgcttccttcatgtattcccattgcatcagtggtcccagaaacatcctccgtcatgtccaggatcatgagtttggctgtcacatctccttagtgcctccatgtttgtttgtttgtttgtttgtttttctttctttctctctttctttctctttctctttctctttctttctttcttcttttcttttattttttctttttttttttttttgagacagaatcttactcgctctgtggcccaggctgccaggctcactgcaacctccacctcctgacttcaagcaattctcgtgcctcagcctcccaagtagctgggattacaggcacgcggaaccacacctggctaatttttgtattttatttatttattttttggggacagagtctcactctgtcacccgggctggagtgcagtggcgtgatctcggctcactgcaacccccgcctcccgggtccaagcaattctcctgcctcagcctcccaagtagctgggactacaggcgcacgccaccacacccagctaattttttgtatttttagtagagatggggtttcaccgtgttagccaggatggtcttgatctcctgaccttgtgatccgcctgcctcggcctcccaaagtgctgggattacaggcgtgagccactgcgccccgcctaatttttgtatttttagtagagatggggtttcaccatgttggtcaggctggtctggaactcctgacctcaagtgatccgcccgcctcggcctcccaaagtgctgggattacaggtgtgagctac

SEQ ID NO: 20199 - DNA, 1038 bp, Homo sapiens
gggctaactgatggctcctaaccccagcgaatgtctgtacttagatgaattgtccaggaagagtggcctctgataggaccctctcgttcccactctcccacttgctgccggcaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcaggtaggggtgctgccccgcctcctcctgtccctggtgtcttctgtgaagaggggaatgggactgacaaggaaggggccccgttcatctcgaggttctcttgagggcaggcatctccttaggctcctgtccttaacatcttgtgagaattcttagactgagtggtgccctctcccagtctctactctgaggggacagctctggaggtgaacacgggctagggccagggcagagcgtggaactgcaggactcacggtgcttgaagaagcggtatctggcagagaggcccagaatcctcccaaggtgtaggtttctagcctctctgccaagtgagactgacagtcacttctttctgcagatggtgcctggacatggccctgtcccgaccagtcactgccctggacaatgagcggttcacagtgcagtcggtgatgctacactatgctgtgcccgtggtcctggtgcgtgtggcggggctgtgcggggctgcatggggcagaggagagggctggacacgggggggtctcagggccactcacatgagcgggagtgaatgcagagggtcccagagtgagccagcctgtggagtagcaaaggaaggggaacggcagtgcctgggtccctctagaggggcggggtcaaggctgtgcctctgctgttcccaacaggccggcttcctcatcaccaatgccctgcgcttcatcttcagtgccccgggggtcacttcctggcagtacaccctcctccagctccaggcaaggaccaccctgtcctc

SEQ ID NO: 20200 - DNA, 1297 bp, Homo sapiens
ggttgcagtgagccatgatctgccaatgcactccaacctgggcaacagaatgagaatctgtctcaaaaaaaaaaacaaaaaaaaactgcttggaaaccagctgtaactttcaagatgacctagtaaaatttaggaaatttatgcccaattaaaatctaaaacagtaatattcttgaaaatatagtgtgagctgttccatatttgagctgattctgtgattggatagaactgtatgtagccactaaaatcttgagacgttgtgagtgagaaagataagagtgtgttttaccaggaaagaaagttttggcgccagcatgcaggagggaaaaaaaagaacccctgaaaactgtaaatgcaacctgctttctatgctgagtgaaaaacctggaacccaggcctgagaactcgccctgcctgagaactggcaagatggtatgggcagacccatggccccatagttcaaagtcagtcacagctctcctcgggcttgcagaacaaaacactcagtagtgataatcttctctgcctagtatttagggtatgtgggacttggagcctgcacgtaaaacaagcccagggagccgttaagtgtttgggtttcagttgtggagggaagggaggatctgggtcctagagtctttctgggtacagttgcagccttttcttagggctggaaggcttcctggggaagttggctggagaggagggtacataacacttaacggtcaccccttctaaaatactgtaatccaggcaacaaatccttgggagatgacagggctttgtgagtcagggtgggggtcacatgaaaaacaaaacagactttactgctgtccagtagcagtcactaaagagcggggtgggagggacccaaaaaaggtgaagctgggaagattgtggaaatgccttttgtgctcaggctccccttctcagccctacatcacggctgacagcctcgtcattcctgcctgctccttgactgatgtgcttcgctgttcctcattcactcatgtgcatttcaagttttactgtggaatgaaaagttttcatggaataatttctgttcctcttgaggagccctcagaaatcagaacacaaaatccaaccctcaaagtcacttgatatagttcttttggagggtgatggagaagggtttagataaagcttgccagcttcaatgttctgcaatccccagtggctgccaggcctttaggagtcctcgtggcatctccaaggactacaaatgatccccagcatgagtcttctgtgatactcttatcttagtcctggccctgtc

SEQ ID NO: 20201 - DNA, 1027 bp, Homo sapiens
aggctggagtgcagtggcgcaatctcagctcactgcagccttcacctcccagttcaagcgattctcctgcctcagcctcccgagtagctgggattacagatgtgaaccaccgtgcctgactaatttttgtatttttttttttttttttttggtagagttggggtttcaccatgttggtgaggcaggtctcaaattcctgacctcaagtgatccacccacctcagccttccatagtgctgggattacaggcatgggaatcccatgggattacacccagccctttttttttttttttttttttaaatcaaacggctacagtttggtgctgccacctcaatttgttctaaaggctagcagtttacccaccattgcttgtgcaaaggtcaacacgatgaaaaagacaatgacttaaaacggttttgactttgcagaccccttagaaaaactactattattctaaaacagaaatcatgggtcagtgattcagtagttgtttgagaactgtttttattgctctgaaaatgtccgttaagttgttagccttatggggtcttgagccatgttgagggtgggttagtattcagagtaagatgattcagccctggcatggtggggaggagttcaagctctggaatgagactggggttttcttggggaagtcctttaacctcagtttttctcatcgcgaaaataatcatcataataaaatctgtctcatttattttaaggttcaactaagtaaaaataaaatgcagttgtccctcactatctgtggggatcccaggaccccctcctcagatgctcaaggttctgatataaaatggtgtagcatttgcatttagccttgggaatccttctggatactttaaatcatcttatgatacttgatacaatgtaaatggctgtgtaactagttgttagactgtgttgtttagggaataatgacaagcaaaaaagtctgacacgttcaacacagacacaatttaaaacacacacacacacacacacacacacacacaattggagg

SEQ ID NO: 20202 - DNA, 1062 bp, Homo sapiens
ccacgagggccacacttgcttgaattcacagtcgacgtagataaacatgcaaagatggaaacgtgtccgtgcgtgcccatgaccgtttccctcgcgggctgtgcggagcctgagtctgggagcccgaaggtgatgggttccaagtatgtctgcaggctcagcagaaatgtagcattagagggagccccaaatactgacactacaggagtccagcaggatgggaaaacctcttcctggaagtcttgcatctgtgtgcttttaggtcgctgtcttcatttccttcaagccacgttaagcattccctagagttaggtgatgtgggagaaagatgaataaggggcggtttctcctgttaagcaaaatgttgctttccattttccctgatgctctgtgaatgcctctcatccccatgggctcctgagtgatgtgcatgtttaaaaggatccccagctgcgagaggttttggaacctggggggttgaacagctcttaagttgttcagtgaacgaagaacagaatcatctgttggagtagaaagaactcaaaccagtcaggaggaactcttgttatagaagaccttgggaaactgttctggggttggggaacattggttataggaagtgtatggtttctttgtgggattctttgttgttggctgaaatcatttaagcttcttgactacagtctgactcacgttaaccattccttttctgatatggacattgctttcctggtcctttcttactggagatctttcgcagtctttccattgattttggtgagatgttcttagctcaaagactactgatgagttgaatggtgtagtcttgattttcgaatctggaaacttcacgtaattggaacttctttataatctctggttgctcagatcactgtttttagcaaaataaacacattttgagtcacgagagtcttggcttcagcaacttgtgtttctgtgttgtgttgtcattgagcatactatggaatctgtaatagaaaggctttcttattttggaattgacaggtgaaacaagtgaacagctgattaaatgtcagtatc

SEQ ID NO: 20203 - DNA, 1027 bp, Homo sapiens
cagggtttcactgtgttggccaggctgatctcgaactcctaacctcgtgatccgcccaccttggcctcccaaactgctgggattacaggcgtgagccactgttcccgtctgcctgtcaaattttttacctttttaaacttttatttatttatttagttgtatttttagtagagatggggtttcaccatgttggtcaggctggtcttgaactcctgacctcgtgatctgcccgcctcggcctcccaaagtgctgggattacaggtgtgagccaccgcgcccagccacttttatttttatttttaattttttttttaaatttatttttgtcacccaggttggttggacagagcaagagacaggatcttgctctgtcacccaggctggtgtacagtggcatgggaaggcgtgagcctgagaaggtgtgagccacctcacctggactttcttatacattaattaattttgtatagttttatacctgatgttatttgaaattaggtaacatgctgtagtctttgcaataatccagagacacttgtgtgataattgagtctcactcaccataacagtaatcttggcaaacacagttgaatacactaaaagcaaaaaattatgttgccattggtttccctttcttgcccttcattcttgtgctgaaattaaagttcttagagtttgagccctccttttcctaaaccaagaggattattcataacatagtttaaaggataattttgttgattttttttttctaaactcttgaataatcttgctttaagggaaactttggaataatcctttcagcaaattggtgtagcaggcacttgtgctggacttaggaatccagtccttttagaaaacagttatgtcagaagttcctttattgtacagctccaagtatttgcttagcacttagtaaaacgataatgtatatgtattattattcttccaatacaagaaccacatgacctctttttttttttctgagaccgagtctcgctctgttgcccttggctggagtgcagt

SEQ ID NO: 20204 - DNA, 1046 bp, Homo sapiens
ctctttcctgtgtgtcttagaagccatgagcacgcttaggtaactagagccctgccacagcctgagcagcacagcacacatctgcaggctttcctgccagacctttacctaaaggtaatttttctcattaggagagactccaggtcaagagtgatgacagtaaggttgcatttaaagctgcattacattaaatagtggactggtctagtgattattttcccacactgggcaatatttgcttaatgattaagtttttttgtttttgtttttgttttttttaatccagctatggttgatactaaaggaggttttcccactatccgtatgcatcttctctgttttgagattgcaactatggacagttatggctaatcctagtagattgtcttcccttttaacatcttggatgaatttgggtcacactaattgttatgtgaagatggatgttgaatgtaagtttctctgccattcttagccaatatataaaaattacattagcctaattgctaacaatgccaagaatttaggtttactatccctctggacaatgtagcttcttgttttcttaccatatagataactctatagattcaccccagccagtcatcttaaaatacctgcataggcagcagaggtatctgtggagaaagtgcatgggataataggtacagggtgattttgggagtgatggaaatattctggaattagatatggtgaaggttacataatgtgggtgaatacactaaaaaccactgaaatgtacaagtggtgagtttgagtgctctctgaattatatctcaaattgttaaaaagttaattaaaaaatcagtgtatatgagtccctcttaccatagagagggcttcaagcgcatggcctattgccaaggctcagcaacagtggttcagtgtgggaaagcctgtggtttgcgcaaagctccttggtgcccttttcccagctttctcagtggcttaggccctgtgtatctattctagttgaatgccgccatgttataagtctgtggagatgttttgagataagaaatacg

SEQ ID NO: 20205 - DNA, 1033 bp, Homo sapiens
atatagccaccataagtcctgacaaaatgacttttaataaggagggggaaggtccatgtcccaccttcctatgaaattttggcctattcacaagtctacccccacataagagaagtagttatgttctgtaaagaagaggttgataaaaacctttagcatggtgttttgtgacttagaagttttaagtagtcgttcttatatctaagcatttattaattttggtaagaacattactatacgtttctgatgtcacttttactgttaagaggtgccaggcatctggtgacctgtcacttcaggatttgtgtgaatcagaccatctaaatataatataaattagagactggtacttgtatttcctgattaaaaacaaagtaacgtctgttttactattgaagtaagagtactttataatgaatacaaaaatgtatattaaatatccagtagagcatgctaaagtgaacatttctgtttttatttcagcaacttattttatggtattgtagttatggcctgtccgaaactctctgacatattctaaacagctttcagagagtcactgaggcttatttgctactactgttgtttttcctttagctcagttaagaaatgtttagttagccgggcatggtggctcacgcctgtaatcccagcattttgggaggctgaggcgggtggattgcctgaggtcaggagctcgagaccagcctggccaacatagtgaaaccccgtctctactaaaaatacaaaaaactagctgggtgtggtggcgggcacctgtaatcccagctactagggaggctgaggcaggagaatcactaggacccaggaggcgcaggttgcggtgagccgagatcacgccattgcactccaacctgggcaacaagagtgaaactccgtctcaaaaaaaaaaaaaaatgcttagttaatagtcagcatggtagttaagagtactgactccagggtcacaccacctgggtttgaggcccagctctgtcagttactagctgtgagatcttgggcaagtgactta

SEQ ID NO: 20206 - DNA, 1442 bp, Homo sapiens
atcacgaggtcaggagattgagaccaccctggccaacatggtgaaacctcgtctctactaaaaatacaaaaattacaggccggacgcggtggctcacacctgtaatcccagcactttgggaggccaaggcgggcacatcatgaggtcaggagatcaagaccatcgatctcccaacacggtgaaaccccgtctctactaaaaaatacaaaaaaatttagctgggcattgtggcaggcacctgtagtcccagctacttgggagcctgaggcagaagaatcacttgaacccgggaggcggaggttgcagtgagcctagatcacgccactgcatttcagcctggtgacagagccagacatcatcaaaaagaaggccgatttcatgtggtttttcctggctgtcggtgagtccacagctaagaaaacactaattcagtacaacctaaagtgtaatctgctagtatcttttacagctggtggtggtaaaaatatgtgtacagcggaagaataattggacaaatttacaaaacttgtgaaaatgtaaggtggtttattcattgtgttattcatcagcaggtactttgcagaaaatatcttaatttatcatgtgttattgaactcttagcatcagtaattttacttggttttgtgaatcatcatcagttccataagtttttgtcagaaatagaagctgaatattctgatgtgccctgccgcgcagtagtttgatggcttagcagtggtagttttctttcaactttttgagctcagggctgagattgaaaattttctgaatgaggagaatcgctcccaaccactattgaatgctgaatggctttggaaattagcttttgctgcagactaggtaatgtttgttaatgaattcaacctaaaactccaaagtaaaacagtgcttatgcaaaccctatgcttcagggaagtcatgttgatgacagcaaatgtttaaatcatatgtcatgttaaactgccttgtatacttcctgtgctggcaaaagtgaaaacaaaggcaagctctccattcctacacacatgttccaaatgcaggctatagttctatcagggattttgcatctcaatgtgaacacaaaggaaatttctctaatttgaaatccactgggtgggcgtggtggcttatgcctataatcccagcactttgggaggcaaaggtgggtagatcacttgaggtcaggagttcaagaccagcctggccaagatggggaaaccccatctctaccaaaaaatacaaaaattagccaggtgtggtagcgcatgcctgtaatcccagctactcaggaggctgaggcaggggaatcgcttgagtgtgggagacagaggttgcagtgagctgagatcacgctgctgcactcctgcctgggcgacagagtgagactccatctaaaaaataaaaataaaaaatccattaat

SEQ ID NO: 20207 - DNA, 1075 bp, Homo sapiens
ctattgcgccactgcactccagcctgggtgacagagtgagactgtctcaaaaaggaaaaaaaaaaaaaaaacaagcccacatgcttgtggaatgttatcagcatttagcaatacctatgtatgtgaaaagacattttcaaagatgaaatacataaaaatctcattacaggccaggtgtggtggctcacacctgtaatcccagcactttgggaggtcaaagcaggggaggattacttgagctcaggagttcatgaccagcccgggtaacatagcgagatcttatctgtactaaaaataaaaaaaatttagctgggcatgggggcacgcgcctatagtccagctactccagaggctgaggtgggaggatcacttgagctcaggaggttaaggctgcagtgagccctgcttgagccgctgcactccagcctgggcaacagagcgagcccctgccttataaaaagaaaaatgtgtgtgtgtgtgtgtgtgtgtgtgtgtgtgtgtataatatatatgtatgtattatagaatcagaattaacaatgaacatttgtaatccattttgatgaaagggatcccccaactttgcaaattgttatcccctcaaaaagaaatctaaagtccgctgggcgtggtggctcacgcctgtaatcctagcactttgggagactgaggcgcttgaaccccaggggcagagattgcagtgagctgagatcacaccacttcactctatcctgggcaaaaaagcgagactccgtctcaaaaaaaaaaaaaaaaagaaatctaaagtctaaaatatttaccatctggtcctttacaagaagagtttgctggccgggcacaggggctcatgcctgtaatcccggcactttgggaggccgaggcgggcggatcgcaagttcaggagatcaagaccatctggctaacatggtgaaaccccgtctctactaaaaatacaaaaaaaaaaattagccaggcgtggtagcatgcacctgtagtctcagctacttgggaggctgaggcaggagaattgcttgaacctgggaggcagaggttgcggtgagtgagccaagatcgc

SEQ ID NO: 20208 - DNA, 1058 bp, Homo sapiens
tcccaggagagggatggtcctaccagtttgaggaatgggtatcccagctcagtgccaggcgtggtacctttgtgtagcaggagggcacagctttttgtctaaccagacagtaaaggagaagaacctttgcttcaaatgccaaagggaccagaagagcatcaggccatagggaggcttccagatttctgcctggggtcttcaggatgtacctggagcccagagatgaggcccttgaaatttgcagtttgcctcctgtacctcacctcatcctccttttctcttttccagttcccttcctattccacgcacatccacgaaggtactgggagctcttagaaccagacatactctgtttctaagctcatactgtttctgttccaaaaacaccttcaaattcttcatccactagtacctctcctcccctcttcccccttcctccttcctgcatcccagcctgggtcgaggatcccttttttggattgacttctgttcccttcatgcttctttctgcagtctccaagcctctggcaccatccttctcgatgacgttagatgtcctatcccaagccatttgttgcttgcatttttaggctcgagagactaaagagaactatactaactgcctgtccttctggggccaggggcaggggagcccagtctaggagaccccccaacctagacacatgtagcaaacaaaaacccagatgtaagggggtaagtgggtctggggccttccactgggtggaatgtgggagaagagatttgggagtgtcttggctgttacacatgcagggcagaggagagagaccagtgaaggttgggaggaggcggccaaaaggagacagcttcatgcccccaggacataaatagcccggctgctgcaggtactcacatgaggtgacacgactggggacagaacaggctggagcggcgggggcgggggcgggggcgggggggcgggtatcttcagaacttcagtatgagattttccccaagcacagatctaggtagtgctaggaaatgtctctgggcggaggcgggcagacaggacggtaatt

SEQ ID NO: 20209 - DNA, 1053 bp, Homo sapiens
gtagggccaggactgacccttagagctcctttgtgcaaattagaaagaggtgccttttccccttggtgagtacagtctcaccccaagacgtgttgttcagtccccactcatctcactggtgtccttgtgtagtgaatggccagcacgacgttctcagaatccctggtgctagaagttggtgctcctttctttcagtactcatttctaggtgcccgctttgtgccaggtcctgtggcaggcactgaggagacagatgacaacatgctgctcctgccctctagagggaaacttcccacccagtggacatttgtcaagcacctgctatacaccagccactgagtgcccagagacccgcccacccccactgatcccggggctgagacccttgagttgtaacatcaggggacaagacccttgtccgaggcagggaccctggatggggatgtgatttctcctggaagtatcaaagaagattcagaaaggagaggcatttgggttggacatgactggcagacggtgtcagaagtcaggagtcaggattggcataggaagcagctgaaggaagggcacaggggcttgggagaatacggacccagcgtagcatgggcgtgaagatgcagcgtgggcagtagacgaggtggtcagggtcagatagtccctcgggaggtcacatcccactcttctctgtccctagagtctgctttggatgacctggacctgaatgagtttggcgtggccgccctggagaagactttcgataacagcacagtgccccacccaggaagcatcaccatcggtactgggtgtgggtgggcagggcagcctggaggactcctcgggttcctgcctggctcaggccccttgctctgtgtggcccgcctggcttccgctgccctcacccagcccgtcctccccgggcctctcttgcaggcggcagcttgctgcagagctctgcacccgtgaacatccccggctccttgggcagctctgcctccttccactcagcatccccgtcccctcccgtcagcctctcctcgcatttcctgcagcagc

SEQ ID NO: 20210 - DNA, 1024 bp, Homo sapiens
gcgtggggtgggggaaagcgggggctggaagaacagagcagaaactcagttttgttcgctcgctctccccctgggaggactcgctttgccagtcaggaccctgggtggttactgttgttgcaggcttcaaattctctctgtgagctgcttgtagtctgtcccaggatcacctgcctcctcccagtagcctcgcctctccagggtttcaagtccaaggttctgggttctgaaatgggccccctgtccagctgcagccggctaccctatgggtgctggccagaatcccagctctaccctgtgtccctgctgtgctaggcccaggtccctttccctggccacagaggggagagtctcctgcaggttctgaaacctctgtgcagacagcatcagcctcctccttgccctcctcccagagagccaacccagcttcccaccaggcctcgcagccagagtggcccccaaaagatgatgctctctggggacaggggcagggcagggccattgtgatgagactgtatgctggccccacaggcttgtgatgcctggaagaaagaggcggaggaggctggtgagcgggccagtgcggcgggcgccgagtgcgagctggcccgggagcagcgggatgcactggaggtgcaggtgaagaagctccaggaggagctggagcggctacacgcggggcctgagccccaggccctgcccgccttctccgacctggaggcgctctcactctccaccctctactccctccagaaacaactgcgggcccacctggaacaagtggacaaggtcagcccaggtcggggagcactgggtgggatgcacggtggcctcagccagctcttggactctgacctggtccaggctgctccagggatggccaccctcctgagagcctctgcccagcactgggccagcactcaaaaggccggcctgctgggaatgggtgaggagagtgcactggggaaggtgaaaaggctgggggtgaggggtgtcggtgccacccccagcacccctgagggcg

SEQ ID NO: 20211 - DNA, 1018 bp, Homo sapiens
agtcatcaaccaagaacagcaatatgaattagcaaaattccagcaagaaaaaagactaatcttaggacactgttctctaaaccacagagattaagacaacgttggtttaaatacaagaaaatacccaaaactagctgggcatgatggctcacgcctataatcccagcactttgggaggccgaggcgggcagatcacctaaggtcgggagttcgagaccagcctgaccaacatggagaaaccccgtctctactgaaaatacaaaattagccgggcatggtggcacacgcctctaatcccagctactagggagggagaggcaggagaatcacttgaacctgggaggcggaggttgcggggagccgagatcgcgccattgcactccagcctgggcaacaagagcaaaactctgtctcaaaaaaaaaaaaaaaaatacccaaaactaaaagcaataagggaacgaaaactctaacaaatgcaaacttgcccacagccatataggatctctgtccaacttctgtttgcctcaaaccagtatagttcaagtcttcctttcttcctctctcctttcaaaaattagggcaggccgggcgtggtgactcacacctgtaatcccagcactttgggaggctgagacaggtggatcacctgaggtaaggagtttgagaccagcctggccaaaatggccaaaccccatctctactaaaaataacaaaattagccgggcatggtggcaggtgcctgtaatcccagctactcaggaggctgaggcaggagaatcccttgaacccaggaggtggaggttgcagtgagctgagatcactccactgcacttcagcctggggcacaggatgagactctgactcaaaaaaaaaaaaaaaaattagggcaaatatatatttgtgatattactttataaatgaggcagaagcattagaccaacaagaggtaagaggtatacttaacaaatccattagcctcagactatttcacatcttatgcctcctatgaacagcatga

SEQ ID NO: 20212 - DNA, 1018 bp, Homo sapiens; identical to SEQ ID NO: 20211

SEQ ID NO: 20213 - DNA, 1853 bp, Homo sapiens
gaaagccgtagttttaacaacgagccttttttcctcccccagaggcctttctttgtttggcatctgcagagacggtgaaaagcagagctccaggttgaaggatcagagtaatagatggagcccttaacatgagtaagagtgggtgcaggcagggcctgagtggtcactagaaatgagaaagcacagttggtgccatcacatacattcacctcctgctttattctgaagttcaagtatgagaatacgtgttgacatacaagccagctatggtaagaaattactcaaaattcagaatgctaattattttaatgataaaaatgagtagcgtctttgcccgtgtgatttggggccactaggtgtcattgtaaccagcgtggatcctcgttagggcatgcagggatgaaagagacatggcaaatgaattttggatcgctaggatttaggaatctttgttattggctgagctgaggatgatttaaagttatccctgtctgaaatggtatcttttgtgaggaggtctgacttgctgaggctcagctgtttaatacaaatctggagaataaaccttaaggtggtttctgttagaatgaagcctgttatccttctcttttagattaaaggtggtggctgtggccttgaaaacagtcatgtgaaaactcatcaccttaaggtgttaagtgtaaggatcttcatgatgaaatttctgtaaatggtgagatttttagtactttcatagacttgaatatgcttatggtcctctttaagtattggtttgttagttttggggatgtgttggtcttccagggttacgattgcccagataatggaagtagtatggaattccttttgatagggtccttgccaagcactctcataaagagcattttttgtttgtttgttttgagacagagttttgctcttgttgcccaggctggagtgcgatggtgcgatcttggctcagcgcaacctctgcctcctgggttcaagctagtctcctgcctcagcctcccaagtagctgggattacaggcatgcaccaccacgcctagctaattttgtgtttttagtagagacggggtttctccatgttggtcaggctggtcttgaactcccgacttaaggtgatctgtgctgggattacaggcgtgagccaccttgcctggccataaatagtatttctaatatcaaccccatatgaggtaaatttttttccccactctgctgctgagtaagtaaaagtgaggcgtaaagagttcttttgcccaaagttatacaagcagttactgagttagactggcagttctgaactggggagcgatggtgttcctggcatctggtgaatgctactattaataaataccctggctgggcctggatatttatctcatgcctgtaatcccagcactttgggaggccgaagcagatggatcacctgaggtcaggagttcgagttcgagaccagcctggccaacatggtgaaaccttgtctctactaaaaatacaaaaattagctgggtgtggtggcgggcacctgtaatcctagctacttgggagactaaggcaggagaatctcttgaacccaggaggcagaggtttgcagtgagctgagatggcaccattgtactccagtctaggcgacaagagcgaaactctgtaaataaataaataaataaatatcctacaatgcatacaacagcctgcatgaggaataattgatccacccagtatgtcagtagagctgaggttgagaaactcctgtataccacacgttaggctaactagagatctgagctctagtctcagcctattttctcaccagagtcttgtttcttcatttgtgaaacagggttagtg

SEQ ID NO: 20214 - DNA, 2024 bp, Homo sapiens
gcaaatctctaatcctctgtcttaaaaaactgaaagcctggagggcacggtggctgacacctgtaatcccagcacttggggaggccgaggcaggtggatcatctgaggtcgggagttcgagaccagcctgaccaacatggagaaactccgtctctactaaaaatacaaaattagcctggcgtggtggcgcatgcttgtaatcccaacttacttgggagtctgaggcaggagaatcacttgaacccgggaggtggaggttgcagtgagccgagatcgcgtcattgcactccagcctgggcaacaagagtgaaactacttttcaaaaaaagaaagtcacatgcttgctccacaaagaatttgcgtgagggaagtgaacaatttgatgagaaaaaaatagtttgcgtgtgctgtggctgttagtgctatggtccagcaggttggtgggagctgagtccatgatgatttcaagttatccctgtctgaaggcaaagaaaggcctttctgtgtggaatttgaatatctgaaactcagtttcccaagtttgccttacagaaattttaagttacttgagagttactctgtgtgtatcttcttaagtagttttttttcttaatttctcttcccaggtgcagtcagcctcagtttccaaagccggaaaaggatcctctagtagccacggtgtggcagctgctctgaaccaggacctggacccggacccaaagtgccatgtctttaatgtgagtaagtagacgaactggtaaacaggcttggtttggtttgggggagtggtaatcttttttgcttcccctgctctggacttaaagcaatgggggcagggagactttagtagcattttgttgctaggtgtctgcaataagagacgaaactgaactgctttgccggaaacaagtgaaatgattgctttcctgtttgtaagatttgtttacatctttcgtatccgtaagaagtcccacaagcctatgatggttagttatccctgtctgaaaatctggactgagggaaataatctattctgaggcttaagggtttggctccatggttttttttttgtttttgttttttttcccctttttttttccctcagcatatcctgctgagagcccagtctagagcatcattcctctaaaacgtgaaaagcaaatgagtgattgtcctgctttctctagtcctttgattatggctctgaggatacaggctgtatgaggtggcaggaatgcacaagtacccaggatttgatttatgcccttattgtggaatgaaagtgcttgttacatatttcaagaaaatgaatgcgctcttagaaacagattggaatgtaggatgtatgccagcttgtggcaatgagaatgcttaatgactctgaccttgcctctgctccagggtcctgacatttaggggaaaccacggctgtttggtttctatgtgctttgttaaggacgccagggaggtctcctaagtttgtagcttagatcctgtctgaatgtcacgactggcatgtgagcaagaaagaaaccaagtggtgctggagagtggggtgcccagctttgttcccactggaatgccaggcttgaagtgcacacagattgcctttcttttctgttgaaaggggaggtgtgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcctgcctgggtgacagagcgagactccgtctcaaaaaaaaaaaaaaaaaaaagaaaggggaggtgtgtgcaaactctttgtatttaaggttgtgtttttgctggacaccaaagaagctgtattctgggtg

SEQ ID NO: 20215 - DNA, 1070 bp, Homo sapiens
tcctatattgaacagacctcgatgaaaatcttgaattcaccccagtgccctctgttggcaagggaaggtgaagattgaaaagttaaaaaagcttttggccacttgagaggatcagggccgcaactcttgaagaagcaaagggctcagtgcattggggtcagcgctggtacagctgaaggatgccggccttgtgcaggtccctccacagggcagcttccagggacagatcgtggtttgcataaaatatcaatggcttcatttttcgttcgaaatagtggtcggaaaatttccagtagttgcttgtgatgaatccataggcactgacctgggcaaggatagtcgctggattagtatttgttgagcgtctagtgtgtacagacacttgggtgaagtgacatgagtttagaaaggtgtccgtctgctgaggtgaggataatggtctagggcttattcccacttagcaagtggggagatggattcaggggtgactcactgtgtccccacttggcatagctggtgattgccagagctggatttggaactcaagggtggaggcaaaagcccattactactctctccatcctaactggggactgcagtcaagacactcctgcatcagaataggaaaaggccctgtgtggtggctcacgcctgtaatcccaacactgggaagctgaggtgggaggatcacttgagcttggaagtttgagaccagcctgggcaacatggtaagaccctgtctctacaaaaagtaaaaaaaaaaaaaaagagctgggcgtggcagtacatgcctgtgatcccagctacccagctacttgggaagctgaggcaggaggatcatcacaccactgcacttaagcctgggtgacagagttgagaccctgtctcaaaaaagagggaaaagatttaggtgtgagtcgtggagaggcatttggcccccagctctccataccagctttagcatgggtcacggcctctccttgaaagctgctgcttggcccctgcctccatgagcttcacgtgggtcatatcccatcaggaatgactcttaacggtgatttcaaagtagt

SEQ ID NO: 20216 - DNA, 1022 bp, Homo sapiens
aagaggacatagttggaggctgttagtctgtttttacattgctataaatacctgacagtggataatttataaagaaaagaggtttaattggctcattgttctgcaggctgtacaggaagcatggtgcccacatctgcttggcttctggtgaggcctcagggagctcttattcatggcggaaggtgaagtgggagcaggcatgtcacttggagagagagcaatagagagaagggagaggtcccagactcttaaacaaccagaccttgcatgaactaactgagcaaaactcacttatcaccaaggggatgttgctgagccattcatgaaggatctaccccatgatcgaatcaccccccatcaggccccacatctaacattaggaatcatgtttcaacatgaggtttggaggggacacacatccaaaccatatcagaggccgtagagtttggaagcctgaacttgcacttggggtttttggtctaagctggaaggagtcaagaaaaaggatggggctgggcgcggtgactcacacctgtaatcccagcactttgggaggctgaggtgggcagatcacttgaggtcaggagttcaagaccagcctggttaagatggtggaactccgtctctactaaaaatacaaaaattagccaggcgtggtggtgcacacctgtgatcccagctactcaggaggctgaggcaggagaattgcttgaacacaggaggcagaggttgcagcgagccaagatcacactattgcactccagcctgggtggcaagagcaagactccatctcaaaaaaaaaaaaaaaaaaaaagagagacagagatgggaactatgattttttaaataattttttttttactttttttttttttttgagacggagtctctgctcactacaacctttgcttcccaggctcaagaaattctcccgcctcagcctcctgagtagcttggattacatgtgcccgccaccatgcccagctaatttttgtatttttagtagagacggggtttcacca

SEQ ID NO: 20217 - DNA, 1036 bp, Homo sapiens
tggaagagtcaggacacattccagggtagggggagaggacacggtacccttgaaatttgtttattttgatgactgaaggaagacaggatttatattctcagggcaaaaagttcaaacattagagataaagctaaagccttttccttctctccctccttccctcctttcttttcttttctttcttctttctttttcttctttttgagacagggtcttattctgtttcccaagctggagtgcagtagtgcaaacagggctcactgcagcctcaacctcctgggctcaagggattctcgcacctcagccccctgagtagctgagactataggtgtgcaccaccacacctggctaatttttaaatttttctttaatttttactttatttatttatttatttatttattcgtatagagataaggtcttgctatgttacccaggctgtttttgagctcctgagctcaagtgatactcccatctcagcctcccaaagtgctgggattacaggcatgagctactgaatctggccttctgatttttctgtagagacgagtctcaccatgttgctgaggctggtctcaaactcatggattcaatcaatcctcccacttttgttgcggtaaactgaggaacggagagaccaatatggcctcccaaagtttaaagtctttctttactatcacacttgtctttaagggcggaggggagagcctttcttggcaaccatttcaaccccactgttagtagtatgttatatacccctctctatagaactctctaggtaatatttatgagggtgtaacataaatgagatcatattacaccactgctgtgcaattgcttgttttacttaaccatgtgtcttttttctttttcttttcttttctttttttttttttgagacagagtcttgctctgtcgcccaggctggggtgcagtggcacgatctcagctcactgcaacctccgtctcctgggttcaagagattctcctgcctcagcctcctgagtagctggacttacaggcacccgccaccaca

SEQ ID NO: 20218 - DNA, 1032 bp, Homo sapiens
ccatctgggcccccacctttttttcatgccaatactccaagttcacgccccttttttgctcagccgtcagccccgtctccgtctgaagagtgcttctgccctcatttgcctctccctgtgaccccggccccctcagactccgctgcgtcgtctctcggccccgtccagccgttcctgactgctcttcgccggagtccgcttcccaaccccctttcgccagagcccgagagctccgtcggctctgcgtcctggcggtggggactccccgcggagcgcttgcgcgtgccaggccacccgggactacgtttcccagcgggccgagcggccggcgccgcggctgcggtcaggtgacccggtcgcctggccgcagtgagtcaggctgggagggcggggccgcgccggctgctgcggctggcacttggccctttaatccccttcgtgggcccctcaacctggagcggataaattcttggcgcttctccgggggttgtgctcttccgtactcggatcgcttcttaggagtatcctaactgccggtggggagaacttcgccctaaacctggggttccgatccaggaactggaagttgacagcttggctgcctggctcctgcatctgccttctccactcaccatctcatttctttctccaggattgtcagtggcttcgccccgaggagagctgactgccctgggctgctgcctccggcagagctgagccaaaatgtccccggaatctaaaaagcttttcaacatcattattttaggagttgcctttatgtttatgttcactgcctttcaaacttgtggaaatgtggcggtgagttggaatctgtcctccctcctttgaagtgcccatcataatgcagtccagaaatgaaaataaacgttcattatatctaatagcgcgctttaattgcatctttcatttttcccacccagacttcctcattttttatgattaggtttgatttcttgtgtcagacatttctcatgggggcgttaagcattatcgtttaatctgatttgatta

SEQ ID NO: 20219 - DNA, 1047 bp, Homo sapiens
ctcccatgggtgtttgtttgtgtgtgtggatgtcccgctcttttattgcaagtttcatattgtctatatttagatttggcttagaccttgagcaacgtttattgaaccacaggtgtttttctctgtgagtatgaaaacattctcccctcccctcccgagttttcccataccccaacttgaacgcctttaaaccagggcttcggctgcccacacaggatttctttcctctaggagtttttgttggttggttggtttgttgtttgttgacttatagtaagtcccttgggggtcttttgttttttgagacggagttttgctcttgatgcccaggctggagtgcaatggcacagtcttggctcactgcaacctctgcctcccaggtacaagcggttctcctgcctcagcctcccgagtagctgggattacagatgcctgccaccacgcccagcctatttattttttgtatttttagtagagacgggatttcaccatgttggccagactggtctcgaactcctgagctcaggtgatctgcctgccttggcctcccaaaatgctgggattacaggcatgagcccccactcctgacccccttgggagtttttaagttctccaagtacaaataagtccccattaatagtcattttttttggatcttcacacccattgggatggctgctacccagaaaaaaaaaaaaagaaaaaaggaaggtgttggcaaggatgtggagaaattgaaacccttgtgcactgtgtgtggaaatgtacaatggtgaagctgctgggaaaacagtatggcagttcctcaaaaactagaaataccatgtgatccaataatttcacttgtgggtatatacataaaagagttaaaagcagacttgaagcaatatttgtacacccatattcatagctgcattattcacaatagccaaaaagtcaaaacaactcaagttattcatccatagaagaatggataaacaggccaggcacagtggctcaagcctgtaatcccagcactttgggaggctgaggcaggcagatcatgag

SEQ ID NO: 20220 - DNA, 1035 bp, Homo sapiens
agtgggaccagtagtgcagcaggcagggtgccaggcctaaggcgctccagggaacacagcgtcaccccaaaagccacgctgtgggctcagcaccactggggtgctgcgtctgcaggaacgagctgctgaccaggctctgtggtcagtcaggcctgagtgctctggccacggcaccgctatggtgtcccagctgtgagacaccttatgggatgaaacattccttttttcatctcagtcctttggggaagggactactccagcccgagctatgagcgacagcccaccagggctgcccagtgaggccacgcaggctgtgcgctgcacgactccacgacagacaccctttaggcggccacaataccagtggtgtcctgtggagttgtagaaagcagtggccaggcaggtcatctgatgtcctccagtttttttagctgaaatgatggaaatctcttcatctactctgtgctacaagcactggttgcaagctcggtattgaatttggatgatgggcttgggcagacatctctgaaacgagagtgatctgaaaaagtaaaccgttgcccccgcctctgggaagctgaaagagagagggagctatctatatcctgttttctcccactcctttggagaaggactactccagcccaagttatgagcgatggctcaccagggctgcccagattaaccgattgagtgtgtgagtgcgtggggagggcctgagaggctggagagacctgagttagtgtcatctaacgctagtatgaaatttcccggtcccagctgagtttttgaaaatccactctgttttccgtagagggacttgtggggaggtcctttgctgcttcagctcttggggtggggaggaaatatgcccattttctccaatacccgaccccctccgtgagccttcctgggcatctctgcctctctctcctccttttcttctgcccgccacatcccccctgctcccattcatgcctgttcttcagagccaggagccctgtgtctttaaggaaatcgcagcttctcctgttt

SEQ ID NO: 20221 - DNA, 1073 bp, Homo sapiens
aataacgaagctactgatcaggggaagcccctgtatcctacatcaggcctgttacatgattattggatttaatcactctcccagctgtactggttaggattagatctggctgtcgcagggaaaccccaaaataatcgtgatttaaacaagatggaagtatattttctttcctgcttgcaaatttcagaggtcgggagggctggtgtggcgttccccggggtcttcttaccttgacccatcgtgtttagtttccaccttggccttgcctcatggttcaagatggctacaggtattagagtcattatatctgcatcccagccaacaaggagaaggaaggagcagagcgggacaccacgtttcccacactgctcatcagctccatcttggccacagggccatgcccacttccaggggatgctgggtggcattatttccaggcagctcagctcaatgtgcccagccctgttctgggttctatgactgaggaaggaggagagaaggaggactcagggggatctcaccatctgggttgtgtccacccaagacgctactgttcactgagagcttgctatgtgccaggcattgtgctaagggctcacgtgcatctcttatttaaccttcacacaatgaggtaggtgctgcatgtgatcctgcccactctataaatgaggacaccagggcacagtgggttagaaggtgacccatagctagtaagcgccgagctgatgttccagcctacatcaatctaagtccagagccaggggtgcttggccctgaccccacagcctgttcagcattatgaagccttggagaatggcagagagaaggcttgaaagcaggaatcaaggtccaagacctctgctgagatgtcagaggtcactgtggggtgtggagcggggagctgggagatgaggctccccatgccgattgccacagctgcagggaagcccgggaagctgtgggcactgggtgctggagaagagggcagagtcggagggtcgtggaacacacagggtctacttttatcagaaaatgctgttaagaaactggcccaagagaatgagaggttatga

SEQ ID NO: 20222 - DNA, 1062 bp, Homo sapiens
ccgtttaaccttatttcataattatgcacacttcccagcttgaacttgaacatttgtttctgtcttgttcccgttggcccggacacacagtgctgtttcctgccccctcttttcttttttcttttcagacttctttgcctcagatgtttgccattccccatctgtctctccagatcttacccatcttgtccttccacacgtccccgatgcctctgaagatgccattcatgtttctctcccttccccgggacacattcttaatgttggagttggtgttaggtactttcacttgcaatgggagtttctttattcacaaagcctcttgagtgttgctctcatactattttgtgtgtccttccagggcagtgaccttgacagttatttgtcttgttctcccaagcgcgggtgctaaggacatagtctgtgggcatgcagatgtgtgtgacttgttcacacgaactgtgaggatgaggacttggtgaatggtggaaattcagatccaaactgtatctccagggcatgatggcgcctgtctgtagtgcagttacttgagaacttgggagggtgagttgggaggatttcttgaggttccaggagttcgagaccaacttgggcaacatagcaagatcctgtctctataaaaaaataaaattaaaataaatggtcatggtggtgtgtgcctatagtcctagcttctcaggaggctgaagagagaggatcctttgagcccaggagttcaaggctgcagtgagctatgatcacaccactgtactccagcctgggttacagagcaagaccctgtttcaaaaataaataaggaaataaaatgcatctctaattctgttttcagacaagagatttatgttttctacatggaacagaagtaacatgctatggtctttcagttaaccagtgggtcacctgggagcaaagcccttttgtgataaagttggctgatttgtgttttttttttttttttttaattttcgtaaacgttgcaaaaccttgttggtaaacactctcctggcagtttaagtggtgtgcttttccaggttgaataac

SEQ ID NO: 20223 - DNA, 1035 bp, Homo sapiens
gaagcaaccagactatttcccactccgaccttgcctttgggcttaagaaactgtcaccaggacccagttttgacagtgacaaatcatcatgagcccttactgagtctctttgcactgtccccagccactttatgtccgattagagacacgagggagagaaaaacctgctgcctgccctctctgagctgagaaccagtgaggggcaagaggccggtgcaactcctgaaggagagaacggggtgcagagagaagggggacccttccagctccatctgcagagccatctcgtttccgttgggtgaatgttcagtcccaagttgaaagttaagtccttgtctggctgccaagccctgcctgtcctttccactttgccagggcggtgtattagtctgctctcgcattgctataaagaaatacctgagcctgggtaatttataaagaaaacgggtttcattggctcacggttctgcaggctactggaagcatggcggcatctgtttctggggaggcctcggggagctttcactcatgtggaaggtagagcgggaacaggcttctgatatggcaggagcaggagcaagacacagccaggggaaggttgccacacacttttttttttttgagatggagtcttgttctgtcacccagactggagtgcagtggtgcaatctcggctcactgcaacctccgcctcctgggtttaagcaactctcctgcctcagcctcccgagtagctgggactacaggtgggtgccaccacacccggctaatttttttgtatttttagtagagaacgggatttcaccatattagccatgatggtctcgatctcctgacctcgtgatctgcccgcctcagcctctcaaagtgctgggattacaggcgtgagccaccgcatccagcctgccacacactttttaacaaccagatcttttggtaactcactcactatacagtaccaagggaggatggtgcattagtccatcctcattctgctaataaggacatacccaagactgggtaacttataaacag

SEQ ID NO: 20224 - DNA, 1024 bp, Homo sapiens
ctcccaggttcaagtgattctcctgcctcagcctcctgagtggctgggattgtaggaacgtgccactgcgcccagctaatttttatatttttactagagatggggtttcaccatgttggtcaggctgatctcgaactcctgacctcgtgatctgcctgccttggcctcccaaagtgctgtgattacaggcatgagccaccacgcccagcctgcctcatttgttaaatgggacagtgctatgttgttgtaaaggttaaacgagttcatatttgaaaaagctgagaaatgcctgctctgtaacctgttagctgctgtcatgatcatgattgtcattgacaggaggatggagaaggctggggttacgccattgctaggacgttccagaagcctccatgatcttcccttactgtggtcagagcatggtgcagggtctctcccccagcccctcagcactggagccagctgcactgtacccgccctggctctctaggttctgagttttgggactccctttgcatactaggtcacatggaacttgccgtcattcccaggctcccctggaaactctctgtgggtggcagcggcaggaggacttacccgaggccgatgagccacagaagcgggactgaggttgcgtcacacccctactggcacctgggaattactctggagattctttttttattttttatttttttgagatggagtcttgctctgttgcccaggctggagtgcagtggcacgatctcggttcactgcaacctctgcctcccaggttcaagcaattctcatgcctcagcctcctgagtagctgggattacaggcatgtgccaccgtgcccagctaatttttgtattttttagtagagatggggttttaccatactggccaggctggtctcgaactccggacctcaggtgatccacccgcctcagcctcccaaagtgctgggatcacaggcatgagccaccgtgcccagccactctggagtttctctgtggctttcaggagattcctgaagggg

SEQ ID NO: 20225 - DNA, 1050 bp, Homo sapiens
ggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggcggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcc

SEQ ID NO: 20226 - DNA, 1045 bp, Homo sapiens
accaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaagatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcttgggcgacagagcaagactgcctcaaaaaaaaaaaaaaaaaaaaaaaaaaaggagattctgacacatgctatagcatagatgagccttgaagacatgctaagtgacagaagccagacatgaaaagacaaata

SEQ ID NO: 20227 - DNA, 1068 bp, Homo sapiens
tttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactacaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggtttt

SEQ ID NO: 20228 - DNA, 1032 bp, Homo sapiens
gctcttcgcatacttggtccgcaccgggccgtgtgttccaggggcagaacagggaggaatctcagcacagacagcagggctgccagtacagcgttgagtatagggttaatcaaagcacagggctccctggaaccacccaacacagagcagtgaagaggtggctttggggaaagtggggtcagagctgagcctgagtggggggtggggagggcgggcatcagcctgcaagggagggacacctactgggccccagaagttcctggtggggatcagggactgtgaagttggggagagggtgaccactgtgatttagggaggaagggccccatagacagcccagcttctggccccgtgtttacaggacaccccacataggctctgagcctatccctggactgtggactccctgaggcagggtgtgcaggttcgtccagtaccaggtgtaaggcagggggccttggtaagcgtcgagggactcactggtgtctgatgaagcagtgagtttggatcgtgtcatgcctcgggtcctgagcctgcaggatttttctgtggggctgtgtgcttctgcttctggaggtgtccagaaggcactgacgttcctgccgggatgccttactcggaaggtcccgctgctcccacctcctcccattttcctgagctgcttgcagagggcacccaggtccccttttactttgggattgggtctctttctctttccccttctaagaacaagtaccctccttctccgaactgtccctggagcctctcagacctaggtctagagtgggaagtcccgcatgtgctgggggaacaggaatcaatgcgggaggattggccaggcccggtgtgtctccttcgtggtgggacggggtggggccagagaacagagcctggctccagagcccaggaagagaacccctcccctcgccggcctgccaagcaccgtgcagtggtgagaggaaaggagggctggtccgggaatgcagcgggtgccgagcagctgtggaataccttaaatagagcgcagctgcg

SEQ ID NO: 20229 - DNA, 1035 bp, Homo sapiens
ctggtgattgtggtggtgaagggggtgatggtggtgattgtgatggtggtgaagggggtgatggtggtgattgtgatggtggtgaagggggtgatggtggtgattgtggtggtggtaatggtgatggtggtaaaggggtgatggtggtgattgtggtgatgtgggtggtggtggtgatgtgggtggtggtggtgattgtgatgggggtgatgatggtaatgtgggtgatggtgattgtggtggtggtggtgatggtgatgattgtgatggtggtgaagggggtgatggtggtgattgtgatggtggtgattgtgatggtgatgtgggtgatggtggtgttgatgggggtgatgatgttagtagtggtggtgatagtgatggggatgatggtggtgttgatggtgatagtggtgggatggtagtggtgatgtggttgatgatggtgctggtgctgatgattgtgatgacagtggtggtggtgatgagggtgacggaagtggtgatgatggcgggagtgatgggatgatggtaatagcagtgatggtattgtgatgatggtgctgatggggatggtggtgatgataagggtgatgatgatggtgatgataataataaaagtaacaataataaagggatacaccttgcagtatcccagttggcatctcctagatctaaggtgtcgtggctggaacattgacataactcctgacctgaggttggccaggacacagacctggtggacagagagagatggacgaggagtgtccgtccttgggctactaaacagttcaggccagggattcccagcaccagcctctgtcctcccaggagcccacacttttcctagaaaggtgttatcaaagtcagaacatcagtgtaatttagggtgttttttgtgttgtgtttttttgagacagggtctcattgttgcccaggctggagtgcagtggcatggtcttgactcactgcagcctccacatcctgggttcaagtgattctcgtgcctcaggcatgtgccaccatacctggctaatt

SEQ ID NO: 20230 - DNA, 1023 bp, Homo sapiens
ccctcccagccaaagccccacagcaagacggctgctgagccaacgacagcccttctgtgtggacatgtaggggtgtggttgggaccccagaactcatggacgagggtgcttggagctggccctggcccgcctggcctgtgcagtggtgtcacctgtgtctgggacacacccgtgtccttcctctgccccacactcacagcgtggccgactcggcccggggccctgtccttgccagcagggacccccgtgagccccgagccagcacctgagagtgtcgacacctgcttgggggtgggtgcccccccactgccccgctcccccagatgagcctcacgcacatccctctgcttcagcctcaggcccctggacatcgagtttatgaaacgcctgagcaaggtggtcaacatcgtccctgtcatcgccaaggcggacacactcaccctggaggagagggtccacttcaaacagcgggtagggttccatctctacttgccccagcccttctgtgcaacctggagacgctgcaggcctggcaggggccaccccgtctaaaggagtcacactgtcagggagaccgaaccgctggtcactctccccagcgggtggctggcctggtggtccctggcccaggtggctgctgggggccgtccctgagatggcctctccagctcccccatatctcaaaagcagctttgtgggagtgccaattctccagcagagtctctgaggggggttttggagaagacctggaccaggcagatggtgaatctctcttccagggagtgaggccgagcaggggccgtgcgacatggcccaccttgttttatgccccccctttttttttttgagaaagggtctggctcagttgccaaggttgcaatgtagtggcacaatcatggctcactgcagcctccacctcccaggctcagtccccgagtagctggaattacagacgcacaccaccatgtctggctaatttttgtatttttagtagagacgaggttttgccatgttgcccaggct

SEQ ID NO: 20231 - DNA, 1093 bp, Homo sapiens
aggcctggctaatttttgtatttttaacagagacgagatttcatcatgttggccaggctggtctcgaactcctgacctcgtgatccacccacctcagcctcccaaagtgctgggattgcagacgtgagccgtggtgcccagcgtctacgccccattttcgtaagataatggggataacaaaggaatcacaagagacacttgcaggtgtgtgaagacgaagttcatcacatgggagggcaccgggtgtctttatttgccttccctgcccggctccccacctccagtgatgccgttcactgccctccttgttaaaaggccttctgttatataacagttacacatgccaggcaccgcgtgttcatataggagttacgaagcacagcaataaaatgaccactctgagatggccaccagctcgagcccgagggcacttgtgggtgcccgtggtctcctgcccagtctccctgagaagtggccactgtcccgagcttgggcttgtatgtattgtgtgaagtgcacatgtccctgagcaatgtttagcattgctgattcttgagcttgtgaatggtcgtccacagtacgtagcccctgtgtgtgtccctgtgtgtgtgtgctctgagcgcacacaaggtggatggggccgtgggggtaacaccctgtgggccacaggttttctttaaaatcccagctccgattcctgcttcatcccattcccagcagcccagccccctgcctgtcttcaggcccctgctgggacgtcctgctctccctggtcaccccagtggtgcgggggcccactgccctggcttctccactgtggcttccttccatgctcctatttggcctggtcactgtgccatctcccattagccaggaactttctggagagcaggagctgagctgtccaggagcaggagctggtgctggtcactccagtatcccccagactgagggcagtgccaggtgtcctatactcagctgcagagcaggtggttcccctgccctcctgcccatggggctgccctcagactctgcttttggcaccagcatttctgggcagggggagagaggtggggtccgggcagagtttctc

SEQ ID NO: 20232 - DNA, 1047 bp, Homo sapiens
gcctctcaggttcaagcgattctcctccctcagcctcctgagtaggcgggattacaggtgcctgccaccacgcccagctaattttttgtatttttagcagagatggggtttcaccatgttggccaggctggtctcaaactcctgacctcgtgattcgcccacctcggcctcccaaagcactgggattacaggcgtcagccaccgcgcctggctgagatgtagtgggttgttgttgttgtttgagacgtagtcttgttctgtcgcccagactagagtgcggtagcgtgatgtcagctcactgcaacctccgcctcccgggttcaagcgactcttctgcctcagcctcccaagtaactgggactacaggcgcccgccaccacacccagctaatttttgtatttttagtagagacagggtttcaccatgttggccaggatggtctcttatctcctgacctcaggtgatccgcccacctcggcctcccaaagtgctgggattacaggcgtgagccaccgtgcccggcccgagatgtagttatttaaatagcttatgcacatgcctatttagccttggatggcagaattttgattgggtagatcttaagtcttcagaaaatggtttgttctctttaacttgtgattttccaactaaatcttaaattagtgaacgtgagtttaaaaattcagcctttaggaacactcacaaaagttctcattagtttctcttactttttatttgtctttcccacaacctttcccccctgttttcccacttgccctcctgaaactgcacttgagagttgggagtagagagagacctggtttgaggcaacagggtgaacacagcgttctttcattctgtgtactgttgtgacgctaagcctgttagcgttgagataccagcccacagctggtgaaaggattccagacttcatactggcagtttattgagtgcctaccatgtgccaagtacagagcacttaatatgttatttcatttattctccttaataagaggagaacactgaggcactctgaagaagccaggt

SEQ ID NO: 20233 - DNA, 1006 bp, Homo sapiens
caaaacaaattaataaactttcttaaaatactatgagatttgtgtgtgtgtgtgtgtatgtgtgtgtttaagctcatcagttattaatgttagtgtattttatgtgtggcccaagacaattcttcttcttccaaggtggcccagggaagtcaaaagattggacacccctggtatagataaaagcaggtaattggcctagcctgggcgacacagcaagacccttgtcttttaaaacatgaaaaaattagctgagcatggtggcacatacctgtagtcctagctactcaggaggctgaggtgggaggatcacttgagctgtggagttcaaggttacagtgagctacgatcctgccactacactttggcatgggtgatagaccttgtctcagaaaaaaaaagaaagaaaagaaaaaagtaggtggggggtataaaattcttgttttagtaacacgggcaatgtaaagatgttataattttagtaaagatatatgaaataagcctcacatatccatattgtaaaatgtctatctgagacccaagtctctggaatttgttatctaaattaatctattagtggtatcattaacacatgcattagttacaggtgtcttgtaataacatttatttcacaccttgggtgataaagtgcttgaattggtttctgtctttgccagatcaaattctaaatttcctaaaatagctaacatgaaaccagtctcctttatgaacccttctctgacttctctcatgataaactttctcttctctattcattcctttggtcatctcattcagtcctgtgacattaaataccacatacgcactgaagacaccaacctagactgctccccagactcaatatttccatatccagttgcctgttccacatcttgatggctttttaatgggcatttccactgaacagatccagaactgcacccctgttcttgccccaaaataacctcaggaggttattttgtcttcactgatgaattctgtcaaacat

SEQ ID NO: 20234 - DNA, 1029 bp, Homo sapiens
gggtaaaatctggtcttttgaaaatatgaaatagcattgtgattatgaggctttgggacatcatgtaagagtaaaggttcaacaacagaagtggaaactaatttacagttgccatcttttactcttgccacataagacttgaataaaaagtaccatgatatacttttatcattactttataaagtaaaggactttctcatgcaaagaagtggaaaggataccatcttataggagaatcctataaattgaataaatgcatctttatgaaaaatgtaggtcgtctttatttttctcattccatggtgttataaaactttctcaactgatcatggtctttagagtgagttgtcaactctgggctagatttctaggaatgccacttattagctaggtgactttgggtttaatttttattttctctgagcctttgtttgctcagctagaagaaatgaataataatatatactattacaggattattgtaagaattaaatgagatagtatgtaagtttctcacattgtaggctcatgttatcttccttatattcagccctgcgtagtctgtttctcactatcacacatttgctctttaattacatatttgtgtatacgtttctgtaatttcaaagaagtgagtcaaatttaaccctatcatagacatgactatagtaatcattttggtatgttttataaggtgggtgagggaggttgttttgccctgaaaacatctacaaatgctagcatataaaattgagcaaaagatgtgggatagagattgaattcatattctttgtgaagactattaggatttgttcttgtgatgatcagattgtcagttcagtttactgtatttcacacacagtagccccagttagggttccagaaatgcttataaatttgtctcctgtggtattatcttaatgtggtgttggattcttcatcgctgaagtcagctattcaggtaaaactttatttggtaagatcagatacctaagcaatatatagtcactaagtcacttcatatataaa

SEQ ID NO: 20235 - DNA, 1948 bp, Homo sapiens
agcctcagcctatctccacagttttgtgcatgcaagattaacattcagtcaaaaactaagcatataaaaagaggcaggcgataaggttacccacaggagatctagatattagggttatcagacatggaccttaaggtaatgttgataaatatgtttagtaaattaagtgacaaatggaggatttcagaaagaactggacactattaaaaaagttaaatggaaattctggaattgaaaagtgcaatatagggtgacaatagtttacaataatcttttgtatattttaaaatagctagaagagaagaatttgaattttttaacataaagacatttaaggtgatggatatcccaattacactgatttgatccttacaaatcatatgaatgtactaaattatcacatgaatcctgaaagtatgtgtatctgttatgcatcaattaaaaattaaaaagaacttttaaaagtgcagcaactcaaattaggaattaaacaggagggtttaatagtattcttagctgaagaaaaaattagtaaactagaagatagatcagaagacaatatccataccaaagcacagagagacaaaaggatggaaaatgaaaagaaaaagaaaaatatgtaagagacaaatgggacactgttaaaagtctaaaatacttataattggaatctcggagaggagaaagaataggtcagaagcaatagtaaaagacataataacttgagaatcttccaaaactaatacagacttgcatatttgagaatcactgtagctctaagcagaatcaataccaaaaaacaaaaataaagggaaaagagaggaaaaattgccaaaacaaagaaaatcttaaaatcagccaaaggaggaaaaagatacattaccttcaaaggagcggcagtaaagacggacagtctactttgcaaagaaatggaaatcaaaatacagtggaacgatatcttcaaagtgttgtaagaaaataactgccaacctagaaatctgtatgaagcaaaaatatctttcaaaaatgaagtgagaatatagacatcttcagacagacaaaaattagaattcatcaccagcagatctacactagaggtactataaagaaagttcttcaggtaaaaggaaaattatcccagctggaagcatggagatgcaggaaggagtaaagagcactggaaaggatagatagacgaatacatctaaaataatgtgaactgtgtaaaacagtaaaaatattgataggtgcagcaaaccaccatggcacacgtttacctgtgtaacctgcacatcctgcgcatgtacctggaacttaaaaatttttaaagtaaaaataataaatggcaacagcaacacagaaagctggaagagagttctgatgggggaaaaacacaggttatttttcctcggctctcactctacaacagtgatcatcacagaggacttctttgaccaaatgtgtggatttctccccacgtgccaagcaagcagtcagttctgcagtggacaccagctgggtcggtctcaacacagaagacttctgtgagcaaatgtgtgagggtttcttctcacacatcaaacaagcaaggagttctgctgtggatatcaggtgggtaccctccaattccatttcaacattatctacctggagataactcagatctcacaggttgaagactcagtctccaggactgtccctccttgagacaccagttgcaagtctgggcctccagaacttctgacccactagcttcaagttgggattcccaccacccctctttgggttcagttaatttgctagagtggctcacagaactcagggaaataattacgtttaccaggttattacaaaggatattatgaaggaaacagatgaagaaatgcctagaacaaggtatggggggtgggtgcttccatgccctctctgttgcaccgccctcctggca

SEQ ID NO: 20236 - DNA, 1049 bp, Homo sapiens
atatggcgtaaattcacagaccaactttcatattatacttaatggtaaaaccctgaaagcagtctcttactgttataccttataacccacccctagaatttctgcttcccattctagcaactgagttctgctgggatttggagttcttattttccaatagggaatgttactaccagaggacacagaaaggttccattgaattgaaagatgaggctataacccatttgggactgttgatgccactgaaccaacaggtaggaaaagaggtcactctcctgactagagtgcttaattctgattaccaaggcaaaatggggtaatgctatacaatgggggcagggaggaggatgtttgtaactcaggattctctagagtgtctcttagtacttctttgcaccatattagagacaaaatgaaaaactgcagtactcaagaaaaggcaggtctgttgaggagtcacatgtttcaggaatgaaggtttaggtcaccctgtcatgttgagaaccctgactggctgaggttctaattgaggtcacaagacatgttggatgcatagtgagagaagaaagttagggacaccatccatgcgttcataaccaggtgcagaagcaaggattgtagtaacttagcatattttttcttgtgtctgtatgtttatatgtattaactttgctttttccccccttattttatatataattactggaagttaattaatttgatctttagagaacagaatatttagtgggactgttaactgaattttaaggagtaattaatatagccagtgattaatacaatgtctgttcggactgcagctcctcattttggggagaaggtgagaacatgttcatttataggaaggtagctgcatgttaccttcatgtggaatcagagttgttttgatacttcaaatatagagggtgtgtatggaagccaagtagccaaaggggtggactgtgccaattatttattgttgctcagttcccagtttatgtaaatccacatccatttatgccctgcttttgatacaggagatgggcactgta

SEQ ID NO: 20237 - DNA, 1020 bp, Homo sapiens
cagccccttggcagacctttggaaggatggacttttgtttagggatgtcatgtgattcgagttgggcacaatggcatttagtgggtaggagccagagatcctaggtattctgtgcctggacctacttccatgcaagtaagactattagtacatctgttatgacttctgaatttcgctctggatattatttgggtgaaaaatttacttaagcttagaacctattttacatgtatagaattttttgtgctgttgtaatatatgctgagtttctggaaactctgaaaagcaactgtcatatacattcagggaaggttgtactttgtctgggacttgctcagtagttaattcatcatttgggaaatctcttcacctgctaatcagtgccagtcatggaatttgagttgcaatgccaactttattttcttcatagtacttaggaaattacttatgaaaaactgaaattactttgtttatttacctgtgtttgtatttgtttacccactaactgtaagctcttgataatagggatcttacgtatcttgtcagtggatatccttatacctaaaatcaactctggcacattgtgtggccagttattaataaatgatgcccaaataatggacagatgtttgaatgagtgaatcatccccttgggcgtgatctttatatgctgttgttccttaagcccccatctcaggccctctttcctgtttactctcaaactcccttcctacctgatctcagctataaccctcactttgatttatatttctgcattaacatctcctgaaatttttctccagtctggatctttcctgtgaactctggaattttacattcagctcccttccccagtttaatgtttcaagcatctcaaacgcgaggtgtccttctccagtgtttatcttagtgaacggaccaccatacacttagtcacactggtgagaagcctacggattgttcttgacacctccctctcccttatacccatatccaattcatcacccacttctgttcatt

SEQ ID NO: 20238 - DNA, 1027 bp, Homo sapiens
attttatttttattttttttttgagatggagtctcactctgttgcccaggctggagtgcagtggcacgaacttggctcactgcaacctccgcctcctgggttcaagcgattctcctgcctcagcttcctgagtagctgggattacacccgccatcatgcccagctaatttttgtatatttagtagagacggggttttaccatgatggccaggctggtctcgaattcctgacctcaggtaatccacccgcctctgcctcccaaagtgctgggattacaggcgtgagccaccgcgtgcggccctatcacttttttttattttaaaagaaaccagaaagccaaaaggtggcaattagcagtacattgactttatgagagtaataggaaatatttgcttcttgagattggtatatgaacatagtattagatttacagttcataccaattttatgctttgaattttagtttttgatgtaagatagtaatttccaggaagttgtttaagggacagaaacaacgagctataactaataaatacttgttagtatacaaagtatgggactatgcagctcacagtctcaaatgtgatctcagtttgctccagtaatcagtatactggtttgtgtttatttaatgaatgactaaagactaaacttaattagaacctttttttttcttatgaggtagttcccttaggatctctgtctaaacttttgcagggtgtgggcagcatctgaacctgttgcgtgtttgaaaacaggaaattaaaatgtttttctgttaattgatatttttcaggtaaattttcttcattttatgaaatttaagtttttacatttcacatttttaatgtgaaatattgacaagcttcttggtacctgtgggggttgtttcctgcagcaatataatcagtcacttttttttctattttgtttcattatagaaactattggctgggcaccgtgtctcccgcctgaaattccagcactgtaggaggctgaggtgggcagatcacctgaggtcaggcgt

SEQ ID NO: 20239 - DNA, 1031 bp, Homo sapiens
ttgggaaaggaaaatactgatatgaatgaggtaagtgcatacaagagctgggccactcccagttgtgccctaagtttgctatgaaagcaaggacaaggaggggttgccttatcccagtcatcttaaacccgtccatcaggtcattaaaactgagcacccttaccaagctattctacccaaaaaagagttgaaactgtttttcagctcttttgagagaggtggaaggtgggaagctagctcatagagtccttgaacaccttcctaaggactttagatcttctggaccagagagggagccattggagagttttaagtaggagagtgacatcatgagatttgtgctttagaaagatcactgaacctgcagaattgaagacgaattaaacagaggaggagagagggctggaggcagcaggtacagttggatcagtgcataggtcagactccagcttactagctaagtggcgggggtagacagggaagggtagtgatgattgatagagtaggcagaacttagaaactaactgagctaactaatcatttgatccagcagatatttattgagcacctgctatttgcttggtactgtgctgattgctatgggaagaaaatgttaaaatagagatacacttcccactctcatggagctgagtcttatgaggaatggacataaatctcaaccacagtgatacatgtatccttactaactgggatggtgactgtgtgacagcatcaacaaaggagcccaaacttggcaggagttgtggaaggtatcattgaatctgaagggtgagcaggacccaactaggccagggaacactcctacatagagagggaacagcatctgtaaagagcctgtggccgtatggagtatgacattttccatgaactaaacaaacaggaagctatgaaatagcagggtatgaggtgaggccaaagtgagagatggggattggttcactatgcgaggcatcaaagaggagttgtgctcttttgcctaagagaataagaaggcttttccaaatcagttt

SEQ ID NO: 20240 - DNA, 1056 bp, Homo sapiens
gcctgtaatcccagcacttgagaggctgaggtggatagactgcttgagtccaggggttcaagaccagcctgggaaacatgtcaaaaacccatctctactaaagatacaaaaaattagctgggcatggtgatacacatctgtcgtcctagccacttgggaggctgaggtgggaggatcacctgagcccggaaagccaaggctacagtgagctgtgatcatgccactacacttcagcttgggcaacggaagtgagaccctgtctcaaaaaacaaacaaaaaagcctggccgggcactgtggctcatgcctgtaatcccagcactttgaaaggccagggtgggtggatcacctatggtcagaagttcaagaccagcctggccgacatggtgaaaccccatctctactaaaaatacaaaaattagccaggcatggtggcgggcacctgtaatcccagctacttgggaggctgaggcaggagaatcacttgaacccaggaggcagagattgtgccattgcactccagcctgagcatcaagagcaaaaaaaacaccgtctcaaaaaaaagcaaaaacaaaaaaaccttttgaggcagatacattaaagtgtgtgaaaaaataattgttagtatgctaattgtaattttaaaacacattgagtggttctaagtttaccagacaagtgtctatgtattgtgctctcagttttatttggaaagtttgctattgtgaaagagacagcaagttttcttctctgttgtgggttgtatttccattttttattaataggctgtattatttagagcagttttttttggtttttttgtttgtttgtttgtttttttggagatggagtctctctctgtctcccaggctggagtgcagtggcccgatcttggctcactgcaagcttcgcctcccaggttcacgccattctcctgcctcagtcccccaagtagctgggactacaggtacctgccaccacgcccggctaattttttgtattttagtagagacggggtttcaccatgttagccaggatggtctcaatctcctgacct

SEQ ID NO: 20241 - DNA, 1056 bp, Homo sapiens
gtgctgcccactggcttgaatgcctgcgcagctttccatagctactgggattcccagacaaaagccttccacttgtgactacttcatgaagtttctgctatttttaaagttggtgtttttaggttttattcagcataggttgacctatgctgaatttatagaattttcacttatgtcagagtttgggttttaagttgtggatcattaccacttaagggtattgatctctcctgtcttataaaatatgatttctgaattacatttttgtgtgtgtgtgtgtgttgttttaaaggaacgaatgctacagtacaatcatttttgtcctatgcttgttgatattaattagttttctgtgagcctgaggaaaactggtagtattttaggaaatgcagtatagcttcctaaactggattgtctggacctggttcaggttcattctggagataaaacaacagtattagtccagagaaatatccctgtgcctgcctttttatcagaaattgtaggctgcctgagaagggctccagaggccgcacttgacactcctcgaacattgcctcaattactcagtctctggtgcgagccagaattgcaggacctgctaccttgcgctctgctgtgcatacaaagctattaagtcgtcataaaatcagtctgctgttttaccagttagtgggatgtggcagaaagggagaaagtgcaaacatagcatttatgtgtgttctaagggaatgaaagcagatcctaaaaatactcagcaacatgattacctcgcatactcagacataatattctgggacacttaaaaaccaacttgcagacacacaagagaacattgaatattaattaacaaaaccatttagtgagtaatggagcctcatagttggctctgaatctaacaatgagattgaagaagaacttccagggatttcatctctgaactcagatttcactgaaatgtagataattttagagtcaaatatgaaggccattatacagttgatccaagctaaaccagcagcagtggggtagtgacatcttactgtgtcttccaac

SEQ ID NO: 20242 - DNA, 1028 bp, Homo sapiens
cactgggcactgcattgagggtaattctcgctctgtaattgttcaaacccaggtttgtgcactgagttgatagtgcacaattatcaatataactaatacatgtaactattatcaggcaataataaaagttattagataatagttaaatgtattcattaggatataggataagccaccataacaaagaggcctcaaaaaacagtagcttaaactaggtagacattgatctctctcaggttacagtgcagaaagaagcagtgcagggatcgggggtgactctgccatagccacttcccaggaacaggggaaaaggcagcactactgtgccggtggccttgaaattgtacacaccacttccagtcacatcccactgcccagacctaggccacagctgcacccagtctgagaggcagtagcagaagaagcagttagtcttccccacacaaagcaaaccagcatgtcccaaatggcaaggcatctgtgtgccgtctcactgtttcttctgtatctccctgttacctgtgagtactgataggaaggacacagaaccttggaaagttcatttataattaaaatatttggaggatgagatctctgaagactttccttcttccttccctcctttctttttcctttctttcttattctttacgtgctaactactaatgttaaaatgtccatacattttttaatggcctttgacatttcacccatgagacaaatataattattattgcaggatctggccagcagcctgcggtgcaacagggctctttctttgttcccaggcagattggcaggtcgagaaataaaagacacacacgagatagtgaaagctgggtccggggggtcaccgccttctgatcctgtgatgccaccaatgcactggatataccggcatttattactaagtttagtgagggcaggggtaggttagtgagggatttagggtcgtttgattatgaggtgagatgatcacatggggatgaagtaattctttaacataacatcggtatgcagaagtacag

SEQ ID NO: 20243 - DNA, 1043 bp, Homo sapiens
gtggttacttgagtttgccaggggcttgacttggtgtttctttgcctatcacacagtctgctggtgttagagagcactctgtgtggctccccaaacacagcagtgagttttcttctttgtctcaagactgcatatgctccatctctctgcctttctaggtaaactgtcagacatcaaatcgacgtggtcctctggccctacctcccacacgcaagcctctctgtctcatgaactatggaaggtgcccagaaacagtactgcacccacgaggccacctccagggttaaccaatcccaagccctcctccacctggggtgccagccccctcggctggaccagctcctactcctcgggtaagctccatgctcctcgtgttccgatgggggccttaccctttaggggatgtgcttatcactttgtcctgtacctcctttgtaaggacccctgcctgtaactctggagcctgggagggcttaggagggcaccagggccaccctagatgtccatccagggcagtagctgggtgagcctggtgtttttagcatcagcctaggtgtgccggcacgcagcaggtttgctctgggccaagaggtcccaggcagttccagcacccattgagggcccacactggccaattctatcctcaggagtgtggctgccccacactgggccatcagaggcctgcacagcgctttaggctctctgcccccatgactccccttcgcacagggatctggatttctgctttttatatttgcttctccacaagatgtcactgggacgtaaggcttttgcaggcccaaaacaaaacaaaccccaccagtttgaaaaaacaactctcataatattgcagcttctctcaggtgctgcatgtcgaacctcagagatgaaagaaatgtactgggaatttaggaaactgaagatttacaccagcgtgggcaacaaagtgagaccccatctccacaaaaaataaattagtggggcatagtggcacatacctgtgatcccaactgctggggaggctgagacaggaggatggctca

SEQ ID NO: 20244 - DNA, 1084 bp, Homo sapiens
tttgttttgttttgagactgagttttgctcttgttgttgcccaggcttggagtgcaatggggcgatcttggctcactgcaaccttcgcctaccgggttcaagcgattctcctgcctcagcctcccaagtagctgggattacaggcatgcgccaccacgcctggctaatttttgtatttttagtagagacggagtttctccatgttggtcaggctggtgacccggaacttcttgaagagaacaagggcacacagaggccagggcagaatgctgatgtctgggtagggtgtaataaatactcactgaatgaactcaagttttacttgctggccagggaggaagtagaccgagaaatccctcctataggctgaacaggggacaggacttcatacgctggctcctgactcagggcatttggatgtcgaggaaggagaagggaaaggtttctgcctcgggggtctgggtcagcctctgtcaacaaggtttacgcagagccaggagaacagagctattgaacaactcacagcggcaggtctgaaggagggagagccttgccaaagctgaagcttccttgttctgagagggccatgtccccaaagctgatgcaaaatccctggatgcattctgaggccacagtttgggagcaaaagagaacagctgcagccctattcccagcctgggctcactttctcgccaggagtccctcaagcacggggcagcaacaacgacgtctccacgtacgcagaggcatgggggtgctcaggggcgcacctctgaaggtcagaaacggaatggccatacccaagcggggaggagatgccagctgccgggtggtcgggaacccagagcggacactggcagcctcaactccacagggcagatgccccgcacaggggaagggacccgtcagcctccccacgggaatggaatttgcagctgtgactcatacagaatgttgggcaagaacagaaccaggaaggcaggactggccttttgaggggacaggccctgtgacgtccgggcagggtattcaggccagagcggcctggctctgtgctgggaggcagggcgggtagagacctcga

SEQ ID NO: 20245 - DNA, 1060 bp, Homo sapiens
cacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaacgtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccg

SEQ ID NO: 20246 - DNA, 1023 bp, Homo sapiens
ctctgagtgaagattaggaaaccgtcttctattttaggagcctggtgtatgttacatactgtgttgactcgcccatgacagttgtgtgggtcctttgaaaggggtgtgtcagtgg[450 bp omitted]aacggggcgcaaaactgtgcttgtcatctcaggtaacacgtcagtattctgaggacgcctgtggccttgttacagaaatggcctcgtagtgtggccccccctgccacacagtggcaccccgtgccctgctttttctccaactgtgatactgactggctcatttcccagcaaaaagggggatattgttctctgggtgtgacagaaacttacagggccctttagctttctcctccattgtcttttccagccaggaagtccctgggccctgtgggcagtgatggcagaggtcccaggcctggaccccctttgtcctcacagggttttggtgcatcagcaacttgaaatagggaggctgggtcagggagactcactacatgttcctcagtcagaagggcacagacggcctacccaggacctgtaaggcagccagccttcaaggcagacctgttcttaccagc

SEQ ID NO: 20247 - DNA, 1050 bp, Homo sapiens
ttaaaatattttttccaccagttatatttcttcaactctaaattgaagaaatttagagtcctttacatgtcttggtcttaaaagccttttgggttttttttttgagacaaggtctcactttgccacccaggctggattgcagtggcagcatcacagctcatgcagctttgacctcccgggctgaaacccttgcctacctcagcctcccaagttgctggggctacaggcacacaccaccatacccggctaatttttagaattttttcatagagatgatgtcttccctgtgttgcccagggtggcctcagactcctgagctcaagcgatcctcctgtctcagcctccaaaagtgttgggattataggctttagccactgtgcccagcccttaaaagtctttaggaacacggcttcttagcttttctaaggaatgtttgacagtggcaacttgtagggcctggccttgcctgccaccagagcaccctgggaatctctgggccaggtagacatgggaagtcagggttttctgggctggcctgaggggctgggctggggccagccggccatgtggtgtggtgctggaggggactcctcactattcctgtctgttcctcttcctcaggagcaagagcagctctacctgaggtcaggtgtggtgtcctctgccaccttcgagcagccgagtcgccaggtgaagctgtgggtgaagatggtgactccactgatcaagaacttcttctgaggacagacaggtgctgtctctagcatcacctctcagcacgattttcccgagagttcacaggtggggcaggtggttgttctgactcaaccagagcttccagagggctctttgatccctttctcagttaaacacagagcagcatcttcaggggtatggcagctgtcctcaaagttagaagctggatgctaaattaggcagtctgttcactttccatctggtacccactccactaagtcccaaggcgcctgtgctggggtcggcagtggcagcctgtagtccccttctgctctcccttcccagggggtcctg

SEQ ID NO: 20248 - DNA, 1084 bp, Homo sapiens
gaagatgacaggcatggccggggtcagctctttcagccgcgcttcagcgatgactccagtctgggtgtcccagcgagcccctgcagggacagtatggctgagggtcaggtgtgctgccagtaagtgagggaggggctggcaggaagggtggggtcctcacactccccgccctctgcagagctgggctctaccccaaaaggcttcaggccagctgccacggctggaagcagaggccttcgtaggtgatggcctgcatgttgtaactaccccgtcccgctgggctcaaggaacagctcagctaaagccctcgggttccatccgtttaaatctgtggcattttcagagcctcatctgtcagccttaatgtcagtggcaggaagtcataactccagctaaaaattacagagtaaagttccctgattcttaatgtgtaatgtctgccctatgtgtacatacacaatataattatacatctgtgcatataaatattgcctttaaccagactgctattatttctactcgccctatttaatggtgtttttatttcctgtctgaaatctcaaaataaacaaacatggagagcttatctttggttgtgtgggaaatggggtgcctgagccgttgctggcccaaccctgccaccccacaggtaatggggtgacgtcagctgttgaaggggacaggtatgtggtggtggcattgctgctcaactcagaggcgggctgagaagatggccggcctcggtgtcctggctgacctcttctgtgtagcaggacaggggtgatgtgggggcggacttctaacaggtgccccagcctcttttcccttgaaccctgtgttccaggagtggcagcagctggggagtgggtgagactgggccagccagcatgacctggagtctcagtgcagccacaaaacgcacttctgccctgggctgactgctccgtggcagggaaagcctgggcttttcagcgcttttcatcacgtcggagctgctctctcacaagctctgctgttttcattaaagcagaggccaggtgactggggtgtttttggtctcctccagaccctgcacattccctga

SEQ ID NO: 20249 - DNA, 1080 bp, Homo sapiens
gtgtgagccaccgtgccaggcctaatttttgtatttttagtagacacgggatttcgccattttggccaggctggtctcgaactcctgaactcaggtgatcctcccgccttgccctcccaaagtgctgggattacaggtgtaagccatggcgcccggcctacaaactaatcttaaatcgttttcaaagatcagcaaaacatggataattgttgaaaacagatcatagacacatggagttggtcataccattctctgcatttttgtatatgttttaaattttccataatgactttaagtttgacttaaatgcataaatatatgaaaagggtataaatcacctggcgtgctgcttactaaaactccaaatgtgggctgcaaatgccaagtaagttcatttgtatgaaatggaaagttttgatattattattatagtataccactcaaccattttccctacatatttggacatacagaagaaataatccaaatatttctgcagtagatattaagtggatcacatttaatgtgacattggagcaaacttcagatgtcgtaagtttgttcttgctttttgggcagtaactgcacacagtaggaaacacgattcttctggctgcccctggaataacagattctgcacaacagtgtgcacatgggccagggggcagctaactgttcaaatacaccattgaagaatgtccatggctgggtgcagtggctcaggcctgtaatcccagcactttgggaggccgaggcgggcggatcacaaggtcaggagatcgagaccatcctggctaacatggtgaaacctcgtctgtactaaacatacaaaaaattagccaggcgtggtggcaggtgcctgtagtcccagctacttgggaggctgaggcaggagaatggtgtgaacccgggaggtggaggttgcagtgagccgagatcgcgccactgcactccagcctgggcgacagatcaagactctgtctcaaaaaaaataaaattaaattaaaaaaaatttcatatggtgaagtattatgagacttttgattgaagtttgaattatgatgggaacatctttctcag

SEQ ID NO: 20250 - DNA, 1032 bp, Homo sapiens
cagctgctagtcacgtgagcacttaaaatgtggctccttggccgagaactggatgtttcattttgtttaactgacatagctccatgtggctcgtagccactgtactgacttaaacatttgcaagcccaggtctcagcagccaggtcagtggtggggacatggaatggggcattgtcagctgaagatgtggtgtggaccaggacaggcagaaagaggtcaggcacggtggcttcacgctgataatcctacccgctttgggaggccaaggctggaggattgcttgagaccagcctgggaaacatagtgagatcctgtctctaaaaaaaaaaaatttttttttttaattagctggatgtggtggcatgtgcttgtagttccagctacccgggaggctgagatgggaggatcacttgggtccaagggtttgaagctgcagtgagccatgactgtaccactgcactccagcctgggtgacaggagaccctgtctcctaaataaataaataaataaatgtagaattaggagcaagaggagctgagagctgaggaacagcctgggagagcacctgtctttgggggttgatcaggaaggctaaacactgggagacagtgtgggccaaaccccatggctgaagaagagggcagtcgacattggcagatgcttacagtgcgcacgaaagaggaatgcagaagggtgttgggtgccacgagggtcgtgggtgatcgtagccaagcagtcggggcggggccagcaggaggagggccagtgggatgctgtgctgattatattcctgacctagaagccccaggctggggataaagccctgtcttatgccaggcttcctcaggagctgcctggaaaatgctggggcttgtccaggccccagacaaccaaatacgtttgtgctgcttgtaaagggctgggtgcgacggggcaccaggccatagaattcccaggttctttcctccctctgttttgggagcggtcggtccccgagggcgtccccgctgctggtgctagggaagtgggcgg

SEQ ID NO: 20251 - DNA, 1050 bp, Homo sapiens
ggatgccggctggtggaaggggtggccttctgtaggggtgacactagaactgagtctttggggaggaggaagccttcagtaggtggagaatagggagtagggtatccaactggcggggaacagaaagggccaaagcacagagacagaaagggacgaacatgcccctctgggctgggcttccttcctttggggggcacttgcccacccggtaaactccccctcagtaggttgcagggggagaagttaggagcacagacatggcttccggaaacagcagccgtagctttgtttctaaacccaaagcagtgagactgctgagcatttcagacctcatgaagatgggatgaaggctggctgctgggaaagatatttttggacaggaggaatgtggagatggctctttccctcctagtggaggaatgacaggtgacaaaggtgacctggtgtgggattgttctgagaaggtctgggagggggtggctgaagtataataaggacatcaacgaggaagggggctttggaaaaggaaggtggagaggaacaactgcggcatctctgcttgaatccgtccccgacccctgcagttctcagggtctcccaatgtcattctggaggccctgggtcagtgtttggtgatggcagatgctacagaggactctttgcaacaggcctctgaatggcagtggagtgatggcagatgacaactcagtgaacaaagaagtggccttgggcgttggtagatttagggaatctcaacgttggtgccatggcctctaaatagccactgcggtgtcttcttactgctcctaaaataataatgattttttaggccaggcatggtggcttatgcctgtaatctcagcacttgggaggctgaggcgtgtgatcacctgagttcgggagtttgagaccagcctggccaacatggtgaaactcagtctctactaaaagtacaaaattagtcaggcgtggtggcagatgcctgtaatcccagctacttgggaggctgaggcaggagactcacttgaacccaggaactggaggttgcag

SEQ ID NO: 20252 - DNA, 1053 bp, Homo sapiens
ctgcatgctggacctgccttcccttcctcctctggctccgggccagggtttgggggaatccctctctgcaactttgcgttttatgggggtttgtttttctcccaggcagagactgtgggagtcctcttgtggccttgttttaattggggggttggagcggcagtttccctttgggtctgaggttagagtgctggcttggtggggggtggccagcctccaaaacctgggtttggactttgagaagtgccatggtgctacggtgccactgccatcggcccaagtcgaggagcggtgagggcgagccccctcgggctgccttgcaaagcggtgatcatcagcctggcgtctaatgctgccctgtcctctgctttgcagacataacagctgggagccggaggagaacatcctggacccgaggctgctcctggccttccagaagaagtgaggacgctgacagcactggggagggtgtgggggagggacggtggctggttggagtcgtgctgggcgctgctcgcctgccgggaggctggagctggggctgtggtctgaggtcccttagcaagattgtgtccagggccatctctgtggctggctgtaaaagtccccagccagcccctctcccaccttctcctagccagcctgtatccatccctgagaagaacctaagtaagtgctgctttggtgtttccgacagccatacttgcaaaaaccaactttttcagttgcttcagataaagatgttatagcttctcttggccttttctgctgagtaatttgcacatggcgctaacagaaaaccaggagagcaggtttgccacagtgacgcaggtctgcccttccagccctgcacgcgtgtgccatcaggcaagaaggctcagagagggagctggaacacacagcacgcagttgtgcctattgtgatgtctctctcaagaaagaaacatttattttgctctggcctgcagcatacagtaccaagtagcaccatgaggccggattgggccagacttgtttctgtaattctagatgtcatttctatttttaggtagg

SEQ ID NO: 20253 - DNA, 1030 bp, Homo sapiens
aggtgaggagagtagcagctcggactccgaccccgactccgcctcgccgcccagcactggacagaacccgtcagtgtccgttcagaccagccaggactggaagcccacccgcagcctcatcgagcacgtatttgtcaccgacgtcactgccaacctcatcaccgtcacagtgaaggagtctcccaccagcgtgggcttcttcaacctgaggcattactgaagccccggcgccaccagctgcgcggtcttactccccttccctgcctatggtgtcgcttggctaagtgactcccagcccaagccccctcaagagtctgggtcgggggaggaggagtgggtggcctccttgatgggcaggcttggaagggacttctcccgcaccccactctgtcccaggacatagggcagggggcctcactgccttgttggtctccaccttgttcctacctctgcaggcctctttgctctcccctcttgcctcaggaaacccggtggcacctgtggctccaggtgactgtcttgaacagagcgggcttcttcatggctgcgttgttgctgagtttgaactgctcctccctggcctgcgtgactgaatcacagctttggtccctgtcttgcaggggctgaggtgtcaggaggggacttctggcccaccttgccttcagccctggagtgggcagagagtattgtggggaggcatggccagtgggactagtgttccctccatctggccacagcttttgggagatggggtgggcaggggtggtcctggctggcattgcctgagccggcagtgatgaagtggggagcttgcccttgacaggtgggggctggctggggccttaatgtgaaaagacagtggcaggcagctggagtagagcgagcccagcagccctaaaaggctgccttcatggccatctagccccagttcagggcagcatccatagcccacaagccagcgtgggtggggcgggggtggtcccacagctgggttccacctgaagagcctccgtgcctcggagcaggagag

SEQ ID NO: 20254 - DNA, 1025 bp, Homo sapiens
tgactatgggatagacactgttctgtgttgtcttagaatcctgacaaccctacgaggtaggaactatgattgtgcccattgtacagatgaggaaactgagaggtgcaaggtcattgcatagtcacccagctgttgcggcaaacggtagctcttgcttcaaagccaccgttctgaaccacaaggcacccatccctcctactcccctaccctgggaaacccgaaagagtttctaaaagtcactttggagaacagcatgattcagtatttggtgagccctaattaagttttatgatcacaagtgacaaatataaaaccaaaaccaaaatcttattttaagaatttatcaacaacaacaggccaggcctagtggctcatggctgtgatcccagcactttgggaggccgatgcaggcggatcacttgaggccaggagttcgagaccagcttaaccaacatggcgagaccccatctctactaaaaatacaaaaattagccgggtgtgttggtgcacacctgtagtcccagctacttaggaggctgaggcacaagaatcgcttgagcttgggagtcagagattgcatgagccaagatcatgccactgcactccagcctgggagacagagcgagaccccatctcaaaaacaaaacaaaacaaacaaacaaaaaaaaaaatatatatatatatatatatatctcaacaacagcaaaaccagtgtcttcacctttgtttaagtgaagtctaggtcacttgttgctctgtaaacccgattttcatccttgggcctagtttctagaaaatacactgggaagtagttttcaaatatgattgaagaaagggcagggacagcccctgagcgagccttgcttcccacctcccactggctctcagtctttgggacagtgtgagtggagcttgtgtccagttgtgcacacggacacccggaaacctctcattaggagaagccactgctgcgcaccctggagatgggttttgaccctgggctcccgttaatgttgttgtggctc

SEQ ID NO: 20255 - DNA, 1024 bp, Homo sapiens
ggaaaacccagatggcctcttgaggccgggcctgggctacgctttcatcaaggcctccatcagctgcgccttggaggaaccagggagagctcaaaaccaccaggacctatcccagcccagatttcagattggtttgttctgggaaggaccaggcattgtttgtttctggctttctttttgacccttaagcttccagatgatgctaacttgcagccagggctgagaatcacagatcttaaatttaaatagcaggatgtcaatgcatacagaattcagaattctcttttttgtgttttttgtttgtttgtttgtttgttgagatggagtctctctctgtcgcccaggctggagtgcagtggcgtgatctcagctcactgcaacctccacctcccgggttcaagcgattctcctgcttcagcctcccaagtagctgggactacaggggcccgccaccatgcctggctaatttttgtatttttgtagataacggggtttcaccatgttggtcaggctggtcttgaacccctgacctcgtgatccgcccaccttggcctcccaatgcatacagaattctaagggagaaggatggttagcatttgacctacatgtcagttagactctggaaattaacaacaacgggaagtccacgcatgaagacttctggctgcagccaaatctgctcagacaaaacccatgacagagtttatttacatttccacaaacaagcctgaaaacagacattctattcgagaagctaaaaagagggaaataaactgaaagaagcagaaaaataaaccaataaagatcaaaagcagaagctgatgaaataaataaaaaatgaattgacttgataaataaactgctttttttttaaatgaccaataaaccttacacactgctggcttatctggcaataaaaaggagatcatgcaagtaacagtgttgggaatgaggacaacttgggggagggttttttttgttttgttttttgtttttaattgcaagaaagctatgcattgtactg

SEQ ID NO: 20256 - DNA, 1033 bp, Homo sapiens
tggacgtgatgatggagactgagaaccgcctccacttcacggtgggcagggcaggggcgggggcggcggccagggcagagggtgcgcgtggacatcgacacccacgcacctcacaagggtggggtgcatgttgcaccactgtgtgctgggcccttgctgggagcggaggtgtgagcagacaatggcagcgcccctcggggagcagtggggacaccacggtgacaggtactccagaaggcagggctcggggctcattcatctttatgaaaaggtgggtcaggtagagtagggctgccagaggttgcgaatgaaaacaggatgcccagtaaacccgaattgcagataccccaggcatgactttgtttttttgtgtaaggatgcaaaatttgggatgtatttatactagaaaagctgcttgttgtttatctgaaattcagagttatcaggtgttctgtattttacctccatcctgggggaggcgtcctcctcctggctctgcagatgagggagccgaggctcagagaggctgaatgtgctgcccatggtcccacatccatgtgtggctgcaccaggacctgacctgtccttggcgtgcgggttgttctctggagagtaaggtggctgtggggaacatcaataaacccccatctcttctagatcaaagatccagctaacaggcgctacgaggtgcccttggagaccccgcatgtccacagccgggcaccgtccccactctacagcgtggagttctccgaggagcccttcggggtgatcgtgcgccggcagctggacggccgcgtgctgtgagttctgggctctgtgccagcatgatggggagggcgacgcgcatttctcacacggcagggagggccacacgcgtttgtttctcacacgatgggcagggcgacacatgtttgtttctcacacggcggggagggcgacgggcatttctcacagggcgctccctgggtcttttactcacataggtctaaatcccatgtaaacacgtgttcaggactcaccaagcccctgc

SEQ ID NO: 20257 - DNA, 1050 bp, Homo sapiens
gtgctgggccttgtgttttctgggaaatgagtcctatgggctgatgcctctcccaactctggccttctgtgctcctaaggagggttctggggccctgcctggaggtgggctggcaccacatatctttccgtcccatgccaggttcctcctgagtcaggcttagcacggcttccccaggccactctgagctcctcgtggggagagagcctcaactctccgcctgtgattggcccatctgtggggtgcagagccctccaagtgaagaatctgtcccccaaccccagagctgcttcccttccagatgtggtcctgcagccgagccctgcccttagctggaggtcgacaggtgggatcctggatgtctacatcttcctgggcccagagcccaagagcgtggtgcagcagtacctggacgttgtgggtagggcctgctccctggccgcggcccccgccccaaggctccctcctccctccctcatgaagtcggcgttggcctgcaggatacccgttcatgccgccatactggggcctgggcttccacctgtgccgctggggctactcctccaccgctatcacccgccaggtggtggagaacatgaccagggcccacttccccctggtgagttggggtggtggcaggggaggcaaggggctggccgggacgcgtctcctcaggccccagcagacggtcccgtgttgtggctgcaggacgtccagtggaacgacctggactacatggactcccggagggacttcacgttcaacaaggatggcttccgggacttcccggccatggtgcaggagctgcaccagggcggccggcgctacatgatgatcgtggtgtgtgcccccacactgtgggtctttgggaagggggccgcccggtgcccagtggctccttctctgtgcagcgtcatcctcgtgcctgtgtggtcgccgaggatgttttctgagggtctttgtgatatcgagggaatatcaagaagtttgcaggcttggccccagctgtccagggaggtcgggtttgagggtccccagaaatggccgggt

SEQ ID NO: 20258 - DNA, 1050 bp, Homo sapiens
tggcgccagggctctgggccaccctcaccttgacaggtttccctcttcccaggatcctgccatcagcagctcgggccctgccgggagctacaggccctacgacgagggtctgcggaggggggttttcatcaccaacgagaccggccagccgctgattgggaaggtagggcgagggtccaggggacgggggttagaaagcagaggcctccagccagggggagccggcagctgctcaggaagacggtgggatttgaggagccatcacgcccagtgggacagctgagaggaatgggccacagtggcccgtgacgatggtggctcctacaaggaatggccccgtgagttcttccatcagcaggcctttgacttcatgggcagctgggcctggcccaggcacaagccctgcagaccctcagtgaggccttagggtcctccttgtcctcccagccccccaggggcctccaggcagggcccccgctgagggagcagctagggagggtctggtgcggatgtgaggctgcctggcagggcttgcacggggccgtctccgctgcccttctccctgacgctctctggttctgcagcccagcccctgggtggacgtgttgggggtgacccctcgttttcccagggttgaggccccttggccccgcatcagtgccttgtggagaaagagctgctcattgacctccagggtgcaggtctctcagatttgcaaatgtgggcgtccactaagagtgaggctgcccctctgctcaggctgaggctcagtggggcttccatgcaggccctgggtggggccgggtctccccactgcagcctctcgttgtccaggtatggcccgggtccactgccttccccgacttcaccaaccccacagccctggcctggtgggaggacatggtggctgagttccatgaccaggtgcccttcgacggcatgtggattgtaagtgtggccccctcctgagcatccccaaggcctctggggactaccccaccctcctcactctgggcagagtcacctaccagcagcgcttctcttgcagga

SEQ ID NO: 20259 - DNA, 1031 bp, Homo sapiens
atcacctgaggtcaagagttcgaggccagcctggccaacatggtgaaacccatctctactaaaaatacaaaaattagccgtgcatggtggtgggcgcctgtagtccctgctactcaggaggctgaggccagagaatcccttgaacctgggaggaggagattgcagtgagccgagatcgcgccactgtactccagcctgtgtgactccatctcaaaaaaaaaaaaccaagctgtgaaagactccacaggaaaagataagtgaatgtgtatctctggggaaaggtttcatttagagaaaaaaaaaaaaaaaaggtgaactttatttgaccatagcagaaaaaaaaatgtaaatctctgaatataaacacaaaaagattaaaactgctctgaacatggactgtaacagcagagaaggcattgtcaataaaacagcaaatagctactcttcctaataggtagagaactcatacgttggtaagaccaagactaagaaccaaattggaggaacactgtttgcaaaacaggagatacgaatggtatccacacattcttcacccggaaatccaagaaacgcaatttgtgttttaattactattttaatgaccttgttgtttctgtcactacacttttttttttttttttttagtggttgccctagggattacaattaacatcttaattttagcctcgttggaactgatgccaacttgctttcaatagcataaaaaagctttgcttctatgtggtttccattgcctctcgttcctctgtgctgttacacgtctgtatccatgatgagcccatccacgcagatttataatgaccgccttattcaattatcttttaagtcaaataggagggaaaaatgggttacaaacaaaaagtacatacacactgtctgccttttatatttactgatgtagttacctttacccatggttttatttcttcatgtggctttgacttcttgtctaacatctttcatttacagcagaaggactccctttagtatttattgtagggcagttctgc

SEQ ID NO: 20260 - DNA, 1052 bp, Homo sapiens
ccctctatgtgactgcgtttggaaacagggcttttagggggtaactaggtttaatgaaggtcataaaggtgggccctgaaccgatagctttagtgtcctcgtgagaagagacgccagagagctcgttctctgcaccctcacaccccagggaactccatgagaggacacggcaaaaccaggccatgcgcccaccaggaagaaaggcctcatgaggaccccagcctccaaaactgggagaagatgaatctctgtgctaggccccgcagcctggggtgatctgtgacggcggcctgagcaggtgaggactgcctgcatgtttgtatttttatgaatgctttgattgagtctgggggtaaatccctggaggcctgtggcagcctcagaggtgtgttctccctgcactttcttcaagaagaatgtggcctgccctactgagcctcgttctgcccgttctgcccgggcagtcccggccaatgtcagcgcagcaaggggagggcctctgtaaccagggctgctggctgcggggctccccactggacacgggagtggacattggagtgtccttcatccgcgtcactcttccaggtcccttgcctcctcccattttccttccttcctttccttccttccttcccttcctttccttccttccttcctttctttccttccttccttcctttcctcccttgctcccttccttttctttcttccttccgtttttctttcctttcttccttcctttcatttttttcttcccgttctccctttcttcctccctccacccctttcttctcactgtgttccccaggctggtcttcaactcctgggctcaagcaatcctcttgcctcagcctctggtgtggctgggaccacagacacatgccaccgcgccaggctaatttgttaattgtttttatagagacagggtctcactttgtttcccaggctcgtctcaaactcctgggctcaagtgatactccagcttcagcctgaagtgctggaattaaggtgtgagccaccatgcctggccctctctcattcacaagtgaacc

SEQ ID NO: 20261 - DNA, 1073 bp, Homo sapiens
ccactgggacttgtcccttctctagagattttcagatggttgactggagatgacatccagagccccgtctgcaggctcctgctggctgtcatcctcagcacatcagcccctctgcccatctgtcaatagacgcgggcgcttcccttctcgcagagccctctgcgccccttcatgcctctctcgggggtcccccacctgggttctctgtctgcaaacttgacagacagagatcaagacttgactgtgttgatcacctggactcccagtgccgcctcctcacctggggggtcctgggcttcccctcgctccccctccctgcacagtgaccctgaaactcaaggaagtgagctggggtcaactggttgttgctttcccttggcaaccagggcctccctgccccctggtgtccggtgtcttggaaacagttgttttactgtttatgttgttcatgtgttgttttaggcagatacagaagaatgtaaatttagtccctgtcactccaccttggacaaagacagaagtcctaagaactttatagagtatatattttttcgtttttgtaaacatatatatatattttttttctgagacaggatctcgctctgtcacccaagctggagtgcagtggcacgatctcggctcactacagcctcaaccaccagggctcagctgatcctccccctcagcccccccaagtagctgggcctacaggcgtgtgtcaccatgtctggcaaatttttcatatattttttttggagagactggtcttgctgtgttgcccagtctggtctcgaactcctgggctcaagcaatccgcccatcttggcctcccaaagtgctgggattaagacgtgagccactgtgcccagccaaacatgatttttactagctagagagtgtactctgagaacataagctttgaaagaataggcattagtccggtaattccatatataaatacatttaaatatggaattctatatatataaatatggaattcctgctctgataaatgccatggcattgatggctcggttaaaagggcacgtggtggctgggcgtggtggctcacg

SEQ ID NO: 20262 - DNA, 1050 bp, Homo sapiens
gtctctcgccaagaccatcgtggcagacgccatgcagggcccggctgcctactcagatctcttccgcagcctgaagcaggtccacctggtgtccttccagtgcagcccgcactccaccccacagggcatcatcagcaccttccggcagtgcgcccgctttcagcaggggaaggacctgcagcagtacgtctctgtggtggtgttagatgaggtggggctggcggaagactcacccaaaatgcccctgaagactctgcacccgctgctggaagacggatgcattgaagacgatcccgccccccacaaaaaggtcggcttcgtgggcatctccaactgggcccttgaccctgccaagatgaaccggggcatttttgtgtcacgtggcagccccaacgagacagagctcatagagagcgccaagggcatctgctcctcagacatcctcgtccaggaccgagtccaagggtactttgcgtcctttgccaaagcctacgaaacggtgtgtaagcgccaggacaaggaattcttcgggcttcgtgactactacagcctcatcaaaatggtctttgctgcagcaaaggcttcaaatagaaagccttccccgcaagacattgcacaggctgtccttaggaacttcagtggcaaggatgacatccaagctttggacatctttctggccaatttgcccgaggccaagtgctcagaggaagtcagccccatgcagctgatcaaacagaacatctttgggccttctcagaaggtgccgggtggagagcaggaagatgctgagtcccgctacttactcgtgctgaccaaaaactacgtggcactgcagatcctgcagcagacattcttcgagggggaccagcagccggagattatttttggttctggtttccccaaggaccaagagtacacccagctctgcagaaacatcaatcgtgtgaagatctgcatggaaacaggcaagatggtgttgcttctcaacctgcagaacctctacgagagcctctacgacgcactcaaccagtactacgtccacctcggcgg

SEQ ID NO: 20263 - DNA, 1049 bp, Homo sapiens
agacctggagcgccacgccatcttcacagaggtgattgtctttctgcacttgtaccctatcccctgtcacccaagagtcctaaatccctcgtgtcaggattcaagattcttccccaggcagcggttagggatcctgcagggagatgctgagacgctgagctctcctccgcggtaagtgtggggagtaggtccagttaaccaggtgctgagtgcctggctctgtgcagtgcaccatgctggtaacagcaccatacacagtgttcacaccaacaaataaagtaccacgtcccaggactgggccaagggcactagggacgcacagatgaatctgtagcccttgtcctttgttagcattagggagcatggagagaccagcacatgaacagatgccatcaatatcatatgataaatgctgtgcttagaggcagcggggagcggtgcagaccaggatgcgagctcagatgagatgttccctaggagaagcccctcgccgatggggaagaatggccgggaagggattgtaggctgagggccttctgtgggcagagccgctgacagctcttagggttcaaggctgtagtgctgagatggggcgatgaggtgcagtcagagagaactactggaggccctcagtgactctgcagagccacatctcagccctatggagcgggcactggaggcacgcttgtctccctggctgggtgaagggagtctgatgaaaggctgttgtggaaaagacgggccggtagggaggccgctggaaccgtacaaaggagaggagcagatggaaccgagagatactcaggaggcaatttggcagggccaataccaccacccagtggggggatggggggtggaggggtccggggcgaccccctggattcctccttagatgagtggacattgcttcatcatgacagataccgcaggaacggacagcaggttgtgggaggctagtgatgatgtccgccggggacaggtttctatgcatcgtgcagctggacgtaggaatctgagctcagtggtgaggcagggattcctgggctaga

SEQ ID NO: 20264 - DNA, 1035 bp, Homo sapiens
tggcattgcgcacagaactctttgttgaaatggaaaggtccactgggtacaggggctgtttcctgtaatcctagctacttgggaagcagaggcaggaggatcgtttgaggccaggagtttgagaccaggctgggcaacacagcaagacccccatcgcttaagagaaaagaaggaatggaaagttcagctgtcctcacccttagctgcaccggggcaggcccattgaggagcacaagatagggtttctggtcaacgaaggaatgccacttcaaagcagaggacacaggaatggggaagaaaacgagccgctaagagaagatttctcatccccttgtgagagaagaaatcacgatcgcagggctctgaagtttatgtaaaactcatcggaacgggtggccgtgagaccgaaccaacagctcggagaacacccttctgcagctgcacagctttgctttgtttatttgcttgtttttgtgtgtgtgtttgtttttaaaataggtattcttttttttttctttaaataggtattctgttataaatgaaatcaacaaaatacgagaaaatgaggaccgtatcttcgtctatttcatcacaaaactgtcccgggtgggaagaggaacagcctatgtgggcttccacggaggtgagatcagaacatcagtcagggtatttatttatgtatttatttatttatttgtatctatttattttttgagatggagtcttgctctgtcaccaggctggagtgcagtggcgcgatctcagctcactacaacctcaatctcctgggttcaagcgattctcctgcctcagcctcccaagtagctggcattacaggcgtgcgccaccatgcccagctaatttttgtatgtttagtagtgacggggtttcaccacgttggcctagatggtctcaatccgttgacctcatgatccgctcgccccagcctcccaaagtgctgggattacaggtgtgagccaccgcacccagcccagtcagtgtatttatttaagtcatgttggaactgtttctcat

SEQ ID NO: 20265 - DNA, 1050 bp, Homo sapiens
acatcaggggaggtggcagaggtggcagaggaggccatggaaacagaaagttctgagaaggtgggaaaggaaacctctgaactcggaggcagtgatgtaagttctggttcttgggacctccccttgtgctgctggtgatgcttctgagctgcatctttaaacgcttttgcattgggagctagaggagtcgccgccgctgtgcaggggtgaggatggcgccccactttcctcacacagtgacggtcttgttgctggttactgggggtcaagggcatctgcaccggcagtttggggggtgcagggcggaggtcggcgtctcttctttgtccgtgaggaccgccgccctgtgctgtttgctgcattgagaccctcatcgcatacgggcggtttggcttttgcccactgtgtcagtggcagaaacggatgacccaaccgtctccaccaacaggtgtcgatcctggacaccaccaggctgctgagaagctgtgtgcagagcgccgtgggcatgctcagagaccagaacgagagctgcacgcgcaatatgcggagggtggtgctcctcctgggcctcttgaatgaggatgacgcgtgccacggtatgagcctccccacccctcttgcccctgcccccacgtgggctcttcctgaggagtgggcatcatttcactgtgtgttgggggacaccctctcaggtttccatggctcagcagaagcagtgacacagtgggaatctaagagcatctctcagattttgctctagaattggcctggccaacggacttcccttcctgggggaggtgggacagaagcactccggagccaacagctcagccacggccatgctgaacgtctgtttctgcctttgtacagcctctttcttgcgggtatccaagatgcgcctcagtgtctttttaaagaagcaagaagagagccagtttcaccctctggagtggttggcaagggaagcctgcaaccaggacgctctccaggaggcgggcacattcaggtactgtgactaaaggaagcaaggagtggctccaatctggtggc

SEQ ID NO: 20266 - DNA, 1084 bp, Homo sapiens
ctccgcctgagaaggaagtgattgagagcctgctctctctcctcttcgtccaaaaggggcgcttaagagatgctgcccagagtaggttgctttcttcctgtaaacctagcccctcatttcttcatctcgcttctgcatgtctcatgcagtgagctgcctttttctttctggtttaaggacactgtgaacacacaaaatctctctctccattcaatgatgttgtggataagactcctgtcatccgctcagtgatactgaaactgcttttgaagtacaggtaagaacaacatggagacttgcttctggaaagccctggctttttctcttcatcgcagcgttttgttaccaagtcttcttgtcgtgactagtagctagtacatgatcttggggagctttttcggtgagacacagcctggttacttgtactggttgtgtattctgacattttcacatataggcacatgagtttagtattcccacaagcacacgcatctagcaagaagccaacagtgccgtgaagggaccacagtggcgtgagggacatggaactcaagaggccagaatctgtggtgctgagcctggttccacagcagcgcaactttctgatttttcagatggtagcttagaatcctgctcaccctgaatgtcctagatgtctcctaagtttctattcccctgaacatgggctctatttccttggaaaggatgttgacatccaagaatagtatcacctgtggtacttgtatggatctaatattgcagttctcaaagtgttggtatggacccttgggtgtgaggtaggtctctgaggttaaaactattttaaaaattagattactaagataaatttgcccttttttaaaaaacatgttgatacttatgatgatgttacaaaaagcggtgatgagttaaactgctggcccctcacgtgaagacacagtagctggaggtattgttttcttcaccgccatgcacacgtggttttcttcatgccagtttcattttagttttactaaatcttgactcttgaggatttgacttttcaacgttttgtggaaatgggaagcacacacaaaacactccc

SEQ ID NO: 20267 - DNA, 1053 bp, Homo sapiens
aatggaagaccaaaccactcttctcacggattcatgttttggaaaatattttaaatgttatttaacatgtaatagctttattgttattttaaatgaatgtatatttttgaaaccttttgtttttaatgtctcataattcctaatatcataaatattgataatataacccacataaaagctcttcggggttctcaatttttaagactataaaggggtcctgaaaccaaagtttgaggacagctggtctaaaatgtgagttttatattcctccagtattatgctaaaaggttttccataaaatcttagaaaccacgtatatgtatgtatatgtttatacacacacacacacaggacagacgaccgatagatagatgctcttttttttagtaaggtatgtctccagatctgagagaaccaggaataatatttctctttctgcagctttcatgatgtaaaagattatattcaggaatatttgaccctgttaaaaaagaaagcattcataactgaagataaaactgaactgtacatgctcttcatcaactgcctggaggtaagtgaactctctcttccctgaatttcttttggaaactatctgaaccacatggtttaaaatttacagaatataattttagtcagtataattaacgaatgctctgttccgtgcagaaaagaagaaaggtttcaaagacgcggcttctgccttcagcaacgtatattttggcatttacttgcatatacatacaaaacagaacagcctaggagaatatactgccaaagttaacagtggttatcattgagtggggacattatggatactttttatcttcatatttttatatccaaaatttttataatgtaaataaattagataattttttttcctcataggttcacttttcccctccttcttgtccttaaaataaaaaggaatgttaggtttccataagtcaagaaatttacactgaaacctacagtaacattcttctatccttccttctccacagtcacattggcgactgtagaagcttggggcatccatgtttaaaaaaa

SEQ ID NO: 20268 - DNA, 1058 bp, Homo sapiens
ttttatgagtactgttcattgagagatgacaatgaagattagatgaaattggaaataaaccaacattgtttacattccaggagacttgtagctcagccacacacgcagtaatgacctgtgcccgttcgcctctggcactgcccacccctctttttttttttcttctaattctgtactcacaaaagagaatctcattttcttctttcttccattcccttaaattctgagtactgtacatatatttctgggttcccacgatgatgtgaaaaactaccagactgttttttgtcttctcacaaagacaagaaaaatcagggcattttgtgagtgccttaagatcaaactaacaagatctgaccctctcccctcacagtgagccactgccccacttcagagggtaagagccaaaagcctcattgtgaaaggcactggacttggaccagggacaccatcagggccttggttttctcacgcataaaatggagagtggattaatcgccaaagattcttctgatctgacattttgaaattgtgagagaaactagatgactgtaaacttggtcacaggcctggttctggcagttctttgcggacttttttctagcattatgccaaataaacatgcagtctcagtgtgctctcgcatgtatgaatatctagtcctttctgtggttctcagccaagacataaaaactaggactcagagcacatacaaaaccagttatgtttcggaaagagggaaaagagtccccgagcccggatcttgtgctgcttttctcactgacgtgttgccttttttctttacaaaatctgctttgatacttaggacctctctggactaatttctcttcctagacagctcagcacagctattgatatgttagaggcagtatccttaatattcattctaaatgagttaacgacttaacttgaaattgggcctaaggagtgagaactacaaaaatacaaaatgcttgtccaggactcagccatgcacaccttgagcagcgccggcaggaggcacggaaggaactgtgctccgttctcctcactgtcat

SEQ ID NO: 20269 - DNA, 1037 bp, Homo sapiens
tgatgagcagtacatgaaatgcatggaaagcagttaacacagcattcccttccccctccaacttctcctggctgcaaattaatcacctcatctgcatcctgggcctcttttgaatgcacatgctgttagagcgcttctcacattgtattaaagttagtcatttatgattccatttttcccactgactgtaggttctcaagagtagggtgtaccatatttcttttacaaccccagcaccaagcaaagcacctgctacttcgtcggtattcattgttccggctatgaaagcttagactaggaaaggatcttggaacagtctggtccactggttcctgaatgcccgaccgtggacctgcaggagcagaatcacccagaagtgtgttgagaaacagattccgtaggcacatccacagagacagaaagtggatccttgggccttggagttggggtgggatggatgggaagtgactgctgatgaggatgaggtttatttaggggttaaggaaaatgttctaaagttagattgtagtgatattgcacaactctgtaaataccaaaaccatcgcattatatgttttaaacaagtgaactttatggtatgttaattgtatctcagtaaacctgttaggaaaaaaaacaggccgggcgcagtggttcatgcctgtaatcccagcactttgggaggctgaggcggctggatcacgaggtcaggcgatcgagaccatcctggctaacacggtgaaaccctgtgtctactaaaaatacaaaaaaaatcagccgggcatggtggcgggcacctgtagtcccagctactcgggaggctgaggcaggagaatggcgtgaacctgggaggcggagcttgcagtgagccgagatcgcgtcagtgcactccagcctgagcaacagagcaggactctgtcaaaaaaaaaaaaaaaaaaacagattccagagccctaccccacttactgggggaaaaactctcccagagtatagcataagaatctgctttttaaaataagctttcctgtgattctgaa

SEQ ID NO: 20270 - DNA, 1057 bp, Homo sapiens
aacccaaattctgttatcagaatggaccctccccactttgggtcatgggcagatttgatcagtttccccattgagtcattgatgaagatgttgtgagaatgatccccaaccctctgtgctaatacagagcactccgtctgctttggtgtgtttaattattgatccagccacaagtgaggagtggaagttgtgatttgaaagctgtcaccaagagatttgggggattcagtaacaaaactgcaggaaggtagacaggtctgcagaatgtggacatagtgggaaacgtcttcacattaagggcagtgtgactaaggaaaacacaaggttaggagactcaggcctgccatgttgtgctctaaactgcagcctctgcctcctgggttcaagcagttctcctgcctcagcctcccgagtagctgggattacaggcatgcgccaccacgcccagataattttgtatttttagtaaacacggggtttctccatgttggtcaggctggtcttgaactcccaacctcaggtgatcgtccgcctcggcctcccaaagtgctgggattacaggcgtgagccaccacgcctggccaacactgtgtcttctttaagcctccaacaacccatggaggggtggggtggggcatcggcttcaatacacaaaggaggagacaccaggaaagcaaggggcaggcagaggtgatgcagccagcagccttagccttgcttctgatgaagaccaggtcctggggggctcccgcggacctgatcccagggaatcctcctatggaccaggtcccggaggctcctcctatggactagattccagggaatccttctacagtctaggcttcaggggctcatcctatgaactagatcccggggaatcttcctatggaccgggtcccggggaatcctcatacagaccagatcccggggaatcctcctatggaccaggtcctgggggctcctcatacagaccagataccagggaatcctcctatggaccaggtcccaggggctcctactatacacatcaggtctgggagttggggctcctccagtg

SEQ ID NO: 20271 - DNA, 1024 bp, Homo sapiens
aaataaattaaaccgacagtttcatttgtaggattgactttaataacacgcctctactgaacaaatggcgattaactggggaaaacggaattatggtaaccgaggtaacggggtcggggactctttctccttcgctgcatgctgggtggcggggagagaccgctctgaggaggtttggtctgtcggccacgccgtaggccgcggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactcccccaccccctcccccactgatggagtccgaaatgctg

SEQ ID NO: 20272 - DNA, 1075 bp, Homo sapiens
caacatggccaaacaacaggacagacgtggctgctttccgtgggctctgttgcttctgatttatgtgtgtcttttctctttgagttgaagcattagaaggtgtatccaccaagatccagtaaagaagacagaaaacacaccaggtatctcaaccaagcggatttaggtggggaactggttttacaggctttcgaggggctgaaagggccaaaaggaaaccttgactgagacggtaactacaggaggcaggtgctgctgctagggctgggggaacaaatagaagaggctggagttacttaaatctagatggctagagaagggacccagtgagctggggcttgggccactgaggtagggacacagcctggcgcttgctggcaccgctgctaagtgcacagtgcaggggcctgggagcagaaggaagcaggagggcatgggggcggccggcagctgggaagggaaccatcctccctcctcgcctgccagcctccctggagggtgctggacaggtttgaacttcatgtggtagcagtaattttaaggttttgttttgtccccttgcaactctccttacttgctttgtccccttgcaacttataactaccttacacaggtactctgcattggtactctgcacaggtactcggggttattatttacatatgggatctgagcctcctgtgctttgcccgagttagggcctcaaggactttgtggatcccttcctgatcttttatttatttatttgtttatttatttatttatttattttgagatggagtttcgctcttgttgcccaggctggagtgcaatggtgcgatctcggctcaccgcaacctccgcctcccgggttcaagcgattcttctgcctcagccccctgagtagctgggattacaggcatgcaccaccactctggctaattttgtatttttagtagaggcagggtttctccatgttggtcaggctggtttcgaactcccgacctcaggtgatccgcctgcctcagcctcccaaagtgctgggatcataggcgtgagccaccatgcccggcccttcctgatctttatggcaaga

SEQ ID NO: 20273 - DNA, 1053 bp, Homo sapiens
aagtgctggggttgcaggcatgagccaccatgcctagcctgtgtggcctttcatactaggtgaatctgtggccacccacatcctgagaattgttttgttcctcttccaacctagaggaaggtccccttggaagtgtggcttggggctctgtgattgaacctttcctattcatcattttcgtcagtgtgttggatacagatttggaaggcgtgattactgagtgctgatgatataaagctgggaaggacaggtactaatgtagatgaaagactcgtgatttactccaatcttgaaaggatgacatgctggcagattgtggtaaaatataacagagatactttgaaagtcctgcatttagtcttccctttctctcccttgctcccttcctcccttgctttctttcttccttccttccttccccctttatttgtcccatcaattgcgtaaatgcaggtaaacatttagccattcctgtgaaagccgctgtgtatgtggtggccttaatcattgtccatttttgggcctgtggatccctgttattctctgcagtggagactgcacatcgggccagtgcatgcctgctattctctgcagtggagaccgcacatcaggccagtgcatgcctgctattctctgcagtggataccgcacatcgggccagtgcatgcctgctattctctgcagtggagaccgcacatcgggccagtgcatgcctgctattctctgcagtggagaccgcacatcgggccagtgcatgcctgctattctctgcagtggagactgcacatcgggccagtgcatgcctgttattctctgcagtggagactgcacattgggccagtgcatgcctgctattctctgcagtggatactgcacatcgggcctgtggatccctgttattctctgcagtggagactgctcatggagcatctgattttcttctggaccttctattttgagctgcattcacagagcacacctgagaaatggtggccaaggggagtgatctaggaccctgagaaacctggaagcagctccccttagggagagttg

SEQ ID NO: 20274 - DNA, 1027 bp, Homo sapiens
gctattgtagagtagaaacgagaatgcacccccggaatcagctctccgatgatatgcaggtgcagctgcctccagccctgccgttggtcaggaggaggcaaggggtacctaatgtgctcttatttggcccatgatgagtggagaaagagacctttgcccaggtgtccatgtcactgaggcagtggcggagggtgtcccccagctctgcagtggtcaccctctgcctcctgtcctcgggcagctgcctgtggctgcaggcggtgaaggtgctgttggttgtttgctcccagacctggctgtggggcctgctctgcagaggtcaggggcatggcgcagggggacccagcagggagctggagccaggcagtgcgggctgagccaggccgaggagacccccgcttttatcttgagtgttgtcatctgatgctgagttctttctcagcagtgaaggggaatcagtgtcctgacttgaattgcactttgatggggtttttagtttctgtgtgttggatttttactgagagctctagagaaactagtcacctgggggtttcagaggagggttgtgaagtgctgaatttttctttgagcttttaaggtcagaactcaggggagctaaaaaaaaatgaaaaaataataatttaaaccttataaggtgactcataaataactgcctttcaagatgagtggaattcttctgggaaaaagccctgtggaaattctcctgaccaccgagaacaaagaggaccactgctataaaaacctccagaatcatcatctgcggatggagggaagactctgccaggagtgcgatttttcctttatgtgttactccgtttaccatgtctcaataaaatggcagagaaagtccttttcctgtgtttcatttttcccacaacctttccccttttgacttctttggggcttccccttatctgagactggcccaccgcagaattcagcttcacgggcctgtccggatggaacgtggacgccatcatgtgtttactgcttttatctcttagcc

SEQ ID NO: 20275 - DNA, 1029 bp, Homo sapiens
atgctgttacctattctctttgaaattgagatttctttcttccttgtcccattccactcttgccacacctagctcaggccttcttattccaccgtgacagcttcctggctaatttcccttcctccattctttttcttcccaagtaaatgttagcccttgtcattaatgttagacgtcatcttcctgaaaatatccatttagccaggtttatgccgtggcagctgcagtggggcccggaggcctttcttccaggcctctgttattggaatccacctcccgcgtctatttggagctatggggcctttggaacggcttcatgagatgcgttggcccaagcagaaggctggtacagaagcagaacaaagctctgagcattctgagagttttctgttgagaaatgccatgggcttatgtcttcagcctgcctgggagccctgcatatttttacttgccttggggttgatttgatgaagcctgtaccatgggtaacatattgctggataatgaagagtggaaggaaaattagccctgaatgaatgactcagtcccatgataatgtggctaattttaatttgcatcaggaatagtaaagctgtggcccagtgtgttatcaaataaatctctaaacagccttgaaatcaatccatttattgaaaattgaaaatctttttttttttttttttttttgagacggagtctcactctgttgcccaggctggagtgcagtggcacgatctcagcccactgcaacctctgcctcccaggttcaagcaattctgcctcagtctcccgagtagctgggattatgggtgcacaccaccacgcctggctaatttttgtgtttttagtagagatggggtttcaccatattcgccaggctggtctcgaactcctgacctcgtgatctgcctgcttcggcctcccgacgtgcagggattataggcatgagccaccgcacccggcctgaaagttgaaaatcttgttccatgaaataaattttagaaaattagccagacatggtggcgcatg

SEQ ID NO: 20276 - DNA, 1043 bp, Homo sapiens
ccccacttctgcccccccatgcttatagaaataacatgtttatggtagatggaaagtgcatacacagaagggccaggtacaaagaagaaaagaagaatcatccacgttcctctgaagaggtcagaatcactcatgacatcttgtgttttcatttggtacgaccttatatttggaatcacagttgtgggtacagttttgtaccctcctcttttcagttatgtttgagcatgtcctgtgccatttaatattctttgagaacatattttttaaacagctctactgagatacaattcacataccccagagttcacccatttaccaacagagttcaccaacagttgcaatctgaaagtatgtttttgtaaaggacatatactattttatcatgtaacactgtttaatatacgccatttaattatgcccttcaacgtggaattttaggcttccataggatacagtttatcgtatttagattttatgctgttgaatgacttggaattaatttgtaagtgtagagaaaaatgaatcctagggctcagagcactgcagcagatcacgtatttttgctctgtgacaaagtatttttattttcactttttctttttttgttaatttcaccccataaggtgtttcgggtagaggcaaatcccacaagtatccttggggattatcgacgactaaagaacagcaaagaaatggttcctagctcctcacgcagtccttggtgggcggtgggctgactggctgcgcacgctaggcctcaaggtagaagcggttcatttagagacccccaggcatagtcgcatggcttcacacacccgcaccagggctgaccatttgtttttggaggaaccacaaaaggattcagtatggaattccttaagaagggagtttctttagtttgcttaaaatagttacaactttttttttttaagacggggtcttgctctgtcacccagggtggagtgcagtggtgtgatctcggctcactgtaacctccgcctcccgggttcaagcagttctcccacctcagcctcccgagt

SEQ ID NO: 20277 - DNA, 1356 bp, Homo sapiens
gctcttccatgtgtctctctcttctgggactcagctgtctatgtattctgctgttggacattgtaccgcagctcttctgtgtgtctctctcttctgggactcagctctctatgtattgtgctgttggacattgtaccgcagctcttttgtgtgtctctatcttctgggactcagctctctatgtattgtgctgttggacattgtaccgcagctcttccgtgtgtctctgtcttctgggactcagctgtctatgtattgcgctgtcggacatagtaccacagctcttccatgtgtctctgtcttctgggactcagctctctatgtattgtgctgttggacattgtaccgcggctcttccgtgtgtctctctctcctgggactcagctctctatgtattgtgtcgttggacattgtactgcagctcttccgtgtgtttctctcttctgggactcagctctctatgtattgcactgttggacattgtaccgcagctcttctgtgtgtctctctcttctgggactcagctctctatgtattgcgctgttggacattgtaccacaactcttctgtgtgtctctctcttctgggactcagctctctatgtattgtgttgttggacattgtactgcagctcttccatgtgtttctctcttctgggactcagctctctatgtattgcgttgttggacattgtaccgcagctcttccgtgtgtctctctctcctgggactcagctctctatgtattgtgttgttggacattgtaccgcagctcttccatgtgtctctctcttctgggactcagctgtctatgtattgtgttgttggacattgtaccgcagctcttccattgtgtctctctcttctgggactcagctctctatgttttgtgctgttggacattgtaccacagctcttccgtgtgtctgtctcttctgggactcagctctctatgtattgcgctgttggacattgtactgcagctcctccgtttgttctctcccatgtcacaatgagcttttgttagtctgctgataaaccagccaaggaaattctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgc

SEQ ID NO: 20278 - DNA, 1029 bp, Homo sapiens
ggctgcaccagaatggtgtctggaagcctctgatgatttccttgctggtgctggaacgcttggacttgttcttcatttttctagcttttgatataggtgattccagttcaaaaggaattgagagaaaccatggtgattatatttttttctgaaggctgccagccactatctggcccgtatttccttgcttaggcccattgagcccttttctaaataatttatcagtttgccactgatgaaatgtttcttctgattaaatttaaggctttgccttattaccttgtaggtgtataaatttgtgttctgccagagattggaggaaaatgccgaccgttgtttcagtggaaaattctgcagtaaaacctcactcattccatcataagtctcaaatgaaagttttattgggaaatgggagtaggagattattataaagctgggaccatacagtgaagaatttatctttttagagaatttttctaacaaattggggctactggcagtttagtacaggatggaagttaggagctggagcctgtggaaaaagacaagcaggaggggcctcgctctctgtgtccttctttccccagagagagtggacaacaccagaagcagaggccacacctctttacttggggtgagctttaattcttctggtgccttaaaaataagtttctatgggaatatctatcatttactaaggaagatgaaacagcatggcggtgcctccactgaccaagtctgtccgtcgggcaggtgtgtctaggggaggaggcggaaggcgctcctcagtcatggagccacgttgttgtaggagctcattctcatcttgtccaggtctgcgagtagtgaaggcagcaagtcctgtgtggcggccgtggggcttccagggagctgagcggtcaggttgagtcagtttccatgtggtggacagttcttacttatccatgcacagccctggtttgtggattacagtgaacagattttgaatgtcagcttcccttcagttcaccgtgcttctcagatgtgtca

SEQ ID NO: 20279 - DNA, 1027 bp, Homo sapiens
aacccttctatgtgccttctgttttaaaaccatgattttttttactttaataataggcaactaatttaaaatacctattcaccatgtgtcatctcagagtaggaaggggactgtgaggcagacggagccacttgggacttttgcctttgggttgtgacatttgtctgtaggttctttcacttctgtccatctcatttgtttctgtgccatgcgtgtgacatgatgagctggaaagactttgcatggggcccacgtgagtgctcacatcgaaggggcaagtgttaatcaccctctagttgacagagctgtttcagggatggctagttcctctgtccggaacacttgtattgagtggcagggagccgcggggacactgcccatagcggtgggagagcaagcaggaggggctctgcccagggctgtttcctttgcctttgtttaccagcataaagtattaaaacagctaaattatcatgggcattttaatccaatttctcagcgtttcgtcatttgaagaatagaagtctctttgttttcacagccctgttcttgcttgtttaaatttgaatatatttctattcattcagctgatagaaattctttacttttaaactgagggagaaaaaagaacagattgactagggatcagaatgtgatttcagtgggtctttattgggcccttgttagggaggggtttggacctggggacttggagtctacactgatggcagaagcaagctccagaaaagagcaggctccagctttgcaaggtaaaccttggagagtgtagttagggtgacagccagcacctctccctgctgagtggagagggaatccagatttttaggatcttataacctgatatttttcatgcctttgactcctgtcttggtctgttaggtcttggcttttgatagccaaagtaaccagctgactttccttctttttttttgaaatctcctttactttttcacaaggctgtttctcagtgtgaatatgttgctttcatattcccagagcactcact

SEQ ID NO: 20280 - DNA, 1930 bp, Homo sapiens
agtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcacaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcagtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttcctttccatgtcctttcctttcctttccatgtcctttcctttccttttcctttcccc

SEQ ID NO: 20281 - DNA, 1106 bp, Homo sapiens
cgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaacagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttcttttttttttttttttt

SEQ ID NO: 20282 - DNA, 1782 bp, Homo sapiens
gcgagttaaaatcacacagcttattgcatctatcagttccagtcagagctgatggcaaactcttgttctttcagttcagtaaccagagagtggaatctgtctgtctgtgtcttccataaccaaaatacatcaccccacgcaatgcctcctaataactggggctttgtggtcagggtttttgcagggcaggccccttttctgcaggcaaagtgctaatggccagcgcctacactgcaggcctctggcgcattctctgccgagagttctgtccgtcccacttctcctcactgtctagtcttcttctgaccctcccagcctggttcacgtttgctcttcgttaccctcttcctgtttctttctcctgtctctcctcccaccacaccatccctcacatgcaccatggggtgctccttcagattgtcatctgatcgagccacagtcccactcagcccatgtttgtcaggactctgccactggtcacttgtccacaaggaaccactgtctttgagcttcttcctccggtgctcttagcatctgcccacactgtatctatctgtgtccaggtcttgttttctgtgtcattgtttgatgaaaggcagggactcattcggtgagtgggtctcccctgcctctgccccacaccagcacactgctctgcccttggtgggcacccgttggtgtgtgttgagctgggtgttgtacctcggtgtctgcgtggagaaatgcgaacagtgagtgccacagcacagccacggaatggttgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagtgaggccgacagtgagttgtaggaagctcagaaatgggatgcccgcactgccttcaattcaccctccattgtccatcgccgctggcatacccaggtcagcgcctgcaggcccctgtctcaaaagatgtggccggcttcttgtcccggtactgcctgaagcttcacctcagcaccgctagcttcacactggccacacccacctccactcagcagtctccatgctgtagcccaaagcatgtagtggcggttgagtacctgagtgggggaaataattaactgggatgcttttattgataagtagtcagatgcctgttaagtgacatttatgaacactcacgtagcactgctgcctgttagccaggcactagtcaaaggacttttgatgtattagctcatttaatcttcacagaaactagaagttagacactatcctctccactcccttcacccccagccccaaacacacacaattttatagccgaagaaacggaggcacaaagaaggtgaagactttgctaaagtcacaaaactggtataagcatgggctttgtgtgtgtccaaagttcatccctcaaccgtttctctctggatcaataattaaaaggtttatcaagaagtctgaaggtaaatggttcagtattgtcaggttctggataagtttctctgtgttcttgacttttccctcatgatgacaagaaggctgccaccactccaaacatcacagcctcacagttgtgctcaaagggagaaagaagaagggacggccgttctcctttgagcacactgtttcactggcttcctgtgggttccactggcctgacttgatgcctgggacactttaagcatctccggtgctatgcgggctgggaagaagtga

SEQ ID NO: 20283 - DNA, 1029 bp, Homo sapiens
tgtgtaccacatgtgatgacacgtatgcgtaaccttgggtacatttatatacgcacacacgcacacagtgttttctctttagggaagtgctgtatgttgtacatggtttcttctaccttgcttcttgttgctgtattagactggaatccacgtgtcctcattggaatcaaagcttcattgtttcctctaaagcagagtttctccagcttggcccgattggcatttggatcagctaattcatgattgtggtggtcgtgtgctcatgtgctgtgcggacagtcacaggatgtgtagcaggtccccaggccattgccatcagatgccagcagggcccacttctcccagcagtgccgaccgagcctgtctgcagacaacaccagtgcccccgagggcagagttgctcccagcggagatggtgtttctcgggttcattggggggattctgagcacccatttcagaagtggatttggccccatctggaagcaatagcttttctttttggactttgaataataaaccagctattctagttcttgtctgcctcttctgcaaattaaggaaggaaggaagaattgttactgaataatacataaaggaaagagtcgatgattttacaaatttcacgtaactctgcccttactgggcagacacgtgttgagaacattacgagttactgtgaccttgtagtccctttgggttcggtgtacgcaatttcctactctcagcatctgccagcccagactctggcagacttatgccagccctgggtgctgtagggtcagccacccccttccacgcagggtgggcgtccagatggtgctgtgggaaacagcgttttgccaggggccagagagctgactcagatagtgacctggaaaacagactgtggatcaggtgggcacgggcctggaacagggtccctgaaacacccagcaagaggctggggaatgtctggagagcccggcatggtccggagcgtccacgcagccagcagctcacatcctcttgctcctggcggccgatgctct

SEQ ID NO: 20284 - DNA, 1065 bp, Homo sapiens
cccagagcaggcggggctgggaaagctgttctgtggcgcagcatcccagtggctgttacggggtgaaagcccctcttagaatttaaagtcctagagcagagaccaactggggccatccatggccctgtgccgtgctgcctcctggacgcacgctaggaggtggagatggtccagccccagcaggactgggccacgaggaccctgccggtaacctggtgctcgccgcccacagatcacggggcgtggagggagagactgccagtgctgtcctagtgcagcagtacctcatggttatgacggatcatcttcctgaactttgcatctcagaatttaaaatggagattttgattttgattttggcaaatgtggaaaatagatttcagctcaaaaagcaagacctgagaacatggtgtgttaaaatatctttcatttcatgccactttgcagccctgggaccctcggggttgtacctagaaggtagtaaagatgacagcagcccccgtttcactgatggtggcgcagaggacgttgtgaggtggctgtagggtcaggtggctgtagggtcagggctgggcaagttgtattcagatgctgttcgctaagcccagaacattataggaggtaaataaatagcacgcagtgttctgggggtaaaaagatacacccatgtcccaggctgctgccaaaatcctttctcctgtcagcgtggggggtgatcctgcccaattaaaggacgtcttttggcccttctttcccttggcagcagcatggaagtgggtgggggaggagaggagcatgcttcccccaacccctggggacctgtgagcgcagcctgcaagctccggctccaggaggaagcgtgctcaagtgcacctctgaccacgtcacgctgcgagaacgtgggcgctacacctccgaccacatcgtgctccgagaacgtggacgctgcacctctgaccacgtcacgctccgagaacatggacgctgcacctctgaccacttcctgctccgagaacgtgaactctgcacctctgaccacgtcacgccccgagaacgtggacactg

SEQ ID NO: 20285 - DNA, 1030 bp, Homo sapiens
cccctgtttccatttctagttcttctggagggtgtctccttccctgtagatgacatgctgagaccactgcttcttgatttgtcgtttttagattatcagtgggctttgtcttagggtacaaaccaagaacagagctgccattaagttctgtttaaagaagggagaaacgatgtggaagcctgttagcaaagaagtcaattatgtgtagattacatgctggtttaaattcctatgtgttatttgtattcagtagtgaattctaaagagaaaattctagattgaagaggctgcgtcactcacgacgccttcttgcgttccctcttattcactctattgggtttctttatactttgtaaactttgtggtttcaagtaatatccttatgcttttatttctagttttatcagtaatagctcatttcttccattttcaaggctcttagcttccttgtactttcttctgccttttttcttttacagcttctgttatctgcactttctgtgattgtctttcgttctctgaccacgattaacacctctgtgcttgagtggagattgattctataggaagacaagcattaaaccttgtacctgattatgaccacataaatattgctcgctcagtggctagagtactgtgatttccatttttataactgttttcgtttgtttgcttttcctggacatttcctcttttcttcttgaattacctatcgttaccacttcctccactgatagatccacaaggagagcggagagcacagaaggcgccctctcccctcacatcttccaagctctcctgcctcgctcagccgatcgtgcctgtggcctgctccccggcgtcagctggctcccctttgtaattctccaggatccgtccctgtgtctagatcccacttcttcccctctctcgattttctcctttgttctcctaggggaaatcctcaagcactgccctaagaaaggatgtttggcagtctgagaccatcagtatttgaagcagtggaagtaatgaaaaatctcattactgg

SEQ ID NO: 20286 - DNA, 1025 bp, Homo sapiens
aaaccacctgatggatgcggtaagaaagggaattgaagcagatggaggggcacgggctgctgactccccggctgaaccccgtcctcgggtgctgcaggaaagagtgagattgatgatcctggagggagcccactcagcagcacagccggagactttgctggtcccttgagatggctgagtccccactgggggctggggtgaggggtgaggccggaggagacagtggagctggcgagggccccagggtgcaggcaaggctgagggcactcggctctcctcccactgcccttgataggcatggcctgctgtgctgtgtctggggctcagaaagatggaaaataagagggtggaaagaaagagtttgtcctaccgcccttgtgaaaagagaagtaatccaataataaataaaagtgataaaagacaattggaaatatgaagaagaaacaggaagaaagaccagttggaagcattaagtataaaaaatataattggtgaaataattgaagagatggattgaaaagcaacattatggatagagccaagaataaaccaggaagctgagaagcttgtttgaggagttcccaccaaagggatggagctagaaggaaggggagaaacatgagaggcagagacaaagtttaaatatctaggaaataacattttcttctctctaaaaaaaaacgtagaaaaggagaaaagacaggcttagtaaatagaaagtgtgagatacgatggctaaaatgttttgaaataaagttgtaactgtaaacgaattgaattcacctctcaaagggccatgattcttgtgttggttaaaatcatgatacagcagtctcttgtccatgagacacagatttaaagcaaaacgtttaagcctgggcaaaacagcacgaccctgtctctactaaaaatttaaaaattagctggacatggtggcttatgcctgtggtctcagttcctcgggaggctgaggcaggaggatcagttgagcccaggagttcaaggctgcagtgagctgtgattgt

SEQ ID NO: 20287 - DNA, 1021 bp, Homo sapiens
ttgtagagactgtgtcaccatgttgcccaggctggtctcgaactcctaagctcaagagatcctcccacctcagccttacaaagtgctggaattacaagcatgaggcaccatgtctggtccttttttaaaaaatagagacagggtctctcccttttacttagatgggagtgcagtgacacagtcatagctcactgcatccttgaactcctgggctcaagtgatcctcctgctttagcctcccaaagtgctggaattccaggcatgagccaccacgcctgatcccagcatgtgcgttttcacacttaacatatctggggtccagaagcatcttacaataagtaacatacctgtttagttggcagttcttttcctttgttaatagtgtatagaaatgcttgcaaaggtccacctagaggtgtgcactgtaccctttcttactgctgtttgtaagctcactgtttgtcactagggaaagaaacaggcaccattacttaactaggtgttcatgtaccggcaataattgatctcaaaatttaatgctatttgtagtttttaattaaaaaactctcaaatgtatggtctaagtttttctttaagtccagaaaaaaaagaatacattaaaccctaagtaagtagaagaaaagaaataataaagagaagagcaaaaataaacagaagttgaccccaaaatttgtaaaaattcatgaaactagttgatagtttttgaaaggttcattaaaattgtcaaaactttttctagagtgctcaagaaaaatagaaggaagatacaaatgactttcatcagaaatgaaagagggcacatccttactgatcctacagatgttaaaagaataaggggccaggtgcgggggctcatgcctataatcccagcactttgggaggccgaggcaggtggatcgcttgagcccaggagttcaagaccagcctgggcaacatagcaaaaccccatctctacaaaatataaaaattactcgtgcgtggtggcatacgcttgtagtcc

SEQ ID NO: 20288 - DNA, 1032 bp, Homo sapiens
ttatgcctaacccatcaaaggtgcagcattgttgggcacaggatgaaaaacagacagcccccacgtttggctgtcaaaccacatgacccagaaatagccatcattgtaagaaccccagagggagcctttgctatcttttaatttattgcacaaataatattataacagtaaacaatgaaaaggaagaaatgaaagaaaaattacccagaatccactgtttttgctattccatattcttcatacatttgtccatatatgcacataattttacttacttggaattaaatatattttgtattgtttttaatttgaagatcactgattttatattgctattgatattttcaaatttagtattccatcacatttatagacagtattacttaatcatttccctctcataaaattatagtgcttgcaaggagttttttcctgttcatctttgcggtacatagaaccttccttagctgtccatggtagcatgcagctgtagtctcagctacgtggaaagctgagatgggagggtcacttgagcccaacagtttaaagttatgatgagctatgattgtgccactgtactctagcctgggcaacatagcatagagtaagatcctgtctcttaaaagaaaaaaataataatattttcttattttggactatttcttagaatatgtttctgggaataagatcagtaggtcaaagtatatagctcttgatatcttttgccaaacttcctttttttttttttttttttgagatggagtctcactctgtcttcccaggctggagtgcagtggcgtgatctcggctcactgcaagttctgcctcctggattcaagcgattctcctgcctcagactcccaagtagctgggactataggtgtgcaccacaatgcccaatactaatttttgtatttttagtagagatggggtttcaccatgctggccgggctggtcttgaactcctgaccttgtgatccgtccgcctcggcctcccaaagtgctgggattacaggtgtgagtcactgtgcc

SEQ ID NO: 20289 - DNA, 1030 bp, Homo sapiens
caccttttggagtctccggtgcctgttattccacctgtgtgtccctgtggacccgttgtttagctcccactcacttatacatgagaacatgcaacagttggttttctgtttctgagttattccactgagcataatggcctcctgtttcacccatgttgatgcaacagacacgatttcattctttttctggctgagtagtattccatgatgcacagacgctgcagtttcctcatccagtcctctgttgaggggtgatctcggctcactgcagccggagctccgcctcctgggttaaagtgattcttgtgcctcaacctccagagtagctgggatatcaggtgtgcaccaccgcacctggccaagagtgattttataggatgaagttttagtcccttttcctagatgtcacagatcagtgtgagcatttcattaggaggtctatttgctctctctccgtgcatcattttttttacaaatagaatgtggggtctgaaagtacaggattgttatcaggtgacagcagaatgacaaactagagtgatgttatacataccatgtacatcggggactccaaaaccgccctgctcatcaggtgcccgaggcaccctggcctgcagcacctggcactccagggctggaactggagaatcttttcttatgaagcagctcttccagtatgcctgtctgagcactctcttcatatacaaggcaaatgaaatttgataaccttagcaattctgttttaatttggtcgcctcagctggagtgcagtagtatgatcatagctcgctgcaacttccaactcctggggtcaggccaccctcctgactcagcctcctgagtagctggaactgcatgcatgtgccatcatgcccggctcatttttgtattttttgtagagacggggtttcaccatgttgggcaggctggtctcgacctcctggcctcaagcgatcctccagcttcagccttccaaagtgtttgcattacagtattgagcctctatgccggccaccatgattaatcttta

SEQ ID NO: 20290 - DNA, 1029 bp, Homo sapiens
ccatgtcgcactggccaccaggacctgctgtgctcgctgaagctgccctgttgggctttgttcagccaaattcactgaccctgttgtccaggcactggcaggcaccccgagccacaggctcgtaccccgcactgtgcgctctcacccgtcagccctgcacaccccacacaaagccactgctgtgtctcccacccacagccgctgctgattcaagtccagcccaggccatcaggtccccaactgtgctgcccacggacccctgggcccctgctcagcccttctgctccctgcacccagccctgaccatagcctccccacaccccaagtcctcacgtactactttggtgtcacagctgaagtcagggggcagtggggaggctgctgccgaagcggacggtgagggcttccaccttggaggcaggcgtcagtcgtacccagcaccagttgacctctcgctggttccgctgattcttgtagattccctgggattttctgctagttcactggttcttgtagattccctaggattttatgtatatgctctctccaagcagaagcagcttccagcccctcttccggttctgggatctctcactctttttctgggcctggggcactgaccatggctctgctggcacgggtcggctaccgtgcttgccatctctcccagctgctcctgatttcctgagctggatgcggggagctgctgctcttcctctcagcacagctgaggttgaccttgacctcagttcaaccttgaaccctcctgggcccagtgctctgcacctggctgtgaccagagaacgctccataatggtgacctgaataccatatatttcagcaaaatattttccctgctacccattaaactacagataaagaatgactgctttgaaagattggctaaagcactggatttaaggttaaaaccctgagtttgatcccatcaccgcatttgctcttacaagtcattttcacttcccttggccatgatttgcctctgtaaaatcatgagccttcggccgtctg

SEQ ID NO: 20291 - DNA, 1045 bp, Homo sapiens
agagcttccgtctgcaggtccccacgcccacagcacctccctttccccctgggcatttggataccacatgggcatctccccttctgctggcgaaggctacagaaagttcacagctgtggagtttccaggtggctgaacttgctgaggctgctgtttgctgtgcgcgtgccatgcctgaggccctgggtgctgtccacaggcaagagggactgcggaggccccgcccaactcctgtgtgaaacttagctcttgtctgtgatgagtgaatgccgttgttatcctcggtactggtctcggtggagtacagggcgaagaatcgcagtttcatttgagggccacccagacgggaagcacacagcagcctggggcccggacacaggggcttggcctccatgagttttctcctctgccggttctttcttttctgtcttctcgaaggagctggactccccattccaccatccttcttatacaatgtgattcctgacttttttttttttactggagaaaactgagttttattcgtatatcattcaaatcttaggaaatttgacaggaaagagtttcacaatgagctggagtttaggaaggaaagaaaacaaagtcgcccctgcaaagccagcctcattcatattcagtgaggtgtcactcacaccacctggaaaccaccgtgcttacctaagtgtttagaagtcataacttacacagaatcccattgtgcacagcacttccctgtttccagccaatttcttctttcatttcagccaaagaacagcaatctctttagtcctttcagtgaagattgcagaggctttcagaaccatggcaacctggagagtccatgtctccccatctttcctggtgccccagaagccctgccccagcgcctccccatctttcctggccccccagaagccccgcccccagcgccctccctgctctgccttccccagagcacttgcattcttacaccctcagtcacgtgtttcctttcttccccgtggcaatgaagccccttggctggtacttggcttcctttgatcgc

SEQ ID NO: 20292 - DNA, 1041 bp, Homo sapiens
aggaagcactccctgggtcacagtgcacagcagcacgtgctgaacttggtgcagtgcagacgtccatgccacatgcaccactacccatgggctgcggcagctcctagaaatctaggatgtgacatcagacgctcctccgggagtgtggtcatgccctccgatccgctgaggcatttcaaggaaagttacaccctttccaacgcagttttccttttagaaagatttggcctcagtagatgaatccatgtgatcaagcctagtgatcagctaggattcttgaatctcgggacccgttgccagaataacaaaatgggggcttcctgtaacctcggctctttaaagcaacacttctgataccagggttagggtttcagaaaatgcagccgccttaggagcctcattggcagctactttccactaaaacatcttccatttctctctctcaggagtttcctttaacagtgtttacactcagatttggagagtcctgctgcacctggctgctgacccctatccagaggtctcggacgtggccatgaaagtactcaacagcatcgcctacaaggtacgtgccgggcgctccccaccgcgctccagctgctggttctcggttacgagtatgcatgccaggaactccaggtgtgcccgggtccacaccacagtttagaaagtaacaaaacgagcttcagcaaatatcttaaatctggagatgtacacagtacaccccaaactgtgtctgtgcagctcccacgtgggcagagggtgctggatttactgatgcctgtcaaggcaattaggggaggactgacattatctttcaggatcctctggtgtctgggtgagctacagtgctggcccttcttccattttttttttctttctttacttaattatttataagagatggggtctccctgtgttgcccaggctggtcttgaactcctgggctcaagggatcctcctgcctcagcctcccaaagtgctgggattacaagcgtgagccactgcacctgttttttgtttttgtaagacagtctcact

SEQ ID NO: 20293 - DNA, 1031 bp, Homo sapiens
caattctgctgcctcggcttcccatgtagctgggattacaggcacgcgctaccatgcccagctaatttttgtatttttagtagagacggggtttcaccattgttggccaggctggtcttgaactcccgacctccagtgatccacctgtctcggcctcccaaagtgctgggattacaggcgtgagccactgcacccggccatggatacatttcttttaaaatcacattgtcatgccagaattttctctcctcctacttgacagcctctcttagaacccagagagcccggtctgtgtctccctaccctctgttctctcaagctgcctgaatcgtaaggatttcttaattcagcatgtttgcaattaacctctagaccaaagtagttctgcactgctaaaactgtctttacctctgaaattctctgaaatttctcttccagtgatctcagccgatctgcatatagatattctgatttctttttaacctcgtcaaatggcatttccttaactgagacagacagttctctgttgccaccgtgatccctccctctagaactgcacctctctgaagccattggactctctcccagctcagggcccctccgggaatcgtgagctctacgtccagcccctgaaggccgtgctgcccatcccacccctgcctggtttcagcggtggcctgctgtgtggaagtgtctgactgcctctcccaccaagccacgggcgtgcacaccctctgcatcctcagcaagcgttcacctcacctgtcttagttcctgcacctccaccacaaggatggatgctcagaacagtgggatgagccgccccaggaatgtggcatgccagcagcactaatgaacatgaacagcctggacacatgtcacacctatggcttgaaagcttgtcatgcacatgctcattcccctcactgcagacctggggaacgagggcagcatcagcctggactagcatagctacagaatcagatgtggccctgccttagagccacgctgcccaatgctggcccgtgggc

SEQ ID NO: 20294 - DNA, 1050 bp, Homo sapiens
agctgtgcgctccgtccaggccacttcacatgggagtccccgctctcagtctggtgtcacggggccatcacaggagctgtcctggaaccaagcggcagaggctttttgggggttgataaaccagcacacatggacgcacgtggcattgtctgaacagtcagttagaattgacttgggagctgtgctgggtcggccctggggatggtgggaccgacgtggctcacacttcacagcccgggcccctcaatccctggccagacgttcaggggttcttggtcaccaggatacggaagtgagcagagcacagaagtgccgtccttaggggcagcccggtgctcccggcagcgcctttgtccccagctgcagctcttttgagctcaggagtggcatgactgactggtgtttctttttccttccaaccctcctgcttaaaccctgaagactgcggacgacgcggacgatgctgctggacacaaaagtttcatctccgccacggtgcagacggggttctgcgactggagcgcccgctattttgcccagcccgtcatgaaggtgcgcccggggtgtggggttcagagtagagtcctagcgaacatgtgtctgtcccacttctttgagcataaacgctcaaggcttgtggctgtgggagcgtcccattgtggtcgtggtagtgatggtcacggttgaggtagaaccgcagaagaaacaaacttcacttaccttcctgtcgccaaacgaaaagagaaaacctgcctcgctggagcttcccagtgtgacaggtgtcactttgccttaactgacagggtcaccacaggccttcccactccctaatggtgaggatcactcgaggcccatcccaaggccacgcttgcgtggctccgaggtctggggactgttagacgcagcctgctgcagccaatcctagcgcatttggggttacaccacaagaccatctctgaggctcaaccctgacacagccctaacaagcgccgtgtgctgtggacgcagtggctgtgttcctgcaggctggggcagggcggcggctctcgg

SEQ ID NO: 20295 - DNA, 1027 bp, Homo sapiens
acttacaggggaacaaggacaagaatcaccacagacttctcattagaaactgtgtaagacagagatagtccagtaatatctttaaagtgctgaaagaaactgtcaacctagaattctgtacacacaaaaatatctttcccaaaagaaggtaacaagacaaacatatcctctcttgccacttgtcttcaacactgaactggaaattatagccagggaagttaggcgagcaaaagaaataaaacatatcatattggaaagaagaataaagccatctctgttcacagatgacatgatcctgaatattgaaaatcattcaaaatccattttaatagagtatcagaacttaaaaaccaatgcagcagtattgtacccacaagctcaatatccagtaaccatttgtatcagaatcccctacactagtaatgaaaaccctaaaaatgcaatcaagaaaacactttcatttataatcatagcaaaaataataaaatgcttaagaataaacctagtaaaagaaatgtaagacttgtactgaaacattattgaatgatactaaagaagacttaaataaagggaaagaaatcacacattcataggtcagaagactaacattaagttggcagaactccccaaatagctctacagattcagcaccatccctggcagccttttttgcaaaaattgacaagctgatactaaaatttgtatggcaatataagggacccagaataacaaaagaaaaatgtaagagacaaacatactgaacaactcacgcttcctgatttcaaaacttactacatagctgcactaattaagataccatggcattggcttaagagcagacatataggtcaatggatttgaattgagagcccagaaatataccttccgtcactgctttatgcctataaactctacaatttaggcgagatagacaaattccttggaagagattactacccagcgtcatttgatagcaaagagataacctgaatagttcctgtctattaaagaaaatgaagttttcttg

SEQ ID NO: 20296 - DNA, 1041 bp, Homo sapiens
tgcaagccccgccccgccctagagcaggcctgcaggagtggcagctcgggactcggatgcaccagggcgatatgtggagcaaccagccccgctgcgcacacagagggggcgcctgctacccgctgggcccccacccaccacggcctcatcaccagggctcgtggctccttgaggacgtcccctctcactcagtgctgcactgaatggcccttcggggcttccctcgtgttcatgtcattcctttttccaggatagattctggcacccactgcagcctgggccctcctcactgagcccggctcgcctgcctccctcctccactttttttttttttttttgacagggtctcactgtcacccaggctggagtgcaggggtgtgatcatggccactgcagctttgacctaggctcaagcaatcctcccacctcagcctcctgagtagctgggaccacaggcgtgcaccactacactcggctgatttttgtttactttttgtagagacaggactcagtctcactatgtggctcaggctggctttgaagactcggtctcactttgttgcccaggctggcttcgaactcctggattcaggggatcctgctgcctcggcttcccaaagctctgggattgcaggcgtgagccccacgctggcccctcctccacttttaaggaccttgtgattacactgggccccccgggatgctccagggtcaccaccctagtttaaagtcagctgatccaaccttatttcatctgcaacctggatcccccgagccaggtagtcacaggctcccactaggatgtggacatcgatagggaacactatgctgccaaccaacccctgtctacaagccaaagagcatcccaccaggtagagcccacgaacactcaggggtcttgggcaggaggtgggtggacacagggcgggaaggagatgctcagtggggttgggggaagcaccggccgcgatgggcctcccagatctcagggccaaggcatgggaagctggcaccatgtccgggtccttggggctgtcggta

SEQ ID NO: 20297 - DNA, 1076 bp, Homo sapiens
gtatttttagtagagacggggtttcaccgtgttagccaggatggtctcgatctcctgacctcgtgatccgcccgccttggcctcccaaagtgctgggattacaggcgtgagccaccgcgccgggccttttttttttttttttttttttttttttttttgagatggagtctcactgtcacccaggctggagtgcagtggcgcaatctcatctcactgcaacctccgccttgcaagttcaagcgattcttgtgcctccacctcccgagtagctaggattacaggcgtgcgccaccatgcctagctaatttttgtatttttcgtaaagacgggattttgccatgttggccaggctggtctcgaactcatgacctcatgatccacccacctcagcctcccaaagtgctgagattacaggcgtgagccaccacgcctggccacgggtttgtttttgttttacttttaaaaactttttggtctgggagaaaaatgacacactagcaatgaacaatctgaaaaggaaattaagaaaccaattctatttacaataggatgcaaaagaataaaatatctagaaacaaatttgacaaaggaaatgaaagactttgacactgaaaactacaaaacattgctgaaagtaagaggctctaaagatggaaagaaatcccacgttcatggattggatgacctaatattgttaagttagcaatactccccacaatgatctacagattcaaggcaatctctatcaaaattccgatggcctttttcacagaaatagaaaaaccaggctaggtatagtggctcacacctgtaatcccgacactttgggaggcggaggcaggtggattgcttgagcctaggaattcaagaccagcctggacaacataacccccattctacaaaaaatacaaaaattagccaggcatgatggcgtagtagtcccagctacttgggaggctaaggcaggaggatcacttgtacccgagaggttaatactgcagtgagccgtcgtcacaccactgcactccagcctgggtgacagaatgagaccctgtctccaaaaataaaaagaaaaa

SEQ ID NO: 20298 - DNA, 1083 bp, Homo sapiens
ttggccaaagtggctcggaagcaccatctcatgtcactcacctggtagggcctcctgctctctgtgaggccaggctgtgtcacggcccctctgggctcaggcggctccatgcacagtgcacccaggggcccatgtgtcccagcctcctcctgcaggtggaggccgcagcctccctttgggccagtgactgtgacagcagtgtatgggcatgacacctgctttcaggccctcacggcagggccttgccttgtaggctgccaagtcttcctgacagacaccatttgaaggccttaattagatcaaccttacatccccgagggggcctgacacggaggtccctggttggtcccggacctccagcacagcggcgcctgcagatgagagggaagcgagatgcccctggcccaagcccagcctgggggcttcccttccagagcccaaccgcttgctccgacctgcctgtacctcccttcccccccacactattcctccctccctacagtaggactccggcaggggtgctccagagacagccacctgaagaagccaccaggatgcttgggaaggacgctgccctgggccctgcctcccgccccatggggatctttcaggcccccaccgcctgttcgcagaggcgcgtgctcctgctgaactctgtggggaccctccagcacctgagcaggggaagggggcgggggggcctcatggtgggcgggtggagggccttgttcccctctggctgtggctggggatggcccagccctgcccgcctgccaacagctttgcggtgcaggctgagctctgcagggagattagcagccgtcctgattggattggccgtgttgcagccgcggcagccaagtgtgggcccctggtctggctgctcgtggtttgatcctgagccgtttcctgctggtgatcagtagctccgagcgtcacccacagaggggctgctggagtctcactcagcaagaggctctgaggcccggccaggtgtcctctgccggcgttgctgctgctccctttggcccagcatcgcagcggggaggcaccctccctgagcgctcacgccacagcgtcagg

SEQ ID NO: 20299 - DNA, 1048 bp, Homo sapiens
cgacagagacaggggcccctgacactgaggcttgcatgttggtgcacaggcaggctggggctgtcccctccgggaggcaaggccaaattccccatcaggtcaggtcagcactctccctgaccccatgccccagctcacatcctggccaggtccaggccagctgcattctcccccttctgcccttacttccaggtctaggcagcacccgggtaggtgggcgcctggtcgggtggcctagccctttgtcttgctcattctaagtttggccacgtggttcttggcgtgtaggccccggagggctgtgagaaacggctctgggctctggcctggcctgtgtcctccctgcttcttcttgatcccaggtcctcccagcctccccaagcgcagggtgctctagagggcgctggaggcccctcggggctgcctctttcagggtctgaagggtcatgtgtccccgtccctggaggccccatttcctcccccctgcggaccgaagagaacgcttgtgctcggagatgttcaacccatttgtgatgggcaacttggtcatgcagacatccagctagaagcatctgtagctgaaagaaagccttttgaaattgttaagagccagaatattgtattggtttttaaaatttagctgcatgtatttttttaaaaaaagaattataccccagatcactttgctttggtctgtgtctatatatgatctagtttagagagaaaaaagcataattacgttaaacaatttttttgcgtcttgtgtgcggacttccacatggctggtttggctgccttgcttcccattttcctggatggcttcagtccgcaggccacagctgcagccagcccgcccctccctctgctgactgccccttggaaaggaaaattgacccggattcttcccgcctgtctgggagtagaatccaaccatcggggatggaggccctggcctccatgaggctgcctctttttgctgggctgctcttcctgtgcctgtctggcctggcactgccaccccggctggactgaggctgttcctgctggc

SEQ ID NO: 20300 - DNA, 1056 bp, Homo sapiens
cctgctgcagggaggcctatgggactgggagctcctgggctcttccgcccacccaggggccccaaggacagccggacaacagtgggcgggtccagagcacctgggacacccgagggccaggtgtctgcttcgtccaccctgggccttggtccgggcactccctgcggtccagtgctcccgggaaagcgcccgcttcctgccgtcttccctgtgggccccagagaaagccccggggtggagggcgtcccccagccgggcacggcgccgtggttgttgatagcacgaagctgacagtcttcagggctcggccgctgctttctggatgcataaagctcaccaccgcgatgaagagaatgttctcgaacagtgcatttccccaggggcccgtggtcaccctgtgctggatgaggctgctggcccgcacgcggcaggggtggttccgcagtgctgggagctgcctgccctcgggggtatctggcccagagtccctgcttctgggtggggctgtgcagagggtttgaggaagcttggagtcctaccagggtgggctccacctggaccccccagaggccctcccttgggcctccagctggcaatatatgagaagttagatagggcgaggtggaggcaccttggggcagggcctgagctgccagggacccgccgtgggagggtctcagggaccctcacctggcagcatgaggaggcgtcagtagatagcaggtcccgtgtgtatggccagagtggccggtctgcctgtgtgaatgcctgcaggacaggagcccgttcactgcatgaatactcatgtgtagaccacgtgtcccgggtggtgggccatgtggcttaacccagcatggatgtcgtcacactccggccaggccaggtgtcccaatccccagggtgtgcagaagtggagtcagggccagctctgccctccgggtctccacctcatggtccccccctgggcccccacccctgcccctgccctccccttgtccccgttaatgggcaggtctctgcagctgctgggctcagagctgatccctacaagtgtag

SEQ ID NO: 20301 - DNA, 1063 bp, Homo sapiens
gggttgtgcatgagcctctgaccatcccccctgcggcccccaggagagacgagagttcacggagccctgcacggcgggggcctggccggccgaggaagcgcaaacactcaagctcgctgcctgccccacgtcccacggggccgctccccaggagcgatggcaagaaagtcaagtgagtcctgggcactggcatggcagggcgcgtgtggccggccctgggccctcgaggctggggagcagggtccaggctcccctgaggcttccaggctgctggtgccccttcacacctactctgaaggcctggccctgcccttcctagaccatcgagagtgaccagcagacagagccctgctccagacaggctttgcccttctggcagctcccagcaccaccctggcccgggtccccctctggaagtcacggcccccaggcccagccacgccggctctgcacacctggctgtggcatcgtccccgcccggcccccctggagtgtgaggcggtgttgcgtgcaggcctctttatctgcactgtataaagtcgttggtcacgctgtggagctgctcacggctgccggcgcgatgttattatccattacccgcccggcgcagtcgttggcgcactcccgggcctggtataattgtccttctcggctacaaattgcctctcccggcaggcccatttgcataaatcctccgagctcctccaaacacgattggcgcgtgcgtgtgcgcactgcatcaatcctgatgatttggtaataatagttaaatcggcactaaatggttccttcaattaagacaggcaaaaaattaatctcagggcttcatgtcacaaaacattagcaaatgcagagaaggttacggggaggggctgtgtggctgtgggcagtggaggggtcaccatatggctgcccccccccagagctgcccctgccctgcccaggtgtctcctgggggggggtctcctggggtctccctttgagaaccagccagcactgtgggaactgctgggcaggacagggcccctggaaaccaggatctggctagaaggcagcagcctca

SEQ ID NO: 20302 - DNA, 1025 bp, Homo sapiens
tgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctg

SEQ ID NO: 20303 - DNA, 1052 bp, Homo sapiens
tcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggttttcggtggtccagggtcctgtgtcccacggtactcctgggggttccccagggctccgggggctcagcagaagcctctcgttcccagagctggggcttctgggccaggcctccccaccgccccctgtgttggcccaagtgaagcccctcaggccaggaaagggtcatgtgaccggaatgggctcagagtggtcttaggggtggggtccctccaggaggagggcccctttcctggttgctctcacagtccctgtccagcctgaaccagtccagggccagagtaggttccactggagaggacgaagggcaagagcagtctccgagccgccacgctgggcagggtctcagacgtgaatgaccatcctgggaggggcggcccacggcccgggtgtgggaacacagatgagtgcacccccagctggagag

SEQ ID NO: 20304 - DNA, 1077 bp, Homo sapiens
gagaagaagaaagtgaactgcaagcccaagaaccaggacgaacaggagattcctttccggctccgggagattatgaggagccgccaagagatgaaaaacccgatcagtaacaagaagaggaagaaagcaggtgtgtgcaggcccatactgggcggcagtgaagctttgtgtgtctcaacccgcccaatcgcccaaatacttcagaacgtttcaggcagaggaaatatgccaagacccggtgctcagaaggtgggggagcgtggccaaagctaaagcagtggctggcagctggtggcgctgtggttccagacgaggcttggaaggaggctgtggggtgggcggggaggacccgttatggggcctcaggatccatgctaaggagcggcgtttttttctccccaaaagtagcgaagattcatcagagtttttagcagggcacggccaattcatgtttactctaagcaaaaaaagggtcaccgagcgatgatggagtgagggagagtggacctggcaactggcggggctactgccagggagaagccatgattcttgggacaagagtgctgaagcaatggtagagagaagtgggtggagtcaggagctgaaggaggaaattccatcaggcccctctgagaagtcttgccttcctcccccaagtctgggtagggtgtccacatgtccaccgctgcaacccagaggtaacactctgggcatgttgggaaacggagtccactgtgtgtatattttgcttatagacacatttctcttcccaaacgtggcactggttttacagcaaagctgttttataatttgtgtataaactgtaggcttcttgttgggggttatatggctgccaaagggatagtgagatagaggtgaggaaggtgcagggaggaggcgcactggcctgggtagcacatggcacgttctgaaccgtgctgcattgaattggcacctttgtttgtttgtttatttatttatttattgagatggagtcttgcttcctcgcccaggctggagtgcagtggcgtgatctgggctcactgcaacctccacctcctgggtttaagcagttct

SEQ ID NO: 20305 - DNA, 2038 bp, Homo sapiens
ggctctagggccggcgcggtgacgtgcgcgtgcgcgcactggagggaaaaggcggaagcggaagtcggggggcgcgccagctcgtagcaggggagcgcccgcggcgtcgggtttgggctggaggtcgccatggggcgaggcagcggcaccttcgagcgtctcctaggtaacgcgtccccacccgacggctcggccttggtcagcccgcagcctccgcccggcgctgagtcagcgcggccccgagggcccgaggggcgcggaccggccgccctgcccgcctctccccggcccgctgtcctcccgggttcggagccgccgatcctggaccctcggcgcggccgtggggtcggcgtccgtcgggcgttggcaaatggggctctgcgagggtccgcgcagggcgccaggggcgctcggcgacctcgctcctccgcgggcccgggcattcggccgatttcctcttgaccgacgagcacccggccgagtgggccacaaggcctgagtcatgaaagtgggtgactcagtcggatgttaggctcgcacttgggcttctgacccaaaacactgggcctcgaagggtggagccggcagtgttctctctgggaccttcgagctctcttgggggctgcgggtcccagacccaccttttgttcccacactggcttcgggaagtgcctaatggtttaggaaggcgttttctcacgtttttggaggtgaaagctgatcctatctgagcctcctggaattgacgcgttttgggagggaaacgaatgttgatgtgcacgtgcccagcagcacgtggaaaatgcgtctaatgtttgggggtaggagcttgggtggtcgaatgggctgcccaagcttgcctttttgtcaagtagggttttcaaggagacttcaagtgagacaccttccttgccaagggaaccagcaagcagactgagtatctcagccacacaggtagttcagtgcttcagggatgaatccagaggttaactactgaatcagtatagaaagtggacgtggcttggcttgttagatcgtttctgtatccgggaaaggcgatgtgggcagagctggagctgcccccccagaggggccagttgttggagacagcagtgatgtggtatgatgacaggtatgctggcgagtcctccttggagccccgttctgcccttatttccaaagcacttggcttggagcaaggggcctggagtctacactgcaggcctctctagcccttgcccaagctaaggtcccattgaaaccgggagcatctgggcgaacggggactccaagggacgggtgatagggttctttgttgagaagcagccgagcctgatgtttaagagtgaatcagcctctgtctctggtgagctgtgtgactcacggcagtgccctcgcctctctgctgagtgtctttacctcgctcgcgggttgtgggagggcttggaccagcacctggtgtgctcttacgctgtttgctgcttccctggggaggatggcacttccctgcccatcagcacgctcaggaggattctgtcatgctttttcatttggtccaaatgtctaaaggggaaggagagagtcccccccagctgctgccaagctggggtgctgcacggggcgtccagcaggataacccctccctttcatggcattttctctctcagacaaggcgaccagccagctcctgttggagacagattgggagtccattttgcagatctgcgacctgatccgccaaggggacacacagtgagttagcggggcctgtgccctgatgcggaggagcagccgtgcactaagctgggctcgcttggtgcccgttgggtctccacgacgtagctgaccgtgttaggctcttatgtggagaactgcatgggctacatgctaggattttttgacatcttggaggattaaggggttttctctgtacagcttgcagatacctggttatgtttgtatttgcttcggggttctcaaagactaagatggcagacagacttttttttttaagacggggccttgctttgtcacccag

SEQ ID NO: 20306 - DNA, 1101 bp, Homo sapiens
cgggttcagaccggctcctgcctttctggacccacggcccacgggcaggggcaggcagtgatggcagacaacacacaggtgaaaaggcagcagacagcctgtttcagagtggcaggactcctgggggccgggttgggctgtgcagtcagggaaggcctctgaaggagctgtcccaagtgtcgagactggaacagaagccagagccggcgtgagcaggcaggcagcacccgtgggcagacactcagggttgaggccccagggcagaaaggtggccagcgtgccagaggagagtgcagccgggcctgtgcgccgagggcctccaggctgttgggctggagttcagggttgctgtcagcgcagcaggaggcctctggtgggttttcgtctaggtcgtggctgccaaggtgtgtttcttaagggtccctctcggccattgtggccgtggagaactaggggattgtgtagagagaggtgggggcttcaggatgcatttgggagtcttggctggtgctcagggcccactcagtgagagagaggtgggcatggctgctcacatctgtgcgggttctctgtggccctgagtctgctgaagacgaggctgagagcgtggggaatggggcaggctccaggggtggtgcgtccccgctgcaggagttggacgcttgccctgtggctgcagggtgggcaggaccagtgtggagaacacgggaagaacgcagggggcgctgcacgagctgccttggaccctcaactttggggtggtggatgctggtggtctgtgctcctgtctccttcctggggtgggagctctcctggattttttctggggtcgtgtgtcaagaatagctcaaggtcttgtcctcaggatcagtgggagccctggccagagagcagagggtgagggagccactcagcaggcggggccacgcaggggcctcatgccctgatggagtgggagcagtgtctcaggaagagggcagcagggcctggctcttgtctcccgccacagtgaggacagaggccccatggggacacccaatcttgggggcaggaggctgtctcggtgcccccagacaccttcacttgggtgcacggtcactg

SEQ ID NO: 20307 - DNA, 1028 bp, Homo sapiens
gggcataggggttcacgcctgtaatcccagcactttgggaggccgcagtggcagatcgcttgaggccaggagttcaagaccagcctggcctacatggtgaaacctcgactactaaaaatacaaaaattagtcgggcgtggagtcacgtgcctatagcctcagctactcaggaggccgaagcacaagaaatgagctgagatcatgccactgcactacagcctgggtgacagagtgagactctgtctcaaaaaaaaaaaattaataaaaataaaagtaaaataaaatagaaacagggctcacgatgtttcccaggctgggttcggactcctgggccggtatgatcttcctgccttggccccctgagtagctgggactgcactgtggcaggcttatacctgtgttggtgcctaaacgttctagctctgcagactcaatttagccagtcgtcctgttccctccgccgcaggctctgctgccatgaaggtgaagattaagtgctggaacggcgtggccacttggctctgggtggccaacgatgagaactgtggcatctgcaggatggcatttaacggatgctgccctgactgtgagtgtcccctccatgctgtctgagcggccccgactgtgagtgtcccctctgtgctgtctgctgcctgctggactagcctcagtagctcctgttaaatacctgcacgaaatacccagtttcattttctttttttttttttttttttgagaccgagtttcgatcttgtttcccaggctggagtgcaatggcgcgatctcggcttgccgcaacctctgcctcccgggttcaaacggttctcctgcctcagccttccaagcagctgggattacaggcatgtgccaccatgctgggctaatttttttatttttagtagagacggggttttgccttgttggctaggctggccttgaactcctgacctcaggtgacctgcccgcttcagccttccaaagtgctgggattacaggtgtgagccactttgcctggcccacatttttat

SEQ ID NO: 20308 - DNA, 1050 bp, Homo sapiens
tgggtgtggtggcaggtgcctgtaatcccagctactcgggagactgaggcaggagaatctcttgaacccgggaggcggaggttgcagtgagccgagatcgtgccactgcactccagcccgggtgacagagtgaaactccatctcaaaaaaaaaaaaaaaaaagaaaacaagaagtggccaggagggctctgtgcacatggccccggcctcggctgtcccctgggcactcgtgctacgtgtcccggaactcaggtgaggtcaggagtttgcttcctcctcctctggccacttctgagtgaagcaacctcatgcctccctcttgcctcccggccacacacctgggagggcagaggccgggcgtctgcaccgtgttggatgtgggggctcccatctagcccggcgtcagggtccagcccctctgttttctgtccccctggctgtcctgggactgttcctgttgagtggacaagggagtggggagtgagggtgttgggtccattctaggactatgatggtgttggcaccccatcctccctctgggaactctgccaaactctgcactgtgacacctgagtccccatgaagcgctcgtgcccctcgacccgtgtgctccgggtgagcaggggctgaccccctctaggcctgctcttgtggggacccctcagtgtgagagacacagtggctgtcatgttcccccattctagaggcgtgggcctcagccccttccctccgtgaccagggcgggtcttgtctgcagagcgtggggcgtggagcatggggctcgcagcccagagtagtgcccgcccgtgctcgcccgtcgggaggcgctgttggggtggggtcttggctggcaggaggggtccaggggagggagcgtgtgcctggcctgcatggcgtgctgagggcctttgatctgggacttgggcagctgattgatggagggcgtcctgcctgccccgcgcctcccatcgccgccagccgcacacgcagagggcccggggccacatgccgctgctgggtccctttcagtgatggggggaggggagaagg

SEQ ID NO: 20309 - DNA, 1058 bp, Homo sapiens
gggctgcccttgctgggcagagggtccgaggccgggcccgggagccacgtggcttgccctgtccgcagcgccgtggggaagacatgcttgctgatcagctacacgaccaacgccttccccggagagtacatccccaccgtgtgagtgtgggggcttcccgggagagcacaggccctccgtgtgagtgtggcatgggggggacacgggcagggtctcctctgggcttccacgtcggctcaggtggccctgtctctgggcttcccggctggagctgaggtgctggccagagttctagttctgtgcagacttgtgaaccccaagacacaggccagcagggctgggggtttctgggacccctcccaagccctgaccctgccctcactgctctgcagttttgacaactactctgccaacgtgatggtggacgggaaaccagtcaacttggggctgtgggacacagcgggtcaggaggactacgatcggctgcggccactctcctacccccaaactgtacgtaacaatggggccagccccgggagctgggggggtccctgagatccgcacaagggagggagcagggccctggggagcccctgaccactccaccaggtcccacctttttcccaaggacgtctttctgatctgcttctctctggtgagcccggcctccttcgagaatgttcgtgccaaggtagggcaaggctgggggcccctgtggggagagggcttgccccagtacctgccccgacaagttgtcctttagaggcaattgcgatacgggttctgcctggggtaggcacacggagtggggtctgaagatgaccatgggggctgatggggtgccgtggtggtggtcacagctctcagaatggagggttctgagggctctggctgctggggatgggccttgactaggaggccctgggaggtctccaggttccctggctgcgtgtttgttcctggtatctccccaccaaatccgcccctggtcaccccttgaaggaagaagagccaagtgtagctctggaacagtggggaaagtccctgagggccgtgac

SEQ ID NO: 20310 - DNA, 1028 bp, Homo sapiens
tgtgatgaaccacccccagtcaccctcctgccggtcgcagagcattgtgttcgtgtggaggacacgcgaggactcttggaagtgctttttggcggggtagtgcagtgtgttccgggcggacgggcgtcagtttacgtgtgcgtttctcatccttgcaggtacctggccccgggcactcaggtggcagggacattttgctgttatccttcgtgggggtggacgtggaaggcccagcagtgaccgctgtccccggttggcccccaccctgccagcacctgacatgcacaccccaacctgcatgaggcccaggtgcccacctggcttccaggggtcaccttggcccggttcactgggatccaaggctctcactccttctgggagggcccctcccatggtactctcaggagacgcctgctttgtgggtgggctttctgatctgccccctacctgctaccaggctctgaggaaggccacactgtccccaacaccactggtgtgcagatggctgtgggtggtgacacgggcaggccaggctctggcacaggcacttgatactgcatttcccaagtaggacagataaacaacgctaaggccaagcagacgccccagggaggaacctggttttaatgggccctgtgctcagggaggccttcagtcagcagggtcgcctcagcagcatttgggagcctgccctgcagctccctgcctccaccctgcacgctgtgcccacacccccccacaacacgtaggtgaaagcacaggcaccatgcggaggccccgagcaccccttagtggggcggggtggggggaggaagtcagtccataatgttgtagttacggatcttggggggcctctggcagcctttagcttttgcaggatgagaccgggaggctcctgtggtcttggcctttgcctgggctgctgtcttcatccctggggtggcaatgcctgcctgcatcttgacgggcctcctgtcggctgctggaggagctgggagctctgtcaggtaaagaggaaaaaacagcat

SEQ ID NO: 20311 - DNA, 1042 bp, Homo sapiens
ccaccccatgtgtttggctccctgtcctgctgccttctcagtgcttgtgcacccccagcctcatcagacttgtcactctattagaacaggatgtagggcctggactgttggctccctgctacccccacccacaggacagtgctggggttgacccgactttggctgcacatttgactggcccctggatcagctctaggactagatgtacccaaaaggatgcccacatccttgcctcagctcctgcctctgcccacccagagagctgccttgcccccatgtccacgatgcagccaccaggcctgggtaagcgtgggtgtccgagacgggctgggacacccagaagaggagccaggacttgcttggtctgtatcccggctctgcatgcctcagtgtccctgcctgtaaagtgggatctatgggaacccatgtgtgggccgggcacagtgctcacacctgtgaacccagcaccttgggaggccaaagggaggatcctttgagctcgggagacagggtctcgctctgttgcccaggctgtagttcagcggcgtgatctcagctcactgcagcctccgcctcccaggttcaagcgattctcctgcctcagcttcctgagtaactgggattacaggcacttgccaccatgcccagctaattttgtatttttagtagagatggggttttgccatgttggccaggctggtctcaaactcctgacctcaagtgatctgcctgcctcggcctcccaaagtgctgtgattacaggtgtgagtcatcatgcctggccaaaaaaaatttttttaaattaaccgggtgtgatggcacatgcctgtggtcccagctacctgaggccaaggtgggaagatcacttgaacacagcacttcgaggccacagtgaactatgatcgcgccactgcactccagcctgggtgacagagcaagaccctgtctccaaaaaaaaccctctaaacctatgtgttatggatagggcctctaagaaggtaattaaagttacgtgagtcctaagggtgggaccctgaactgt

SEQ ID NO: 20312 - DNA, 1029 bp, Homo sapiens
tgaactgaggcacagggcagtactgaccatggggctgagggcaagtcccaagtgtgcagactgtgcgttcatggcgccctcacctgcagcctcctggcacagtggagcaccctcgtgcaggagctggaggctgccctgcagctggctttctacccggatgccgtggaggagtggctggaggaaaacgtgcaccccagcctgcagcggctgcaagctctgctgcaggacctcagcgaggtgtctgcccccccgctgccacccaccagccctggcagggacgttgctcaggacccctgaggggagagctcatgccagggggctcctgctggaggctgggggggctctgcactgccaaatggcctgggcaatacgggcccacgtgggcgtcgtgccctctggcccagcagtgtcttgcccacactcagttcctgagggccctgggcagcccctgggggagagactagaaaacacagaaggaagcagcacagggagacccgctttgtgatctgcatgtgtgacactgattctttggaaataaagagtggaagctgcaggtgacacgtgaagggttatttatggttatgatgaccctgtcctgcaacgagggactggcagccactactgaggaggagggtcccatctctctcctgtcggctttcaccgaggtcacagccagacgtggggcaaaggtgttccctgtcctacccagccattcctgggcctgccgcctaggggctcacagggcccaggagtccccagctcacaggccagggcatcaggccaggcgcgctcggtgcacaccgcacctgggaggacctgggtacactcaggagaccaagagcactggcgggtcaggatggttggcgttcagctcctacggggtggggagaagtctgtagccgagagcccagccccctcctgccaggtcttcccaggttcgagagaggctggaactcaatttctgcagaaaatctcccagtttttcctgtttggttagtttttttacaaagacaggatcttgctgtgttg

SEQ ID NO: 20313 - DNA, 1774 bp, Homo sapiens
ttcccatgacccacagccgggccaccgaggacgggttttgggtccagcacgagctcctggtaaggcctggggaaaaggtgttctggcttcaccctggggcggcagggactcgagctcagcattccctggtgcgttacaggaagaccagaggaagcagtaaggagctgaccgtggatcccttctctccccaggctgggtccgatacgccgagcgggtgctgggtcgccccatcactgcccacctctgcaccgccaagtccccccagcaggtcatgggctctttggtgaaggattatttcgccagacagcaggtaagctgacctctctggagggcaggaagggcaggtgagggaggaccatggcacaggggcccaggaaggggaggttccccatctgtccagcgtggtcacggccccccaggtgagcaaaaaggaagctgtggcttcaggaaacatcagcagtgctgtttctcaccaacgcccgtctctattcctcccttcctcttacaacctttttctttcttcttaaccttttctgtggcatctggtggttttcctgggcccattcggggtagagtagaaatgctgcccaccctgctgagaatgaggccccggaccttgcccagagatgctgcctgcctgctgttgggatgcctcacccaaggaggcctaaagtggcctgtgcctggaggctgagggcagctgtcatttagggagccaaacctggcctctgccctggcctttccctcagaccacgggcatcacatgacttccttagccacttctgtgagattccacagtggccatgatgctgtcctcctcttgatggagtgagtcccggcctgaggctcctgcgtgccccctgcctcggcccgtcgtgttctcccttcccacaaccctctgcggcccccaggtcctcccagaactccctgatgtctccaaggccaccctcaaagggaccctaatcccatggtttattctccagccgctggcatgccccacactgctcttctcaatcagactttacacctccctccggggaagcagccatgtccaggcactgtggtaactggagtagagggtaacatcaggatctttcagacatttgaagtcagcctaaaaaggcacgcacatttggcagccttgttattttagcaataggcagtgttttccttctatctagtttctttctacccataaagtcataatttggcaaattataaacatgatgtcagagtatacacgttcagtttaggcaggaccgaaaaatgagctatgggactttctgtcccttgccctgcccccacctgaagagagccatgtgtttctaggtcttccacgtgctgccctctcccctggatggagcccagagctatgtgtcctcctgtaggtgccatgaggggcagccgcagagacccggcctccagcagcctctcacctgaccacctggcacagctgcaaccaggggcgggtttcctcttttgctccgcccctgccctgagtgggtcctttccacccagacctcaccacagggtcacttggcaactgctggctcctggctttgccaccagttcaggcccagccacaggcacctgctctgtgtggacccaggagaggggtagcttgggtgggcatcgcttgggaagattcaggaaagtctgtgggtgaagtagccagcgcgcgcacacacacacacacacacacactcactcaggcctcctgcaatggctccatgctggaccagcaacagctccacgccggctggacttcctctta

SEQ ID NO: 20314 - DNA, 1055 bp, Homo sapiens
gggcgctggggtaatctcctactggccagtacacaccagagccaggcagatctgtgtcccagagccatctcagtgcctgccaatgtggtcgcttgtctgaagttactgacagctgagggtcctaggggcttaactgcaggtgaagagaagggtcatgttcgatctagcctcctgtctcctctgtgcatcttcctcaagataaatcaggtctcagctgggcacagtggctcacgcctgtaatctaagcactgggaggccaaggcaggtggatcacctgaggtcaggagttcgagaccagcctgaccaacatggagaaaccccgtctctactaaaactacaaaaaactagccgggcatggtggcacatgcctgtaatcccagctgctcgggaggctgaggcaggagaatcgcttgaacccgggaggcagaggttgcagtaagccgagatcgcgccattaccctccagcctgggcaacaagagtaaaactttgtctcaaaaaaaaaaaaaaaagataaatcaggtcctgggagaaccacttgggcagtgtggtggccctaactttacattacagtccatgtaaggtacttatctcttggtgggaaagttgtctatagccatagcgggtctcctaatcacaaaccaagtctgcacttaaaacacaagtgaagtttttttcattcagaataaaatgaaaaaggcacgtttgctccagtgatattgcctttaccacggtattggccactcctttcagatgttaagagcctacagtgagttctgtgtgtgttgtggatggaagtgattccctggaattatgtagaacccattcagaagaatgttgacatcagttggtgggggaagcttaagactttgttaaaattctggcggaactgttttaattggtctctgaaaacaggtccctgcaggtatttagatcagtggtagatgaggcagagaggtcagctctcagggacaatctttaagggcgccaatgtccctcacaggcccctgacttgaaattctagcacgcagacgcctctggaaaggtccccacccca

SEQ ID NO: 20315 - DNA, 1742 bp, Homo sapiens
actttgggaagccgagacaggtggatcatctgaggtcaggagttcgagatcagcctggccaacatggcgaaactccgactctactaaaaatacaaaaattaactgggcatggtggcggatgcctgtaatcccagcaactcaggaggctgaggcaggataatcacttgaacccacagggtgaaggttgtggtgagctgagatggcgccactgtactccagcctgggtgacatagcaagactttgtctcaaaaccgaagatattcatttggcaaattgagatacattgttatcactgatttgtagacacagaacacattgcagctattttagcataattgttactttaagttaaaaacccagtaaccaacttacttctgcctcaccttagtgtttagtacttcttccagtggtaaaactctgtgttccttttattttattatttagagtctcactctgtcacccaggctggagtacagtggcaccatcatagctcactgcagccttgaactcctggactcaagcgatcttcccacctcagtctcccgtgtagctgagagtacaggcctgcatggccattcagggctaatttatttttttttggacgtggggtctcgctatgttgcccaggctggtcgcaaattcctgtcctcaagcagtccccccacctcagtctgccaaagtgctgggattacaggtgcgagccaccctgcctggcctatacatgttttcaagtgctgatcatttattaatagtgaagtgattgtagtcaggcgtggctcccccatttactggcaggtcccatttagacctgcggttgcagaagtacagcacagctctgtgcatgattggtggaaatattccaggagatgaggctgttacagtaacagcagatttttccattgtgaaaatgtaactattcctgctttgttgaagagaaagatttttttggaaaatgaagaaaagaggatttctaaattaaggaagcttttagtgaaagcagttggcatttgggtagtagtattcttatctgtttaacatttttgtggggctcttgttttcttttatgtttggtttttggagcaatttataatatcttaaataatgacagtcatagtaaatcaacctccacactttttcatgaggaatttttgaatttgctgctaaaatgcagtacaggagggcatgtttaaggcacacattaccatctctacaatgtgaagcgggctttgagcacggaacaaggtgttacagctgtacctaggaagtggtggcagggagaccagaaagtacctcgtgccagagccacagcccctgcggccctgctttcctcgtgcacgtcagtttagagtgcacattgggcttcaaacgcctctgctgatttgttaggaacagagaaggtgctctgctgagaattccgtagatttctagacagtatttggtttttgctgcagtttgtcatttgagatggaatgcttgtgttctttgtcctgtgaagggcattggagtacgacaccggggtgagtctgcctccttcccctccctgggacgtatgacagtgtctggaggcacatttggttggcatagactgggaggacgggtgctactggcatctagtggacagaggccagggatgccactgaaaaatcttacaacgcacaggacgcaggaggggagagccgcctgttgcgtagcaacctggcagctgataatataataaaagttggttatgactcttggtccta

SEQ ID NO: 20316 - DNA, 1272 bp, Homo sapiens
cctcctcccgggttcaaacaattctcctgcctcagtctcccgagtagctgggattacaggcgccaccaccacgctctgctaatttttgtatttttagtagagacggggtttcaccatgtgggccaggctggtctcaaactcctgactgcaggtgattcccctgtcttggcctcccaaagtgttgggatcacaggccaaagtgtgagtcactgtgcccggtctactgttgtgttttcaaagtggcttttttggtcttgtatttttcagaatacgatagcattttgagtatatagagaatgttttaaaaattctgtgtttttgccatttctgagctgttggaggatgttaggataatgaacatcattttgatagccatttgagctgggtggaagaagatgtggtttaaatataaaatgtctgttctgggtcctccttgaggacctgttcccactttgccaagcttccccctggacttgtccacacgtgattaaacacagctgaaatcctgtacacttgagtgaactgcatgtaagtgttctgtgggctgggctgattcatctttacattgtacacttcctggggttgtagcctttgacccctgggtgacctcctccaggaattctgggtactcgataggactcaaatgtttattgctgaattggttggatgtgggcttctgagtttggattgggtgactactgtaccataggaaaccatgtaaaacagttataaatgtaagtcagattaaattcacttctgattctacagttgctcccacttttttttgtttttgttgatggtagactccccaaagtgacttttttggccttgtacagtcatgcatcacttaactgtggaaatcattctgagaaatgcattgttaggtgatttcattgttgtgcgaacatcatagagcatacttgtacaagcctagatgacacagcctgctgcacacccaggctgtgtgtatatcctgttgcgcctacagccacatgctgcacaaacttaagcaacatgtgactgtattgaatgctgtaacatggtgtttgtgtatctaaacatattaaaacatagaaaaggcacagtaaaaataaggtacaaaagataaaggtacagctctctagagcacttagtgtcagcagagcttgcaggacggggtgagtcagtgagtaaatggtgagtgaatgtgaaggcctaggacgtgactgtacaccgctgtcaacttcataaacactggacatttaggctatactttatttatttgagaaggag

SEQ ID NO: 20317 - DNA, 1152 bp, Homo sapiens
cctgtctcagcctcccgaagtgctgggattataggtgtgaaccaccgtgcctggcattttttttgtatttttagtagagatggggtttcaccgtgttggccaggctggtctcaaactcctcacctcaggtgatctgcccatctcggcctccccaagtgctgggattacaggtgtgagctacggtgcccggcctgtgtttttatttaagtttttgagcatatttaaggcagttgtttcaaagtctttgtctagcaaatccagcatctggccttccccagaatagtttctgtcagtttttatttctttgactgagtcatactttcctgtttctttgtgtgccttgtgatttttgttgttgttgcaaactggacctgtgatgatgagaacgcagtagctctggaaatcagattcttctcctttccttgggtttggtggggttttttgcttgccaaaggatataggggcccttttatttaacgacttttccaagctattgttattgcagactatcttccttcgttatgtagtcactgaagtccttgttcctcagcttgtgtttagttggtgttttgacaaagatttccttgaatgccaggaactcttacagtctttacgaactggctctgtgcctgagccctccttgaactcttgatgggcttgcccttggcctagggatcagcccagagtgaaagcaagctcgaggccgaggaggtcttcgcagagggggccttttgccctgggcatgtgtgtagctttctgaattttccagcacacactgaggcctctgaatgtcctgatttcccagaaacacacccaggttttcgccttaggcagtctgttgtatgttgggactgtaatcttctgccccaggcatctgagagttaaatgggtttgaaatgtttttaagctttttttggccttggatctgacttaggcaaaacagaagaggagtgccttgtgtcagtcagactccagacacattagaacagacacacacaatacattttgaatgaggtctccagcagcttctggtaggcacttaaggttagaaaacattgtttaggaaaagaatagaatataaagcttagcggttggttgtagaaggttcttgctgctggatccactcagctcctgggcagttggtgggggcca

SEQ ID NO: 20318 - DNA, 1031 bp, Homo sapiens
tggagtcttgctctgttgccaggctggagggcagtggcgtgatctcagctcactgcagtctccgcctcccaggttcatgccattctcctgcctcagtctcccgagtatttgggactacaggcgcccaccaccacgcctgggtaatttttgtatttttagtagagatggggtttcaccatgttagccaggatggtctcgaactcctgagcttgtgatccgcccacctcggcctcccaaagtgctgggattacaggcgtgagccaccggacgtggcctcaagtacttttttgaaactggttgtagggaatagtttgacaaatcggctagttggttgaacttgctttgcataaagagacatcactaaatataactctccttaaagttggggacttatttaaatctgattcatttctgtggggctgtatgatgttggttaatactgaagtcttgcaacaaagtctggctttgttcctaaggaacctgtctttggagtccttagagcttcttcgtgagtctgttaattcataaactccagaccattggcctgcacgttgcatttgtaataatttccattcccacaagaaactagaacaggagaatgagagagccaggctgggagaaggatgtttgcgacactgaatccagtttaagttgttggtttgttcaagtgaaggaaatggaatttttatcagggccctctgaacaggtttgaaactttacttagggatttgccattctgctttctgccacctagtgttcctttcctgtagtgcatctcttaacctgtcccttccttccatttttggtcagacgtctcaggcttgtaaacagattcctagtctatactgagcttcattacaaatcttgcagaatccagtgaggttttttttttttttctttttttccaagacagagtctcgctctgtcgcccaggctggagtgcagtggctcgatctgggctcactgcaacctccgcctcccacgttcaagcaattcttcctgcctcagcctcccaagtagctgggattaca

SEQ ID NO: 20319 - DNA, 1020 bp, Homo sapiens
caggtaaaagaaataggtcactgtcaccgggcgcggtggctcacgcctgtaatcccagcactttgggaggctgaggcgggcggatcacaaggtcaggagatcgagaccatcctggctaacatggtgaaaccccgtctctactaaaaatacaaaaaaaaaaaaaaattggcgtgggggcgggcgcctgtagtcccagctactcgggaggctgaggcaggagaatggcgtgaacctgggaggcggagcttgcagtgagccgagattgtgccactgcactccagcctgggcgaaagcaagactctatcacaaaaaaaaaaaaaaaaaaaaaaaaaaaaaaagaaataggtcatggtcagcacaaaagcatagaaaatggcacagtgaacccccacgcctgtcatatgatccacattttgctcatttctacatccatctgcatggacggcttttatttttttaaactgtctattgaagtatactgtctatacagaaaagtgtgtgtatcgtgcgtatgcaactgatgcatttttacacacaggaactctcactgacgcagtcagaatctagatgaagaaaaagcaagttggccgggcacggtggctcacgcctgtaatcccagcactttgggaggccgaggtgggcggatcatgaggtcaggagattgagaccatcctggacaacatggtgaaaccccatctctactaaaaatacaaaaattagcagggcatggtggcgggcgcctgtaatcccagctactcaggagactgaggcaggaggatcgcttgaaccagggagtcgaaggttgcagtgagccaagattgttccattgcactccagtctgggcaatagagtgagactccgtctaaaaaaaaaaaaagcaagttaccaggacatctggatagcttttaaatgtattccatggctcatcaacgtggagaggctcacacttagatgaaaacacagagcacctccctcaccttgctggggctggggctggggctggggctggggctgggcttg

SEQ ID NO: 20320 - DNA, 1050 bp, Homo sapiens
ggctcactgcaacctctgcctcccaggttcaagcgattctcctgccttagcctcctgagtagctaggactacaggcgcccaccaccacgcccacctaatttttgcatttttagtagagacagggtttcaccatattggtcaggctggtcttgaactcctgacctcaagtgatccgcccacctcagcctctccaagtgttgggattacaggctgagccactgcacctggcctgtttactcattctttaaaagatgtttttaaagtggtttttttttttttttttgggagatggagttttgcactgttccccaggctggagtgcagtggtgtgatctcggctcactgcaacctctgcctcccaggttcaagtgattctcctgcctcagcctcctgagtagctggggctacagacatgtgccaccatacccggctaattttttgtatttttagtagagacgggatttcactgtgttggccaggctgatctcaaactcctgacctcgtcatccacctcccaaagtgctgggattacaggcgtgagctaccacagctggctggtttttttttgtttgtttgtttgttttgttttttgtttttaagagatggattctggctgtgttgcccaggatgaactcaaactcctggacttaagtgatcctcccgccttgaccttctgagtagctgggacaacagatgtgctccactgtgcctggcctggattctttttattggagtataaatgaaagggcagacagtggtctaaagtctgccctttcaaaattttaattttgaattttttttagagagcccacagcctgaagaaccatgagccaattaaacattttttctttattttttttttaaagaagagtagagagcccagaaataaaccctcacataatgtagtcaaatggttttttttttttttgagatggagtttcaccctttttgcccaggctggagtccaatgtgcggtcttggctcactgcatcctctgtctcccaggttcaagcgattctcaagcctcagtctcctgagtagctgggatta

SEQ ID NO: 20321 - DNA, 1700 bp, Homo sapiens
tttgaaatatagaatattaaaaacatagagaagaaatgtatgtatgcttatagttttttaattcattaagtaaccaggaacatctatagaatttctttgaggctttaatgagtaaatgatcctttaaaaaaacatctaaactacatggcttagtggtaaggatggtgcaggggcaactgttttctatttattgaaggggaaaaaccttttttgttttaaccacagatgtataaacatgttatgttaaaaaatagcctaccggccgggcacagtaactcatgcctataattctagcactttgagagccgaggcaggtggatcgcgtgactctaggatttcgagagcagcctgggcaacatggcgagaccctgtctctacaaaaaataaaaaaaaattagctgagtgtggtggcttacgcttgtagtcccagctactccagaggctgaggtgggaggatcacctgagcccaggaagcagaggttacagatatctgtgatcacaccactgcactccagcctgggtgacagagcaagaccctgtctcaaaaaggaaaaaaaaagcctaccagccacgtcttccatatttcctttgtggaggggcttgggggtctttaatcatggaaggtacagaatgagacccagcctcccctctggcccaccttgtgcccaccccccatacctggagtgtctataccctgtcctgcctgccttcctgtctacagcaagggggtatctcttaattgaccattaggaaaatgctggatttggagagtagttccatattcagttacatgtcagggtctcttaacatattgcatgctaaattctggccgtatttactctataaaactgaggctgtgcttcaaactatatacatacacacacacactctctctctctctctctctctctctcacacacacacacacacacacacacacacacacacacaaccagataataacttctacccatgttccagtgaccatggctttatggctttgtcaaggagagaaactccacatggggtccagcttgctctgtgggagtgtgtgagggtccctcagagtttacagcttattctgatggtttgagataccagttacctggggctttgtcagtgtgtttctaagaagctttattagactctaatgtgtttctcttaagtggtatttctgtgtgttttttctaacatccatttatttgagaactacctatgaacaggacaaggctttcttgctaaagagggtggctggataaaggcctggcctcagttttgggggggcccaagtcaggacaggtcttttggggagcagagcccttggagcaaggctctcctggaccacagtcgtgaagtggcgaggaccccacgggacccctcatgcatgccctgctttctgtcgtctattgcaggtgcctgcacagctcacgtcggcagggaatgacagactagcacacgtcaggcacccttctctgctgaactgctattaaacttgtttctgttgaaacattttctctcctgtctagatggaggtctgtaagtctacagctgcatctctttccccagtaaggccactcctgtgtcatttcatgcctcgtggctccagctaattaagcgggagagggattagtttctccagattcctcctagttcatggacattactctctctcttttttttttttttttgagatagagttt

SEQ ID NO: 20322 - DNA, 1003 bp, Homo sapiens
aaaaagaaaaagaaaaaaagaaatgtattcattaaaaataggtgtgtaggtgagtttattctcttccgtgtcttcaaactccaggtagtacttgtccatgtaatttctctgtaataactggaactcgttatccatgataacgttctctaaatatccaaccacaacagcaaattcatcagaggtggaggagaaagacagcacaaagctctcttcttctaaggtgtccatcactgcagccccgagcaggctcctaccccgcctgtggcccaacctgcatgcagggcgtggcgggcggccgggttaaggtctcgcagccaaagctgcggcgtgctcactgcccagtcagggcagcacctgcgtgccaggcccagccctgggttagggccccgccgggccctctgtgcataccgccgacactgcgggccaaggtctcggtgactccaaaatgatttttatggttttatgattttacttcacccagaattgagataattgttgtgactatgagaagtttgaaaggacgggcctctcagcctccaaagggactagagctggttccttttatttatttttgttttatttatttttttggggacagagtcttactctgttgcccaggctggagtgcagtggcgcgatctcagctcactgcaacctttgcctcctgggttcaagtggttctccattctcagcctcctgaggagctgggactacaggtgcatgccaccatgcccggctaatttttgtgtttttactagggatgggattttgccatgttggccaggctggtctcgaactcctgacctcaagtgatccacccgcctcggcctcccaaagtgctgggattacaggcgtgagccaccgcacccgtcacttgatctcttttaaagggaggactgtactctggactcaccctcacccttgcacttttggaagcgttcctggacattagacccatcctctgaaaggaacttgtcctgttccttctcctcagtttctgtac

SEQ ID NO: 20323 - DNA, 1051 bp, Homo sapiens
ccacagacttactttgcgtctcgtaagtgatggtggtggtgacgcaggggcagggcttctggcccgtgtcacgttcttctgctcacatggctggagtatggccccaaagtcaccttttctgcttccacattcccactgtgctaaccttctttcctcctaagagcatgcaaattaaatgactccacatcagtcagtacagccacagccttcacttcggggcttgttgactgttgtctgttcttcagactcggatgctgcgtggggtagctctttctgagtccccgcttaggaggactggtcctggtagaacagcgagaggggaagtcgtccttctcaggcagtggctgggattgccatttgcactgcttgagggttttatattaccatcgtgtgggtttgcttttcttcagtcctagtctcagaatctaccttctacttcacacttaaaattctgagagcagttggcaaagctttgccttctctgtctttgtcggggcaccaataacagtcatgtttgattttctggaggaattgatagaaagattgggcgtcagctaaagccaaataaaacattatagcagtatctgtggttattagaatatttgaaatctcatctgatgcccttacctataaacagtttcacaaatcccacacatggcctagcccacctcttcatgtcgcccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacagggcccagatccctcccacacatggcctagccctcctctccatgtcacccatgaagtagctccatccacgggcccagatccctcccacacatggcctagccctcctctccatgtcacccatgaagtagctccatccacagggcccagatccctcccacacatggcctagccctcctctccatgtcacccatgaagtagctccatccac

SEQ ID NO: 20324 - DNA, 1059 bp, Homo sapiens
aacagtacttggttgtcaggagacaaatgacaccccctttgcaaagtgcacttattaaaacagcaagtgctttctgagtgcgtcagctgtaaccatgcaatgtcttcttctcggtgacacaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccaggtgagacagcgggagaggaagcgagggccccaacagcgtgagccagacgcggacgcctgggctccacagagaagaaacagccggactggaggcctgcctgtccctctgtaccttatactagtacctgattttataggccttggaaaactaatagcactgggagtgttttttaaaaatcaatgaaggttctttaaacgacactgagtagatgcctgaaataacttagaattaacctgtttcttagtttgtcattcaaaaatccatgaaacagcccccgcacccccaccccccgcaaaaaaatcaaaacaaaacaaaaacccatgaagtagacaaactagacactggaagcaaaaacatgtcctttttttttttttttttttttttttgagacagagtctcactttgtcaccaggctggaatcttggctcgttgcaacctctgcctcccaggttcaaagaattctcctgcctcagcttcccgagtagctgggactacaggcacacaccaccacacccagctgctaatttttgtatttttagtagagacagggtttcaccatgttggccaggatggtctcaatctcttgacctcgtgacctcatgatccacctgccttggcctcccaaagtgctgggcgtacaggcgtgagccaccacgcccagcctaacatgtccattttaaggaataggtaaaacagtttgcagtttacttagtcataatgtggaataaaaatgtgtgccctggggaattaaacaaacaaac

SEQ ID NO: 20325 - DNA, 1050 bp, Homo sapiens
tggaaagggtgggagtccctgctggctgccgagtcaactctggcattggggcctggctcaggtgtgggctcccgctgctctgggttgggtacatgtgggctgttgccggctgtgtggctgatcctggcgcttgcgggatctcaagcaggcaaatccgaagctaccgactaaaactgtctctgtgcccacgacacgctttctttgaaagagggtacaggtcagaaggctttatcacgacgtttgaatccttaccgaacgctacgaacagagaccttgaaacctgcaggtacctcctactctgactcagcaccaccctgcctctccccaaatttatggaagaacaaggtctggaaccttttctagggaagactgactacctggggttttttttgtttttaagtaatagcaacacttgctgcctgtagatagatcgcagagtttgcagtcatcagttacctgtttgaatgccttcgtccccaagccctgtgtctcctccttctcttctctctgggtaactgtggctgtggatgctctaaggtgataaacctggtggcactgcaggtagctgggaggagatggaagccgggagggctggcgattggagggcaggcggttggagggctggctattggagggcaggcggttggagggctggcggttggagggctggcggttggagggcaggcggttggagggcaggcggttggctttctggtcttagtcactcccagtctgaagacaaggcagaggcctagtgattcccagattcgatatgtgtcagaatcacccagaaggcttggctgttagaggccagagtgctgcgttccccagagttcccgactaggcctgtctggtgtggggcccaagaatgcatttctgaaacagtccaggtctgccaagagcctccggtgcaggtcagaggctttctgggtccacctctcttagaagcagtttgaaaaaccgtatccctgcctggtatagtgcctcacgcctgtaatcccagcactttgggaggtcgaggtgggtggatcacgaggtcaggagttcaag

SEQ ID NO: 20326 - DNA, 1520 bp, Homo sapiens
ctggtggcgggtgcctgtagttgtagcttctcgggaggctgaggcaggagaatcgcttgaacccgagtgtggaggttccagtgagatgagatcatgccactgcactccagcccgggcgaccgtgcgagactctgtctcaacaaaaaaagaaaaacggtatcctttttatgtatttaagttatctggaatttttcattataaatttaagcaagtgttttaatttttcactattgaaaatattgatgttttaaaataaagcttttacgggattattttcagtgtactactggactccaaatacagacatcatgagatgtccacttgcccacgtgtggacacacaggcaggagcggcccagatcctcccttgtctgtggcctggtctttccatctcacattccctaacaggttttgtacgagtcacatactttaggcttaaatgtcatttattagtcatatcttttctctgcagcaataaaatatagatataaatattaaagtttgtctatgagtaacaaaattgataaaacccaaaaatataacaaattcttataaaaccaaaaattaaaatgttactgaagatgcctttcttagtgtatttagctttaaaggaaaccacctgattcgttctgtattcactgatggttgcacagtcctagtgtcaacactgagggcctgtttccactcaggaaggagaggacagtgtcagcactgagggcctgtttccactcaggaaggagaggacagtgtcagcactgagggcctgtttccactcaggaaggagaggacagtgtcagcactgagggcctgtttccagatgaacgtgaaagtctgtcagtgatcttggctgggtgtggtggctcacgcctgtaatcccagcactttgggaggtggaggtgggcggatcacttgagatcaggagttggagaccagcctggccaacatggtgaaactccgtctctactaaaactacaaagattagccgggtgtggtggcacattcctgtaatccctgctactctggacgctgaggcaggagaatcgcttgaacctgggagatggaggttgcagtgagccgagttcagaccactgcactccagcctgggcaacacagcgagactccatctcaaaaaaaaaaaaaagtcttgtcagcaccagtatttcctattattgctttcatgctccatcccatagttttcatccccaaagccagtgcccagttgagcagatgagagaggctgttcagagagaggaggtggcagatgggctttaagaaaagacttcaggaccaagaggagattctggaaatgattttccttaaaacagtgtcggctacagcctggatgctgaacacctaggatgagaaccactgcacaggtgctcataattttggcctcttgtagtcttttattttttatttgggaggtagtgtctcaccatgttgcccatgctggtctcaagctccggggctcaagcagtctgcccacctcggcctcccaacgtgctgagatgacagggtgag

SEQ ID NO: 20327 - DNA, 1020 bp, Homo sapiens
gttgtcgccgttgtccacaccctgcccacctgccaatgctcctgtgtcccctgctctgctccagggccccaaaccctgtgcagagctggggtgcatcatgctgccgccccatggagaaggcctggaggagatggaagccgggaggcttcctcttacaggaagggaagccccagaaatgtgcctggcaccaagaaactgctccaagcttgttccagagtgtggggagggcttgaggcctcccctttttgagtacatggaaaggaaagcctggcattttctggaaacgctcccaagtctccctggcagggagatgtgggaagagtccaggcgcccaagctcttgcatattcacttcctcccatcacacgtgctgtgtacaagcaccctcagagctcgctttgggagacccctgcctcagggctgcgggtgccgccgtccacaccacaggcccttctgcttcctgtttccaaagctcatctcctgtctctgggctgcaggcgctgtttctggtttactggcacaactgtggttgtgtttttgtcaatgacttcatctttgctgctgttgttttgagatactgtcttgctctgtcacccaggctggagtgcagtgccgagatctcaactcactgcagccccgacctactggtctcaagccatcctcctgcctcagcctcccaagtagctgggactacaggtgtgcagcaccacatccagctaagtttttgtattttttgtagagacagggtctcactatgttgcccaggctggtttcaaactcctggactctggtgatcctctagccttggcctcccaaagtgctgggattacaggtacgagccagcatacccagccagtgttgtcgttttgatttgggagttcggggctgagctgtgtttggccagggcctcgcctgctcagtgtgctcctgggctgagctgcggtcctggagcatctcttggctcacatattgactcctccggcctctctactgtcctggtccttcatggggctcacatgtg

SEQ ID NO: 20328 - DNA, 1050 bp, Homo sapiens
cagcactttgggaggccgaggcgggcggatcacgaggtcaggagattgagaccatcctggctaacacggtgaaaccctgtctccaccaaaaatacaaaaaattagctggacatggtggcgggcgcctgtagtcccagctattcgggaggctgaggcaggagaatggcatgaacccgggaggtggagcttgcagtgagctgagatcgcgccactgcactcccgcctgggcgacagagcgagactgtctcaaaaaaaaaaaaaaaaaaaatgctccagacacttcagtttgaaaatattggaatttatgtggggaggattagtgtgcatggaaggccaaaaatgtgaatgcatctccgcagtcatctttccaaaagccgccctctgaatcagtgaggaccctcagggtggggaacgtccccttgtgagtgtctgcagattggagtaggcagcagcggagcccgtctctgtagatggactcgcagaggaacttagttctttccctaaaggagtaggaacagctgggcgccgtggctcacgcctgcaatcccagcactttggaagaccagggtgggcagactgcttgtgcccaggagttcaagaccagcctggacaacatggtgaatctctgtgtctacaaaaaatcacaaaagtggctgtggcggcagcacctgtagtcccagccaccaagaggctaaggcagggagatcgtttgagccagggaggttgaggctgcagtgaaccgtgatcgccccactgcactccatcctgggagacagggtgagaccctctccacatagtaagtaaatggaggaatagaaacgcaagccggcatacattgtctttgacagcattttgtggataggcaagttctaaccatgggggcaacgtgggatgcagcagggtttggtgtgccgtggggcaggggtaatttgcttgtttctctaagactttgtacagctctgtaaacagattcccattaggtcgtcctttccttgtgacaggtaatagtggaggtgtcacaaggtaagtggcctgtcttgcctggttttc

SEQ ID NO: 20329 - DNA, 1026 bp, Homo sapiens
tgacacagaataattgtgcaagtgtatggggtgcacagtgatgttgagaagcatgtgactcgtgatcggcacatccgtcatctcattgaccatttctaggtgttgggaaccttctggctgtttgaaaccgtattgttgactcccatcatctcgcagtgctgcagaacactaaacttattccttctgtctagctgtcgtttctagttttacgtctttttaaaaattattcctcctgtctgtcatttctagttttatgtccttttaaaaattatttattttttatagagacggggtcttgctatgttgtccaggctggtctcagcctcctggcctcaagggacccgcctgcctcagcctctcttggggttgcaggcgtggaccactgtgcctggcctacgcctcttgtattctctgggtcatccagtcaacttgagccctggtgagggtgaggctgttgggttgggtgagtcagccgtgttgtgctgccgtaacagaacacccaagatggaagactttagcatgaacagaaacggattggcttgcagttctggaggctggcaagggccttcttcctgtgtgctcacgtggtgatggggtgaaggcatattcacccttttagaatgaactcactcctggaatcatgagcctgtcccttggtgacagcattaagctgttagtgagggcaaagccttcatggtcaagtcaccttctgaagatgccacctcctaattaggctgcgtgggcaagtgagtttcagcatttcaggagacagatgcccacaccatagcagtgacctcatctcattcagggtattggtgcttgtcagacactggctgtgactcgcatctgggtgcgtgtgcctctctctgtgggggccaccctgccgtcaggcgccaggaaaccgacgtcagggaatgtgggggtctccctgagagggtgccgacctaacacggctcctccgggtcacgtgggtgggctcagcggcctcccgtgcctcccctaggtctggagtctcccctgccctct

SEQ ID NO: 20330 - DNA, 1050 bp, Homo sapiens
aggctggtctcgaactgctgacctccggtgatccgcccacctcagcctcccaaagtgcctttcctctttaagaacatcctcccctttgtttcctgacacagtgtggtcttcccccacacccccgcgtgttgggatgtgagacaggtcccctgagaggtgcccgcaggctgcctgtcctgtgtgtgtcctctggtgcccctgctcgggagcagctagtgtctttgatgctgacgtctgctggaggccacaggctcctagtgtttttgatgctgacatctgctggagcaggctctgttaggggtgttgtgtgagctggtggagacccaggccctgtttgtctctggcaggggcataagctggtaggagctcgctgaggtcgtgtctgaaggtgactcagtttcgagagtgggcgctgggatcccttggaactaatttcctttcttttacttttgcttgcaagggagaggaggtgggcaggaggaacggccctttgtggcccggtttggatttgacgtggtgacgtgctgtggatacctcccccaggtgagtgcacggcgtttgcttctatttcacaatcaggtcagctgttcagacacacgggttggggggacacacccccctcctttttttgtgagcttcagtaaaagtatttgcaccattttttctttgctgatgtttgagaggttgacgtaagattgacccacctaatatgctaggtaagcatgaagaaactgaggaggaccagcaagttaggagctggatttcaaggtgggtaaaaatgagggaatttaacaaatgttttaggtatactaaactctcaaagagggtggaatgacaagggtttgtcacttttggttgtgtgattttatggtggcttccctccgcatttccacctggggagttctgcttgacgcccagcacatgtgcagtggacagggctcctgtcctgtcctcgagaggagggtacagatgaacccagaaaacttgccagggtttcctggcgggcgcgggggcagtagaaagactttgaaatgttgaagtttgttcaga

SEQ ID NO: 20331 - DNA, 1050 bp, Homo sapiens
ctcagcctcccagctgtttcttttttctttttctttttgagatggagtcttgctctgtcacccaggctggagtatagtggtgcgatctcagctcactgcaacctctgcctcctgggttcaaggattctcctgtctcagcctcccgatgtagctgggattacaggtgtgtgccaccacacctggctaatttttgtatttctagtagagatgggattttgccatcttggccaggctggtcttgaactcctggcctcaaggaatctgcctgccttggcctcccaaagtgctgggattacaggcctgacccaccatccctgacccaactattgtttcttaaaaaaaactctttttaaccttgcctttttgttagggtagaaggatagctcagagcttcaaagagcaggactagcctaagaactgtctgtgatatttgaccagaggtgcagcctagctgccattcttcctcaccctgtggaagacattaaagggagaatgaaagtagctgtagaattacctttgggggaagaagccacttggtgaacttggcaaacacccgtgtttgaggggtcacccagggtgtcatgagctgggccggaggggatggattgattacttgtcttgtttgcttgtttctgttgtaagtcagggcccctcagcagaaggcagaacagaaccgagttcctttagaatgctggtttttgtgtggagtgaggaaggaccgtgagtgtggtcagtttccaacctgacaggacctgctcccgttggccaggactgcagcttgttactttgaccctgggaagaaggtaagtgttcccaagaaaagggacgtcccaaagcggcgccatcccgatggcacgtgtgctgctcgactccctgccgggtaggtccatcctgacggcgcatgtgcccctcagctccccccactgggtaggtccatcccgacagcacctgtgctgctcgactccccccactgggtgggtccatcccgacagcacctgtgccgctcgactccccccactgggtaggtccatcccgacagcacctgtgctg

SEQ ID NO: 20332 - DNA, 1035 bp, Homo sapiens
gccggccgggtgtgccgtgccttttaccttcccagcccctgccctggacctgaggccccgcctgatgggcccagccctcttcttccctgcctgacgtgtgtgcccaagttagctccagtgaggcctctgctgtggctgccccaccctaagaggcagcaaggaaggtgggtagcccgggggtccagctctggaccttggttcactcacacctccccacgccctcagtgctcccgggcacccacacgtggcctgtgcatcctcctgtcacagcagcctgcagaccccacacccctcacggcccaggctcagcctcagccttgcagcctctcgtctccgacggggggcccctctgcaccctgccctctgtggtggacgccagctcccagccagagccagctatcagtgaatgaaggtccttgtgactcccacgtggtagcttctgtcaagggcccagtgggcagaggccctggctgagtcaacaaggctgacaaggctgtgttctggatgcaggcccggcagatgtttgagggggaggtggccagcctggaggccctcaggagcacgggcctggtgcgggtgccgaggcccatgaaggtcatcgacctgccgggaggtggggccgcctttgtgatggagcatttgaagatgaagagcttgagcaggtgagtgtgtgtgagacccatatgcgcacatgtgtacaggcagagagagactcagagacaaacagagagagacagagaaagggatagagatggggagggagacagaaacagggagaagcctgtggctgagccgtccacacaactgcccggttatcagaggcagggccaagagttccaccctgccattcttaatggagataaaaagttactgctttctggtatgtgactggttttcctagataagtttggctgtaatgaggctgcataaaatatatatatatacacatatatatatatatatatatattttttttttttttgaaacacagtctcgctctgttgcccaggctagagtgcagtgcagtggtgcaat

SEQ ID NO: 20333 - DNA, 1101 bp, Homo sapiens
ctgcaccctttgcctgtgggttcaagcgattctcctacgtcagcctcccaagtagctgggactacaggcccacgccaccatgcccggctaattttgtatttttagtagagatggagtttccttatgttgcctagactggtctttaactcctgggctcaagggatctgcccacctcagcctcccaaagtgctgggaattgcaggcgtgagccactgtgcctggcctccagctttcttttgactagtgttagcatggtatatcttttctatcctttcaagctttttttttttttagtagataatgtctttttgcacataacttattgttggatttgctttatttttccaacctgccaatctgtcatttaccaagagtatttatttttgacattcgtatttaatgtgcttagtcatatagttttgagtctgtcatcttgcaatttgttttttgtttcatctgccctttgttctctctttacctgccttcctctgggttgagtattttatgtttctgtcttacctcctttgttggcttactaggtatctttgctgggttttgaatggtccctctagggtttaggcagcacttggctccgaattgcaacagtggcctcttttcccttgttgtccaggtgaatgagtggcaggatgactggccgacctttttcgcccggcaccggctccaggcgcagctggacctcattgagaaggactatgctgaccgagaggcacgagaactctggtcccggctacaggtgggcacggcagtgacttctctgggaaagagctggtcctctcatgatcccgccgcatttgtgcgggttcatctgtaaaacggagctggagcagggaacactgagtcctggagcacacatcagggaggaaggggggcaggggcgggggttcccccaaaagggagtccgaaaggagtgaggagtgaagacacacttggctcctcgtgcccctctccactgctaggtcaccaggtatttagcctcagactttcctcatgtgaaacacaggtgcttgtaaatggtggtgtttaccatgattactgttcttactatcagtaacacttgtccactccatcgtgttcctctcc

SEQ ID NO: 20334 - DNA, 1049 bp, Homo sapiens
gctacttaagatcggttttaatgctaatactgatcagctgtgcctgaattccaacgagaggagggtataatgaggcctatgtggaccactccccacaatcccttaatatcatgaggcctgaactagtttttcaggttaagtttggaatgcccttggccaagaggaggggtctgttagatggctagggggcttagaattttgtttttagtttacaggcatgtttggcaggggagtgtgagaggagtgccagggatgtgtgtctcacaaggacagagttgagcttggcccttaacggctggcagaggcaggagagagtgaaggaaggaagaggcgaggaggagactctgttaggaagagtatcgaggcagtgggaaaagaggaacagtgtgccaagcaagtaaactgcacgaggctgggccacagtggccctcaaaaggctagagggaggtggggcattccctccaggtggcctgtgtggcctcctttagtgagaggggaggtgtgctcttgagagctggggaagaggtggagctgccctgtggaagctagcaagggaaaatggggtttctgaggctcatgggtatgtttggcctagtgataattaattttcatgttatatttgtttttagtaataatggacaaataccaggagcagcctcatctgttggacccgcaccttggtaagaatagaagctgctgattttgatcattcagttacagatgaccacggaggccttggtgtgtggtgctggcacatgcatgtgctttgccaggatcaaatgccaagaagtgtccctgtcttgcttgcctggctggttggttttagccgacctgtgatagtggcttgagttccagatgtcactctaggctggggggagatgtgtctgagctacttaattcctttctgctaaggaaacaacatctgctcctcatgtgttttttttgtttttttttcttttttttgagacggagtctcgctctgtctccaggctagagtgctgtggcgcgatctcagctcactgcatcctccagctccctggttcaaggga

SEQ ID NO: 20335 - DNA, 1068 bp, Homo sapiens
tttccctggaaggcccctgtacttcagctttaaaaacacgctttggtttagtcccaatttaagcattaagattaatgcaaattgaggaaattcaaggaaggagaaaaacacattaaaaatggaaaatgggctgggcacagtggctcatgccggtaatcccagcgctttgggaggccgaggcaggtggatcacttgaggccaggagtttgataccagcctggccaacatggtgaaaccctgtctctactaaaaatacaaaaaattagttgggcatggtggtgcgcgcctgtaatcccagctacttgggaggctgaggcaggaaaatcgcttgaacccgggaggtggaggttgcagtgagccgacatggcgccactgcattccagcctgggcaacagagcaagactccatctaaaaaaaaatttacaaaaaggaaaatggctgtcatttcatgtgtgactctgcttgctgattgatagttgtgctctcttggtttctagtgctctgattggaagattgtcgactgtgtggagtgggtttctccctgtgtgttctcacaatggctgggaggcggcggcggggctgggggactcggactgcgagacggggctgttgactatgaaagtggtaataggatgctcttccccttatcggctgttaggctcgagtctcccctttgcagtgcggtttctttttatttttatcattgacaaaagcacaactcttgttaaaggataaaatagtcacacacaacagcattaaaaaccaagaaagccaaagaacgctggcactgtcagcctcactcccagctcccgctcggcccttgtgaagagaggtgctgaagccactctgcttttttatagttaataaaagcagccaggtccccaagtaggagtggttgtggccaagagtgtgtgggccgggaaccagggcttgagctgctgtgagctgtgcccaggccctttgctgactccgtctctcctgtgacctgaggccagggtgagcaccagcgcccgccccacctgggagggaagcagcagacctctcaccgcagaggctggtgtgaggcta

SEQ ID NO: 20336 - DNA, 1032 bp, Homo sapiens
ttttccaggctagtagtgccctgaacttaaacctgggcacgttttgtgatgccattgatgagggaggggtggagaggctgcagtctccatgaggggactggacttatcattgcatccctattttcagatgaatttttgggagatgatttcactagtctcttataattactttatcatgtacagaaactgttttctttattattaggtggtgagtgtttagaataaaaattctgaaagatgtgatgaattgttttcacaatttgtgtgtatgttttaaacttctatttgtatttgtaacattaaaaatctttttttttttttttaggcacaaatatttaaacatggaaaacgtgaagactgtttgccctatggtaaggtttatttttaagagacgatatctttgtgatgtgagtttgctcatatacaatcaagtgtctttccttaacattttattcatagatataggaactgtacattggtatgtttggacactatcgttcttttttttgttgtgggttttagtaactgaacttttttttttttttttttttttttttttttttgagactgagtctccctctgttgcccaggctggattgcagtggcacaatcttggctcactgcagcctccgcgtcctgggttcaagcaattcttctgcctcagcctcccgagtagctgggactacaggtgcctgccaccatgcccagctaatttttgtatttttttttttttgagatggattttctctctgtcgcccaggctggagtgcagtggcactatctcagctcactgcaaactccgcctcctggattcacgccattctcctgcatcaacctcccgagtagctgggactacaggtgcctgccacaatgcccagctaattttttgtatttttagtagagatggggtttcaccgtgttagccaggatggtctcgatctcctgaccttgagatccacctgcctcggcttcccaaagtgctgggattacaggtgtgagccaccgtgcccggcctaatttttgtatttttaa

SEQ ID NO: 20337 - DNA, 1071 bp, Homo sapiens
cagtggggtggggacagagggcacagcatggcagatgcaggggcactgccccagaccagctcttgtgccgtggccacacgcagccctgtctgtgtttggtggggagagtccctgggtgtggctggcagtgccctctgagggcaggaaggaaaggatgtctgtacaggatagagtgggggcccatcctgagagggcctcaccacagagacttgattctgtccaaaataaagacacctgagatgtggtggcctcacgtcttcccagtgtggagctgtggtggcgtctgaagtgaccgctttgcacttggcattttgatgtatggggagagcttttagagcctgcagttcttttttttaatgtctctgcttatttttttccagacttctttaatgtttagacctctttattgcgatctaatttacatgccataaaatgcactcatttaagtgtacggttaagtggtttttatatatttacagagttgcgcaactattgccataatttaatttccgaacattttcattgcctccaaaggaaccctgtgtttaagaactcactctttactctccccagcacccccgccctggcagccatgtctccagtgtctctgtgaatttgtcttttatagacatttcctaacagtggaacctacgacatgtgatctttggcgtccgaattcttcggctgagtttctctgtgtcgtagcctgtggagtgcctccttccttcctgtggcagagccttgtcctgctgtgtaaatgcaccacacgccacgttttgtccatccttttcatcagctgatgtacatctgggttgtttccacctttcactgttaggttaatgctgccatgaacatcgtgtacacgtttttgagtggatgttgggtgtaggcctagtagaaatgctgggtcatacggtaactccacgtttaactttctaagaacctgccaaactttttccaaaatgattgcaccatttcaagttcctgcctgtagtgtgtgagggttctgcttctctgatcctcaccaacacttgcttttatctttttttttttggacgcggtttcactttg

SEQ ID NO: 20338 - DNA, 1034 bp, Homo sapiens
gagtgtctgttctgagaatgcctgtaagcctttgagttttgggaactttcatcctgtgacctggacctttcctcgaaagcgccctgccgggggctgaggacaccgagccccctcccagggtctggacagagtcctgtcccagggctgcccgactctgcttgggggttacacgcttgaagcagtgggtgtgtgatcggccacactctcacgtgaaatacgaaggggtttgtggctgtttccccttaacatgtacccacagtcacagagtgcccctcacttttacacagagcgtgggctggccaccgtctacttgctcctacctgctggctgggagctctcccaagtgctgtgcgcccctgccgtcggcctgtagaacccaagaccatggatgctgctgcctcccctggggccgatccctaagcactcgtggcagtttctgcccactttagccacgtcgttggtgtattctagtgtgcttgtttaaaaatgaagaacattcgaacacaagactctaccctactgcttctaaagtcagctttatcattaagtagcatttatgttgtctcagatatgaatacaaatgctatatttatgttgacttaaatggttgaaatactgttggtgaatttgtacatcctgtgagtgacagcagcattgtgagacatgctttcacggtcacccggttcctgctggccaggaggcatggccagcagcgcctgcccgtccagatgcaccaccaaatggaagaaccaaagctttgccacactcctgcccgagaggagaccagagtgagtagtatccgctttagagatggttgggtcatgggaggaagctgtcctggcccttaacctttagggagtgggttcagccctctggccacacccactcaggtcctgggacccaccagaggctgtgtgtgtgatgtcagagctggcctgctcttttggattcttccagagggtctctgtgtcccccttaccagcctcaggtttccttcagaggctgtgccgcacgcccaaggctgagaacaaagg

SEQ ID NO: 20339 - DNA, 1245 bp, Homo sapiens
gtcctacagttgttgcttatggtgttttgcctaagaccatttctaggtgcatttttctgggagataatgtatctgatgacagttgcatgtgcagataaccggcctctcatgtatccatcccgggagtgccttttctcagactgtgtgtagtgttagtgaacttgattggtgggtgtgaagtgtacagacggcgtgtgcgtggagcgggtcgtgtgcagagccccgaacgagaccctggcgtgtgcgtggagcgggtcgtgtgcagagccccgaacgagaccctggcgtgtgcgtggagcgggtcgtgtgcagagccctgaatgaggccttggtgtgtgggtgcttcagcgtgagggccacctggggaggagtgcttatctggggaggctgagctgggttggaggcttgggtgctccccctggctccgtgggtctccattgctggcttcatagctgtgttccgttttctttgttcagcagttgatctcaagtatttattccaaagcacttgaaatacatgaacctaataaatcgaacaaatacagtaaaactttagcttcttggaacatccccatatacttacaccacgtcctaaaatcctctcatgtctatgtaaaaaatcgggtagcctgggtaacgtgggatgccatctctacaaaaaatttaaaaagtagctgggtgtgatggtggcatgcttgtagtctcagctacttaggaggctgaggagggaggatcgcttgagcctgggaggtggaaggtgcagtgagccaagattgtggcactgcactccagcctgggagacagagccagaccctgtctcaaaaaaataagaaataaatgaaatcacacttgtgtgatgtcagattacccattaacccacttttgaatggagctggaaggataatccacacctacctcggatttctctgcgtggctgttttgcataggagccctgcatgggttattcttgaagtcagcactgtaggagccgtggccggctttgcattttcatcctggttcaccccagacctgctctgggcagagccaggcatcccctgggacgctctgcctttgcgtgtccacgacagtacaattccaggcactgcctggcatctgcgtctctccctcccctgaaccaggggcgcctctccctcccctgaaccaggggctcctcttcctccctgcctggcaggagctgcgtttccttgagtctcctcagactcggcagacccctgggtggtatcat

SEQ ID NO: 20340 - DNA, 1071 bp, Homo sapiens
ttaagttttttgtatttttagtagagacagggtttcactgtgttggccaggctgttctcgaactcctgatctcgtgatccacccaccttggcctcccaaagtgctgggattacaggcgtgagccactgcgcccggctgtagttatataacttttagttattagaagatcacattcatatgtcttgatcagtttaatgatttctaagatatcattaacaaaagccattatgatgtattgaaataggattgatcttaaaacgttcgtgctaatgtaacgtgagttccctttaattttaaaccagtatttttctcttcttatttaggctatagtttgttataaagagtatagagaggaaaatggagtgcttttctgttcatagagtttttctgaaattaaagtcaaaattttcagtttcaagtagtgaaagcagtgttaacagaaagtttcccagatactaatcctgggtcttttaagatctttagataattagttgctttccaaaatagcttttaattctgaactcattttagacttaaagaagaattgcaaaaccagtggagttcttctagaccctccacagcattctccgatgtgaacatctcacatttggaagccaggaagtgcagtgtgggataaaggccactaacaggctggtctgcccgggaccccgcatggcatctggtggtcctgtgccctcagcctcctctgctctgtgagctcctcagtctttatctttcttgatcttggggcacttaaaaaataggttttattgagatgaattcacttgccataaaattcacccctttagggtccacagttcagtggtttttagtgtattctcagacttgaggagacctcaccccagacagaagccatgtgcaccaggtcccgtcacccgctccaagcctggcactgccagcctgctttccgcccctgtggatttgaccctgagacctccagagacgactggccagatgttctgtaggacgcccctctctctgatgctttctcgtgtgttactggaaagagtgatgtgaggtgacctgccctcctccgtgtgctgttgggcc

SEQ ID NO: 20341 - DNA, 1033 bp, Homo sapiens
cgtgctgaggccagagcccggggtgacgaccgtgctgggtgggccctggggcgcactccgccatcactctgtgttccgggttcccagatgctgcttcctgggaggagcagcccagtcgcatagggagccacggggccctgcagctgagctgaccagcctccctgtgtgtgtggctggatttgagccacgttacctttatcggggcagctcaggttggggattgattgacagggaaaggaaaggcctttacacttggtctaaatttaggcaagcagccagaaaatgggatattcccgtgggtgcgggagtcttgcacctcagtcctgagcctgagcagtgtgagtctcagagcatcctgcacagtgaccagcatgcggacggcagcgggagcctcgtggaagaagcggcacagattttgaagagacacagactttgaaagaaatgcaagacgcgcaggtgcggagcgtctcccagccccgcacggccatgtcctgctgaggttggatagaaacatttgagaagaaggtcgagaacttggcaaggcaaagcaaacgggagtggacgtgtcgcatagcacacagggaagcagcctaaaaaccctcggatttggaggaggctgtttctaatacacagatttggaatgaagttgtaagaaatgcgttacagtggaggccgctgggtaacagcagcagggatggggggtggttggggagcggcctgggggacacagagggggctgggggcagagacgagggaccagcttctctgtccaggttcgtcttggctggagttggagactctggtcctgagtggtctctgccttctccctactgagcccaggggctcttgagcaggttgtgactaacccatgggcagcttccacgttcagggcctgtccgacattccagccctatgaccctgctcctaggcgagtgctgtccaggcccccgacaccatcaggcccttgtggtggcctgtccacacccaggccccccacttcccccctgcacaggtgaggaagttgaggctcagg

SEQ ID NO: 20342 - DNA, 1023 bp, Homo sapiens
gtttgtcatttgtattttcttaggaaattatttatgttgtttccagaatttcacatcctggaacctgagagtggtatcagtaacaccatgtaggctgcggggctggagctggggctccactgggaggctgtcgtggcggggtgggaggaggtgccgcctctcccatgtcagagcctcggcggctgctggtcctcgatgcttctggggtcagctgtcaccacccccaagaaccggctgggccagctgcccccagtcaacgtcttgcctgcccgggactgctgagtgaggcctgggctctggtccaggctttgtagaccgtgcaggcggctgcatccccgacctgacccaggcctgctcgctctggtgtgcaccgacctgccagctttgtggcactttgtggcatggggctcaggccgatggaggtcagtggctgtaacactgttgagacctgaagaccgtttacggtgtatgttttcgggaaaggtctcttaccacgtaccgaagtggaaatgtttgagttgtttgaaaaagatgaaatacttgtgagtggtttcaatgatttagcgtggtgttgcctgggtagaccgtcaggaagtcagtgtgacgtggaagtcctcggcgagccatgtctgtggtgtgtggcttgctcaccacctgcctcagggctcggggttcatgagtgtaaatgtctgtggatgtgattattgaacttggtgaaatgcctttgttcattcaaattcttctttttcccccatttccactttcttattagggcactttccctcatggtattgatattttgaccacagctgactattttgccgtcggtaacagatccaactgtttcctggttataaggtaagtctttaatgtatatcacaaaaatagaatactctaaaatcagattggatgtcagaaatcagctaccaccattttcttttttcatcctgtaatgtccactcaatggaatgtagtttttgtgtgaaaaattaaaaatggaattgggaacagtgactgaaactt

SEQ ID NO: 20343 - DNA, 1008 bp, Homo sapiens
tcttctttggcttagggtagttgagattcagattgtgtgtgttgttgctgagtattcgattgtgtggatcaaccacggtttgttttccccgtggatgatgtcagggtggtttccagatttcgccgttacacatgaagctgtgtgcacgtttgtgtaaagcccgtgtgtgcacagatgctcttttcttttgggtaactgctcaggagggaatggctggatcacgtggtagatttgaagaaatgggcaaactggttttgaaagtaactgtgctgaattcccacccacaggcagtgagttctcgttcttccgcgtctcaccacctctccatgctgtcttttccagtgtgtttattgccggctttcctgagtacacgcagccaatgatagaccacctggttaccatgaagatcagccactgggatgggtaggttttctgtttttgtttttctaagagctttttttccccccaaaggagagattcagttgagcttataagccttgagtgtattttctcactgtggatgtcgtattttaaaataacttctgagaagtaatatgaattccagtcttcatgccggatgtgttgagtcatggtctgtctccagttccacttctggagcgcctggtccagtgtgtccgacgtggcggtgtacccgtgcaaatgtccacgctggcgtgttgtggagtgccgctgccgtccgagggggcgcgggcgtagcttggaggcggactctgcgttgtctccctcagcagtgcttcccgctgactctgctccatgtggctccacaggtggtttctgcgctgtctcctgggagcccagcagttcttagtggccgttttcatcattacagtagcagcttcagggtttccttgcatttcataggcagttaaatgtgtctcagaaaggaaaagtgaagtgcggtctggagcataaacagcgcgttagtgctgtgaccgccgccctgaggaggtcagagggtcccctcctaggacagtgccgtgctgtggc

SEQ ID NO: 20344 - DNA, 1039 bp, Homo sapiens
gagggtttccctctgtgcctttgcagcccaggcagcctgtctgctctgacagattgctttgctttttctagaatttgctaccgagggtgtcacacagtaggaagcctttgggtgtggtttcttccccgacgtgtctttgagatacctgtgttgctgtgtgttccgtggtgtgcatgtacggcgccgtgttatccactcaccagcccaggctcatctgggtttccagcctttggctattgtagggaagctgctgtgcacatctagacgtacaagtcttggtacgtttcacgtttcctggctgactaccaggagcagcatcgcagggtgtggggcacatgtgtgacttctcagcagccgagccaacttcccagaccctgctgctgcacgtccccatccacaagtgaccccttggtgtggtcggctctgaacgtgggccctctgggtgagtagaggcctctcgctgctgctggagtctgcctctccccagggctcctggtgctgagcctctttccctgtgctgacgaagcattcctgggtctttcgtgaagttttttgctcattaaaaagttcagactttttgctcattaaaaattttatcgtctgtcttattgagctgttagaactcttcatatattccagatgccagctctttgtcacacacaggatctgccagtgctttctccagctctgtggttcacttttcttttctcttagtgactttttttttttggagaagcagtctcactctgtcgcccaggctggagtgcagtggcagcatgtcggctcactgcaagctcacctcccacgttcaagcgactctcctgtctcagcctcccgggtagctgggactacaggtgccccccatcatgcccacctaatttttgtatttttaggagagacggggtttcaccatgttggccaggctggtcttgcactcctgacctgaagcgatccgcccgcctcggccttccacagtgctgggattacaggctgagccaccgcgcccagcctcctagtggctttttactgggacttgtgt

SEQ ID NO: 20345 - DNA, 1028 bp, Homo sapiens
tgaatattttgccctccccagggcagcgcgcctgcccttgtgcaccagggtcccgctgtcagcgccagggctggggcaggtgtcccagatgggcagagcagcccggagctccgcctagcttcgctcatggtagaaccgcagtgcactgcttctctaggctggatagggggctctttctggcatctgagattagtttctataaagtaagagctgagcgctgcttggaattagttctgtgatgggataccagtcaggactagaatgtccagtaaaaattaaaaatcagcatcaccccagctaggatgggagacctctggaagatggctgtaccacgttttttcctttcttttcataaaaggttgctcatgctcagtaacacattcaactagttctcattttaatgctttttggagcctgaggttacattggcaagcatatttcatggtgttttatacgtcaagaggttcttctaattctgatgttttcattccttttcaggggtctgggaggacagctcatgagacaagcaggtaagtctgaaggcctttgcagccctctgcagccctttgccgcagccatcgttgagggaggtgtgctcgtggcgtgcagggcggcccattagcccccagggtgaagggctgggtgtgtttcttctgtggaggcggcatctgtgatgtgcttggtttgtccagtggttcctacgagggagagattgagagattgagattgagagagagaaagaggaagttgtgagctgggaggggttgcacccaggagccactggttctggaaatttctcaggaagcagaggcagctggggcagtggggccagtgcttgcctgtggacccagtggacattgcagatccctccgagcacggccccagcgtggacagagcagccctggtcgtgccctgtggactgagcagcgcagggaccaagagccgttttgggcgagcacaggaagctcaggcgggggcaagaggaaagctgagcagaggcgaagctccttacacacccgagtccaggc

SEQ ID NO: 20346 - DNA, 1071 bp, Homo sapiens
cttgtctccgtcttagtctcagtggctcttgcatttcatgctttagaatcaaaggaaagaaacaggaactctgtttagtgaagcagcgatgaaggaggggtttgtcagtcagggtggactgcgttttgctcttgaaacaatccccaagtttcagtgtcttaaaaccacaggtgtttttttatcctgctcacatgtggatcaccgagggcaggggccgggaggaagggggtcatctggctcacagccttgcaccagaggcgtcacgagaatcaggaaaagttctcctctcatgccgaagacgggagggaaaccagagggactggtgagccttgagtcggccacaggtgtgtggaggatcgtgacttagcaagccggggacacgctgttaatggacttcctgctgtgggggtgagggctccgtgctccatctctgatgccctgtacacacctgccacctcccctgtcccctcagcagagacatggccggtgctgtcgtgcctttcgcttttacctgtatcttaaatcacacaggagttcattcggatttacctgtacagataccctgttctctttcttgttccgtgggaattcactgggatttacccacacagccacctgctgcttctccttcttgttctgtcctgcatttctcaccttctaagaggaccattttctctttgcctggagaacactctagtgttttccatagtgtgtgtctgctggtggcaccctctcgtttgtttataccaaaatggctttttccactttttttttttgagacggagtctcattcactcttgttgctcaggctggagtcacagtggcgcgatctcggctcactgcagcctccatctcccaggttcaagtgtttctcccgcctcagcctcccgagtagctgggattacaggcatgcgccaccgtggcaggctaatttttgtatttttagtggagatggggttccaccatgtgggccaggctggtcttgaactcctgacctcaggtgatccacccacctcggcctcccaaaggtgctgtttttttttttttccccactttgattcttaaaggtta

SEQ ID NO: 20347 - DNA, 1031 bp, Homo sapiens
tattcagtttggacttttttttttcttttcttttcttttttttttttttgagttggagtcttgctctgtcaccaggctggagtgcggtggcacaatctcagctcactgcaacctccgcctcccgggattaagcgattttcctgcttcagcctcctgagtagctgggactacaggcatgcgccaccacacccagctaatttttgtattttttgtagagatggggtttcaccacgttggccaggctggtctcgatctcttgaccttgtgatctgctcaccttggcctcccaaagtgctgggattacaggaacattttctttgatttaaatttcattgtcacaaattctttcaggtgtgccttatctgccgttaaacgcatccttgaatttttttatttttcagaacttattttttatagttttcatttttttcacatcctggaacatattaagcatggtttaaaatctttgtttaatgtcatcatctggagcctctgtggctgtttctgaaggacggtatatcatacatgaaaagcatctccaccaagctgcaggaacaagacatgacagaaatgctttgaggtctgcaatgttctcctctcccagagagacttgatgttggctcttgacgggaggcgggtgcttgctgtcggggtcacctccattgggttttgggacgtaggaggggtccgtgctgggctggcccacgttttacacctatttctaggtgtggtcctctgggttcagagcctgtggtgagggctctaccgcttctccctttggtcatcctggactcccgttctcctgctagctggagatgctcctggatgcactgttgggggtttctggttcttgtggcgccccctggagtcagccgtgagccggggagagttggcccccgccgctctgtccctctcaggtcttcgtgagctctctggtaactgcaggcacttcctgtgtgttttcattttgtctggcttttaaaaatgtcttagtggagggttggtctgcgttatctagtctgttagttttt

SEQ ID NO: 20348 - DNA, 1027 bp, Homo sapiens
gtgagccgctgcacctggctgggatttacattgtaaaaattattttgttggccgggtgcggtggctcacgcctgtaatcccagcactttgggaggccgaggcgggtggatcacgaggtcagcagttcaagaccagcccggcgaacatggtgaaaccccgtctctactaaaaatacaaaaattagccgggcctggtggcgggtgcctgtaatcccagctactcaggaggctgaggcagaattgcttgaacccgggaggcggaggttgcagtgagccgagattgtgccgctgcactccagcctgggtgacagagcgagacaccatctaaaaaaaaaactgtaaacatgaaacgtcttaggctcaaacgtatgtgaggatcacatttttataacgaccttgacccctagaccaccccaaggagaatgttcccaccattctgagcaaacattcctttttaactctgaatttcttcatccctgtcatattttaatttacccaatatttggaccatgatgttcttgtgtaacttttcgtttttcctggagtttttattgactgtgtttcttattgacaacagaataatgaaactttacatcctcttttatgcagcttttttattttaccatctatcgtgtggagccttctgttttcctgtgagacgccctccagaccccagagtagttcctgagcgctgccttccgggaacttcccctcagctcaccttttgagttggagactgtttccaggatcctgtgttttccctttcttgtttttcacttgtgtttttctggaacccgtcctaagttcttaaaaagagtgtgtgtaagggaaactcagcgtccttatgagtttaaaaacatctgtgttctgccctcccattgtgttgatagtttggctgatagaattctagatccagagtctttgggcggccactgttaccagtgataagtctaatgcgattctgggtctggtttccttatagctggcctatcttttccatggtagtcaacttgagccaccataacaac

SEQ ID NO: 20349 - DNA, 1034 bp, Homo sapiens
actgtggctgtctcctgcctgtctgcgtggacactttcagctgctttaatccatcctgacctgcaaaaatccagacctggtcaaaaaatgaagttggggcaagtgactttccaaagcatttagcataagcttcctttaaataggaattctgcttatccatttaaaatagattttgactttgcacagtttgatttccatttgggctgatatctttctagattgtcctctgtgtatatatagactcctccatagatgtaggcacatctacatatttacgtggtggagcgccctgctatgcagactgtttccaacgtgctttttttaacttaacagcttatggtgaatattgccccacacagcttcgttgtcatttcgtcacttttctatttacatcatcatcgtctttgttgctgcaaagctctcccctaaacctagtaagattttcccttttgaagatttggtttctggcatcaggagcacattgtgtggcatgaaacacacacgtggaggctctcattatgctgctttgtgcatgcaccgaggccattcagacgtagctatttcttatcctattttatcggggcagggggatgacccctctgtaagcaccgtctgcagcgcggttcccaatgagaaaccagctcacctgccgatttcaactcactggaactctcaggaaagtaattttccagataaaagattgctattttattttattattttttaaaatgagatggggggtgggggagtctcattgtgttgcccaggctggtcttgaacttctggcctcaagaaatccccccacctcggcctcccaaagcactgggattgcaggcaggatccaccgcacctggccctgagttttgctaatggataaactactccgttcaatgggacactctttgaggacaaagggccgtgtcttgtttgttttcggcattcttagaataatgccttccctacagtatagaaaacatgtttgtgaattgaagctccacacgtttaaaccagccatcttcagtgttcatctccac

SEQ ID NO: 20350 - DNA, 1046 bp, Homo sapiens
ttctcctgcctcagcctcccgagtagctagggctacaggagtgtgcctccatgcctggctaatttttttttttttgtatttttagtagagatggggtttcgctgtattgaccaggctggtctcaaactcctgacctcaagtgatctgcccacttcagcctcccaaaatgccaggattacaggggtgagccaccgtgcccagcctggcttggagactgttgactgtatcccaggcatgggaacgaacacagggaagggagagggtatttttacggactgaccttttaagagttatgataatcctggaacatcagagaggccggtgctctacccctgagattggggtcgggggagggctactgaggggccccagcaccccacactgagctggtgggggcagagctggaggacgtggacggtctcctgactttggctgggtggtctgtgctgactcagtttctggtggaccctggcactgggtcatggaggaggaaatgtcagggttcctgaaggatgtgtagaagtttgccaggtgtgagccacagggcacggaggcagagaggtggctagagggttgggagaggacagcaaagtgtggggctggcgtggtgggcttggcaaggccggtggggacaggactagagagaggtgggggccagggagggaagtttgcatgttcgtccgtgtgtcattttcttgcctctctccccatcagctcgtgaagcctccctgtccgctggctagtccagggcccgggagtaacggggacttacaagtgtttgcggaatgcccttggcaacatcagccctgacctgtgaccaaccttgctcttcaccagattctagggaaggggatggtggagagaggaccgaggctgctgcctcaccctcctgggaggttttaagccttccggaagcacaggacttcagtgtcttgggcatcaggctctgaaaatagaggaaaacaccaagcaaagtggtttttcctattctcttacagttactcaacacagcacactcctgggacctctggtcaccaagatgtgtg

SEQ ID NO: 20351 - DNA, 1050 bp, Homo sapiens
gagggtccaggcctgcctctcggggtgactgagggtctgggcccacctcaccgggtgactgtaagggtctgggcctgccttggggggtgactgagggtccaggcctgcctcgcaaggtgactgagggtctggactgtctcgcggggtgatggagggtccgggcctgcctcggggtgactgtgagggtccgatggaagacatctgtagtgtcctgtgccatcaccagccccagaacaagctcgtgggacccgtgtccatcaggacaggcagtggtggcggtgctgatgcttctgtccctccttctgtgtgttcctgggacccttcctttctctacattagctggagggtggagggagtggtgattccctgaacctgggggccctggcttccaactcccttcccctggcccgggaaccacacgaagtgtgtcctggcccatcactgacccctggagcctccgaaatgctcagatggaacaaaccagtaggtaggggttgtggaggggatattgctttttggggcctgaacccctgcatgtgtgcagttcataggagcaaggcaggtagtccaggcagaggctgcccactctactggccttgccccccttccagccctgccctgctgccccggtattttccttccccagcaccgtgagcactgcttggaaagcgttggtctagggcattgcagtttttttttttttaaattggaaaaaccggcagtgtagaagtatggatccctgaaacaccacacaccacccatgccccctgcctttcgtgtgtgatctcctctgcctgaacccgcctccctccttccatggggaagcacctgttcatcctgcaaaagctcacacatggtaaagccatgcctgacagccctccccatgataattacagttatcactattaacgaccatttgcaggcaattgggaatttgctatgtaaaagcaccttatctaccctgcctcattaattctcatggcatcccttaaagagacagatcagaaaaccaagggtgagagcctcatccgaggtctcgcatctgggaag

SEQ ID NO: 20352 - DNA, 1043 bp, Homo sapiens
cacagcctttactccctgactgcgtttatattctgcctctcccgtgcctgttggtccttggggacggccctccggcaggttctggcctcaggaccccgcaccagccccggccgtgccagctgccctcccactggcctggcccagctctccagagaggcttcatgcagccagttccccagggaacaccgttgcccacacgttgctaatgttaaaacatgaatttattgcatctgtagcatcttaccttgagcacggcttctttcaatgcttttattttgcaattataggtttattttcttcctttcctctctcttgagctttttaaggtgttttctgtcactcagctggagactttaaatttcctatttatattaattatcaaattatttcatatatgagtcattcagctcagccctttttggctccttcttgcaactcttacttgtggatttattgggcagttcagcgcctactttcatgggcagactcaactggcgagattttaactggagggtgagagatgtcctggccacggggccctgttgctcacagtccctggatcagaggatggtgccggatgggcaggtgctgaggatgcacataccgccctcgggttagcaccgaaggttcttgtgtcagacgtgaggcttccttcctgggttctttctggctgcgctagtccagaagaccagcaaacccgagatggtctgaggtggacgatggagcctgaatggagagcctggggcgtgagccagggtctgggataccctgggacagagttagatgcccctgcagacgtggatgagcggctgaagactaagggagcaggtcacacgtggtgacagacaggagaggctgctgtgccatccaggggctggggaaggagcccccgtggagaggctccatttcggccacgtggctgctgcagacaaccgggagtcagcgtcggcacaaacacgggtgcctcgaaagagagcagtgccggcctggtgtctccgggcccagctgccactggcacaggcctccgaaggggcaggagcagg

SEQ ID NO: 20353 - DNA, 1045 bp, Homo sapiens
agacatatcatagagatggggtctgtaaatctctgggatccgaggcttggaaaggaacatcatggtggatgcagtttggtgagaactgttaaaataaatgcagctgccctgtgacatagtgattcagtgattctacttctcaggatctaccctaaagaaatgctggcacctgtgcacaggtgacaacttctgggacagcctttgtgacggtctgtggtggtgaaagatcgtacacagtctgaatgtttgttcgtggtgagacagctccgtagacttgtattttcataccttgggctactgcgcaacgttgaaaaggaattagaactttatataagaacatgaatgacaaggtgggcagatcacctgaggttaggagttcaagaccagcctgggcaacatggtgaaaccccatctctactaaacatgtaaaaattagccaggtgtggcaacacacgcttgtaatcctagctacttgggaggctgaggcaggagaatcacttgaacccgggaggtggaggttgccatgagctgagattgagccactgcactccaggctgggcgacagggcaagactctgtctcaaaaaaaaaaaaaaaaaaaagtgatgtctagtctaaaccccttcctgagtggagattctttgctccattggtccctgagtcctaggtggactgagacagagagcttcactgcataatgctttgcattcaggggcagctcagaaggtggaaattcttccctcttttgagctgaaatctgcctttgttgtccctctggagcctacaccttcccttttccatggggcaagagtttcattggtttacgttccctcttgtgccctcctcctctgggcacctccagggtttcctgttgtctatagggtaatacagcccatggcctcccgggtctgtggtgccggctccttgctcacgctctgccaggctcaccagccatcccctaaagtctgtgcagaactggactgtccgcctggatgttgcttgactttcacataagagttctttaaaaaaaaagtctttttttttaa

SEQ ID NO: 20354 - DNA, 1027 bp, Homo sapiens
tcagttgcgatctccttttctttgaggacgttgctcacagatatccgggcaggggacgcccagagcagggtactgcaggggtgttgagaaagacaggataccttcagcaggaatcattgctatgaacactgatgagtgctcaccttgtgcagatgctgctcccttgtttaaacctcagccaaatgatgttagagtactattcccatgttacaggtaagaaaactgctgcacagagaggttgagtgtttgtccaaagacacacagcaaggagggaactttagtcctagaaagtctgactcctttggccaatagtctttaaaaaatttttttttcatctttttattacccagacttcaaggagatggccaataccctttacatggtgctctgtagacagtggaaggaccatgtttaaagaatgaaagggtaaattggagaggtggggcacattggctttcccaagatttgaggcttaaagcagtagttttcaatgatgtatattttaggatgggttgcagtgaaaaggcatatactagaatgttcatagcagcactatttgtaatagccaaatccaccccccagggaaatcctacaatgtttatcagcagtagaatggacacataaactggggtgaaggcagacaatggagcaccccactgtggtgagaaggaacaatctgaccacacagcatacgtggatgaatcacacaaacacaatgtcgagtaaaaggaacgagacagaaaggagcatgtcctgcctgattccacgtctataaagtgccaaaagggccaaatgcacggacggtgttggaagtgggggtcgtggtttccgggaggtatgaggagggcttctgggagcgatgaggagggcttccgggaggcatgaggacggcttccgggagggatgaggagggcttccgggagggatgaggagggcttccgggaagcatgaggagggcttccgggagggatgtgggggggggggcttccgggagggatgagcagggcttctgggagggatgtggggg

SEQ ID NO: 20355 - DNA, 1084 bp, Homo sapiens
gagacagagtgagactcagttaaaaaaaaaagacttttggtggtggtggggaccatgcccaggattgggctctctccatactgatgaggattcttcttgttttgatgaccaacccccaagcagaagctttatttattaacatcacttcaaaaataacgtatcaaaggggcaccctaggccgggtactgtggcatcacacctgtaatgccagtgctttgagaggctgaggtgggaagattgcttgagcccaggacttcaagacaagcctgggcaacagagtgagaccccatctctattaaaaaataggccgggcatggtggctcacactggtaatcccagcactttgggaggccgaggcaggtggatcatgtgaggtcaggagttcgagaccagcctggccgacatggtgaaaccctgtctttactaaaaatacaaaattagccaggcgtggtggtgggcgcctgtaatcccagctactcaggaggctgaagcaggaggatcgcttgaacccaggaggcagaggctgcagtgagccgagatcatgccattgcactcctgcctgggtgacggagcaagactctctaaaaaataataaggtaaaaggagtacctgtggatgaaagcagcagctaacagctctgtgattcagctagacctagatattgtgcccattccttcccctcagtccattttctgtagcccctttaaaaaccaaaaaacaactttgaagtcactttgggtttaaaataaatagtggtaatttgtataatcaataaagagttcactctgctcttactgaggggacttgtctgaaagctggcttagcggtgtccaggccagagaacatcctgtgtggactcttaacaatgaaacaggagccgcaatggacaaggtgttctgatctccaaacccagctcagggattgaagctaactaccgccactccttcctctctcgaagaacaaagagccagtacccagggctctgcccacccccgagaaggggtgcctgatttcttatgtctagggtggctcctctgtgcagatcagacaggactgagagcagacaagctgagaccagcatgac

SEQ ID NO: 20356 - DNA, 1050 bp, Homo sapiens
ctgtagtcccagctactcaggaggctggggtgggaggattgctggagcctgggaggcagaagttgcagtaagctgtggtcatgccactgcactccagcctgggtgaccctgtctcaaaaaaataaaaaaataaataaataagttatctaacttaatggggatcttcagctgccttgaccttgctcacctgcgttgccatcttctggctactgtctttctctccctgtgcctcactgcttgacattccaattagaatattgtttctgtgaatgctgactgcaggcccaccagagaaatggccttggccatccatggataaacccagtctgcaatggcatattttttctcctcactttagtttttccctctactgataccactctgcaactgtcttcattcctagggcatgtaatttatcagtggaactcccagcagtatttcgggaaggaggtatttccttccttctcccttcccctcccctcccctcccctccccttcgacaatgtcttgctctgttgtccaggctggagtgcagtggtggcattatagctcactgtaacctcaaactcctgggctcaaatgatcgtcctccctcagcctcccaagtaactgtaactacaagcacacaccaccatgcctaactaatttgtttatttttttttagagatagggatcttactttgttgcccacactattctcaaactcctggcctcctcctagccatgcatggtgatggacgcctgtagtcccagctacttgggaggctgaggcaggagaattgcttgagcctgggaggttgaggctgcagtgagccatgatcatgccactgcactttgtcctgggtgacaaagcaatactctgtctcaaaaaaaaaaaaaagaaatgtgatcagattggatcatgtattcaaaactaatgagccttacgcattcccattggggtaacttacattcttctgttctgtgaaatactggctactgattttctaatgtctcatgtggcatcaaagcatgctgatgcagggtgaaagatggaaggcaggggaaggt

SEQ ID NO: 20357 - DNA, 1035 bp, Homo sapiens
aaggtctctgggacgcactaggtcctgagggaggttctctgggaaagcattagattctgggggaggttctctgggaacgcattgaggttctgagggaggttccctggaacacattagatcctgagggaatttctctgggaatgcattaggttctgagggaagttctctgggaatgcattgaggttctgaggaaggttctctgggaacgcattaggttctgagggagattctctgggaacacattaggttctgagggacattctctgggaacgcattgaggttctgagggaagttctctgggaacgcgttaggttctgagggaagttctctgggaacgtattaggtttttagggaggctctctggggttgcatttacgcatttaggtctgattgcacttcacccctccccttgtttttaatgcttctatcatgggtgagcacattcttagtttcaaacatgtttcttaaaccgtaacagtaagacaatgtttcaattagaaacttcacatggaactgtattattcactcacgtgattttatggactgcttctatgcttttcatgcccgattacaaagtacttcatattaaaatctcagaaaatgaacttgcccagtagcttctccatcatcaaatggaagtctccccatcagcccaccaccaaaggcaagttgccttgccgtcatttgccttgcaaagacccagtagtgcccttgctcttgcccagtgggcacgtgcccagcaggcacaccgaggtacagtggggacttctgcctctttgtccttgagagcaccctgtcttctacattcacagtttgcctccaggaagttactaagacacccctgaggggcaggaaaaaggattggttatttgcctattagagtcacaggtctttgaggaacccccctggatgactcttttcagccaaagccccatcttctcttaacccaaatttttcgttttaaaaggcttaaaagttactgggtccagggtttatttttatttatttatttttgagacggggtctcagtgtcag

SEQ ID NO: 20358 - DNA, 1030 bp, Homo sapiens
aggtggccagtggcatatttgaagagttacttttcagagcacactaacactttaatttcctttggatttttctgtccaagtctaaatttcctctcccttcatcctacagaatggtgtttttggttaactgccatgttatgacaagggaggttagagcaataaatcagaacgtttcccttctagattagtgatccctgtttttaattgtctacacttggctgctggaggattattttacggtattgttttgctccagacaccaccaaaagggaggctggctgggaggaccagctctgagaaacctgtaaccatgtactttgcagctagccctgcattcattctttcccagcaccacaagggcaggagccaagagagcagagcttccaggagcagttctgaaatgatgcaatcaaatgtgtctggtcccttgattaaatgattgtaatagaatggatactcacacttttatagtcctttgcacttttaaattcttttacatgctttatgttatcgtcacaattcctgcctcttgctttataggtgatgaaactgcagctcagagaggttaagtggttggcccagggttgcacagcttggaagtggaggagcttaaactggaagccaggtctcaatgtcagaaactagaattcctttcccagtgctattttgttgatggactcatgtctcattgaagagtagaggacatagaactgaatctcaggaatagaagtaaatgaacaaaactgatgggacatcttgaggaggctccatcccggagatgtatttataggattagatgcagttgatttaaagccgtcatagtattgactggcatggaagaaaacaaacagtttcttgtaactaattaaatgcagttctcaattgcattttgggagcagggactagggtggaaagaaggctctgggtgtagagcccatgcttctggcatgtcctccacccacacagggccacctctgccctgtgagcatgctttgcgcaggagagccatttgcagagccctgatgtctca

SEQ ID NO: 20359 - DNA, 1164 bp, Homo sapiens
tcactgtgtgaactcactatgtgaatatttgtacaggttttcactgtgtgaattcactatttgaatactgctgtgaatatctgtacaggttttcactgtgtgaatactgctgtgaatatctgtgcaggttttcactgtgtgaactcactatgtgaatatttgtacaggttttcactgtgtgaattcactatttgaatactgctgtgaatatctgtacaggttttcactgtgtgaatactgctgtgaatatctgtacaggttttcactgtgtgaactcactatgtgaatatttgtacaggttttcactgtgtgaattcactatttgaatactgctgtgaatatctgtacaggttttcactgtgtgaactcactatgtgaatatttgtacaggttttcactgtgtgaattcactatttgaatactgctgtgaatatctgtgcaggttttcactgtgtgaactatgtgaatatttgtacaggttttcactgtgtgaattcactatttgaatactgctgtgagtatctgtacaggttttcactgtgtgaactcactatgtgaatatttgtacaggttttcactgtgtgaattcactatttgaatactgctgtgaatatctgtacaggttttcgctgtgtgaactatgtgaatatttgtacaggttttcactgtgtgaattcactatttgaatactgctgtgaatatctgtacaggttttcgctgtgtgaactcactatatgaatatttgtacaggttttcactgtgtgaattcactatttgattactgctgtgagtatctgtacaggttttcactgtgtgaactcactatgtgaatatttgtacaggttttcactgtgtgaattcactatttgaatactgctgtgaatatctgtacaggttttcgctgtgtgaactatgtgaatatttgtacaggttttcactgtgtgaattcactatttgaatactgctgtgaatatctgtacaggttttcactgtgtgaactcactatgtgaatatttgtacaggttttcactgtgtgaattcactatttgaatactgctgtgaatatctgtacaggttttcactgtgtgaactcactatgtgaatatttgtacaggttttcactgtgtgaattcactatttgaatactgctgtgaatatctgtac

SEQ ID NO: 20360 - DNA, 1287 bp, Homo sapiens
gttgtttttcatttttatctatcttatggttgaaaacggtatccggttcctttaattttcattttccttgtagctagtaagattagtgttttgttttgtttttttgagacggagtcttgctgtgttgcccaggctggagtgcagtggcgtggtcatagctcactgcaacctggaactcctgggctcaaaccatcctcctgcctccacctcctgagtagccaggaatacaggcaaataccaccatgcctggctgatttttaacatttttctgtagaggtgggatcttcttatgttgcccaggttggtcttcaactcctgggctcaagtgatcctcctgcctcatcctcccaaagtgctgggattacaagcgtgagccactgtacctagccccagttgtcttcttcctctaaacactcatgagtttctcatactctaagaaattattctcctttattcctttctttgagtagtctctacaacttggtctctgcattctttccttgtggaattcttgttacgtgaacgttggatcttctagatctgctgccatgtctcttaattttcctttcatgctttctgtctctttgtccttttgaactgctttctgaaagaattcctcaacccagtcttcctattttaatttattcttcacttgcatccattgtgctatttggcccagctgttgaatttttattttaaaaatccagctttttaatttccagcatatctagctgattcttttctcatgggcataatattctcatgtctctcccacggaatagaaattatgtgtttgttaaagcactgggttgcctgttccatttctctgtcctacagtgtacaatcttcagtgcctgttccattcctctgtcctccagtgtaagatcttcagtgcgtgttccattcctctgtcctccagtgtaagatcttcagtgcctgttccatttctctgtcctcaagtgtaagctcttcagtgcctgttccattcctctgtcctccactgtaagatcttcagtgcctgttccattcctctgtcctccagtgtaagatcttcagtgcctgttccattcctctgtcctccagtgtaagatcttcagtgcctgttccattcctctgtcctccagtgtaagatcttcagtgcctgttccattcctctgtcctccagtgtaagatcttcattgcctgttccattcctctgtcctccagtgtaagatcttcggtgcctgttccattcctctgtcctccagtgtaagatcttcggtgcctgttccattcctctgtcctcca

SEQ ID NO: 20361 - DNA, 1101 bp, Homo sapiens
ggctgttctgggagagctgggggtgaggcaccccgagatgtgtcagcagtagtaggctggggggaaatggtctggtccccgcccccagacagcttttcaggagcggaatggcagagctctaagggcttggagcccctcagccgtaattgcttcccagccccaccacattcaggctgggacaccctcagcaaatcgtttctgcgcctcagtgtccttatctctagagcaggaatactagtcctcaaaaggtgattgtgaatagaagagatcttacctgtgtaccacctagcacagtgtctggcatggagtaggtgcttaataaacctaagaagcgggctgtggcaagcactagttaaccatccatgatagagtaccggagtattttccagctagtaaccgccctgggacttactacttcaaactgtgcgtacttaatgcgcctggaaggcaggtgtttagggccaaacatctgctcaactaagccaataatgcaataaaattaaatttacagcgtcaggagggactatattttgggaccctgggagagcctcctgagccagaaagaagggcggtaacccccagggaggtccccttcgcagcgtaaccctccctgggagtcggtctcagccactgtgagatgagatggattgcctccacaagtgggttacatagtgctgagcccttggcctgctgccgctcccataaatggtgggaggggtaagatggtccttagtctcctggagtcagtgttttctctgctggtgtctggcctgtgaaaatggggaatatgagctcttgggggcatgacagactgaggaaggagtagcatctctcactcctgggaaaggggagatgactcaggaatgaggaatagggagcagtgtttgcaccctcgttttagtttctgggccaaaggaaacatacctgataaagacctacatcctttgatgtttctgagctgggggaggcaaagaatagtgacaagattctggtcttgccaaccatgaaaaggtttggggaaaccaacatttactgagcacctaattagactctgtaactggattcttactgtagctctatctcatttatccatcatagcgt

SEQ ID NO: 20362 - DNA, 1049 bp, Homo sapiens
atagagactcagtttttactttattcctttagtatataatatttgaatttttctaccacatacgtgtaatgaatgtataacctgttccaaaaaataaccccctttcctatttcagtgtaagctggagctacagggcgtcaagggtggggtggaccatgcagcagcttttggaagaattgccttctcttgcccccagaaagaggtaacgcttgataccagatcgtttgagctttctgactagctagttcaacccagctaagaactttgtccttcccttcttgaggtcctttttgattgtggctttagtatcaagttcagcagttgtttcaagagcagctgagataataaattcaaacaaatggcgccttggttctttatggtatctgatactcctctaggactgacgagggccgtgtcctgagtagtgtgtgacccctggctcacgttgcctctgttttcctcaagttgccagacttagaagacttgatgaaaagggagaaccagaagattctgactcccctggtgagcctggacaccccagggaaagcaacagtacaggtggtcattctggccgaccctgtaagtatttctcaggcagggggcaggctggaccaggggtttcttcaaggatgtctttggcaggtgtcttttctctttattggtgtaggacggacatgaaatttgctttgtcggggatgaagcatttcgagaactttctaagatggatccagagggaagcaaattgttggatgatgtgagtcccatttctacatttatgtcaccatgggcctgagagggatggcattaagtgtgtgtgggaggagactaagcaacagggtccaggttcttaatgtcagaaccacgtcctttcgctgttgggttgacctcagccaaggaccgatgtcttcactgccacctgtgtagactgcttgtctagacttagcatttgtgccttaccacaacctcaggctgccctggaaccactgctggtggatctgtgcttattctgctctccacatggagatgcctctatccgaccccctcagctc

SEQ ID NO: 20363 - DNA, 1050 bp, Homo sapiens
cgaactcctgacctcaggtgatcctcccgcctcggcctcccaaagtgctgggattacaggcctgagccaccacgcccgtccatctcttaagcttagtaccgtgacaagttggaacagtccaaggcctattaggaatttcatgcttgttgattgatagtcaaggaaataacaggtcagttggagaactgtctttaggattctgttccttgctttacagaaaaggtgaacaaatctttccttcaggtagatgctggatagtctttggagcttgtagtagggtcccatgagcactgcccacagctgctttctgtaccatctgaggtcatctcatccttaagagaacttttaggaccagacaggaatgctcatctctctgtgcccagtagttctctgggggtggcctgaggctgacttgtctgtagtcactgagttcatttacttttattttctaggccttatgatgggaaatggagtaaaacaatggtgggatttgggcctgaggatgatcattttgtcgcagaactgacttacaattatggcgtcggagactacaagcttggcaatgactttatggtaaataccgtttttttctagcagagttttggctgggggtaggtggctggttgtaaatttgagtagagtgccaagggtgtgtgtgagtgaagagataacatttgagcagagactcaaaagaggtcagggagttagccacgtggatatctgggggatgcgcgttccaggcagagaatattctggcaagagccgtcaggtaacatctggcgtgttcgaggaggtgtaaggaagccagtgtggctggaatagagaacgagaggggagcgtggtaagagatggggtcggcagtgccatggggtaagactgcagggggcctcctaggccgtaagtcaccgagtgaaatgagccattggcggactttgagcaaagggaaaacaaggctggctgcagtctgggggtggactataggatgcgttttggaaagtttactttggctgcagagtgggtaatggatttacaagactggaggcagagagg

SEQ ID NO: 20364 - DNA, 1044 bp, Homo sapiens
aataatagccaatacttatagaatacttacaatatcaatataccaggtactctgctaataagtgttttacactggccgggcatggtggttcacacctgttatctcagcactttgggaggccgaggtgggcggatcacctgaggtcgggagttcgagaccatcctggccaacatggggaaaccccgtttctactaaaaattatctgggtgtggtggtgtgtacctgtaaccccagctacttgggaggctgaggcaggagaatcgcttgaacccgggaggtggagcttgcagtgagccgagatcgcgccactgcactccagcctgggcagcagagggagactgcgtctaaaaaaaaaaaaaaaatgtgtatttcagagaacctgcttcaagggctgggggaacagggcgtgtgtgaagggggagaaagggaaatggtggctgtggtctcagccttctcccccaggagcagagggaggtgggtggtgcagaaagctgcaggtacaggacttccccgccctggttaagacagtccccatcgcaggtgctgtgaggaccccagaagcgtccacggcctggcaggaagagcagcagcttctgcaacaggtggatcagggtcctgtccccagtgtaaccactgcctggctgggtgacccccatccctactgtaaccactgcctggctgggtgacctgggggtcaccttgaccatctgttagggggatcctgatgctgcccgccccatctgtgataaggattagccagtgccatctgtgccgtgcctagcacagggcagacggccgcagaagccagttccgtttcccgcccctggttcacctttggagggatgtgcactcgtcatggctgtaggccaagctcgtcaggaccagctgaggggaggcagcctggcacagcagacatgggtgctttcccccgtgcaggggccgaacacgagtggcttccttgggcccaagttggtttctgcttatgcagacagtcacgcggcccaacacggcccgtcccggcacacctcgtcttaggaggagccg

SEQ ID NO: 20365 - DNA, 1132 bp, Homo sapiens
tttgtcatcccatctcacccccacggcctttcagttctgattttcatctgatgttaacgagctaaataggctgccgttaaagaaaacgtaactagacatagatatctcgctgtcatcccacccacattcctgcctcagcagcaactcacacggactcttaacgtacacgccactcacatgcactcgtaacgtgcacaccactcacagactcgtaacgtgcacgccactcacagactcgtaacgtgcacgccactcacagactcgtaacgtgcacgccactcacacggactcgtaacgtgcacgccactcacagactcgtaacatgcacgccagtcacagactcgtaacgtgcacgccagtcacagactcgtaacgtgcacgccactcacacggactcgtaacgtgcacgccactcacacggactcgtaacgtgcacgccactcacagggactcgtaacgtgcacgccactcacacggactcttaacgtgcacgccactcacagactcgtaacgtacacgccactcacagactcgtaacgtacacgccactcacacagactcgtaacgtacacgccactcacacggactcttaacgtgcacggcactcacagggactcttaacgtacacgccactcacactgactcgtaaggtgcccgccgctcgcactggctcgtaaggtgcccgccgctcacacggactcgtcacatgcacacggcactgtgcgctcggcagtttttactaaacagtgtggcgcaaaaatttgccgtgtcgctatggtctttgtaaggaccattttcatgatcacttaatattttgcctgctggtgcgtcctcaccagctctttctgtcctagaacctgcttttccttccattgctcctcccagctcccagcaatctttgggtaattcctcctggctgcctcagatcacgttgccatccagatgcagagaaggctgggtcacagccctgcccgctcctctctgcctcccagggtcctggaccccttcagcttccttgccccagcccccacctgcttcaaaactccgtgtctcgttggcagtggaaaagtcaccagactaaaccgtgggacagtctcggcgcacctggctttgagatggttttaaatacttg

SEQ ID NO: 20366 - DNA, 1152 bp, Homo sapiens
tgcggggccttggccggcatgcagggataagccagggccacaggattctagctcccttttctcactgctgcctccgttggcacaggacctgagggattagggtggcagggccgttcctgagactggcgcccctaattgagctacagcgtgctttttccagctttttccactctccatttcaagtctctggttagatcaggagaaagtctcgctgtggcgccatctttaaaccactggaaaacttgctaatctcccttccatagagaaagccgacctccgctttccgcaggcaacgcgagacagatcacttgtaataatggcttgttctttgttcttttcattttgacacttagcctctatttatggcgagtggtgctggttctccacttacaatagcaatataaagtttcctttcaaaataattttttgaaggagtctattcaaagcaaaataagtaaataagcatcggagtgaggagggcgcaaattgtaaatgatacatgtggacgcctgagcttggaaactgggtgctgggagcagccatctggatttcacatctggcttcatcatagcaagcctatgaggcaagcactggtttctcccagtgtgcagcggaagtagcttctcaaagaggtgaagggatgttcccagcctggctgactttgccaccctgctctttccacctgccctttcttgtggccggcggacacagtgacctcagattcattctgtagcccctcagcccctctgcttcccgtcccccgctcatgccttctaagcatcttctctcccgtctgcagcccaaggctgcccctgggagcaggcagaggcttgcgctgtcttttgtcctggcgtcttcatttcagccggggaactttgggtggagctggagccaagtggcaagcggagctcaggcttgctgggccccggcctccccaccgcatcccccggcttttggacacagacctttctctgggtggtctggagaccaggttgaaacgtgttgatgtttagcagttcggttctgctaaacgttgacaggattatcatgctctttaaagcggtcagcctgtcccaggaagctgtgctcccgacggagaagctgtttgtgtgtggtttctgttccgaaggcctcagcagttttaagtttcct

SEQ ID NO: 20367 - DNA, 1049 bp, Homo sapiens
ctcagccgtccagtatcacctttgtggttctttcatgtcaataccagctatattaccatttacttacatttttctttaaatatactcattttaaaaatttagatttaggctggacgtggtggctcatgcctgtaatcccagcactttgggaggccaaggcgggtggatccctggaactcaggagttcaagaccagcctggccaacatggcaaaacctcatctctatagaaaaaatacaaaaattagccgcaacatggtgaaacgtcgtctctacacaaaaatacaaaagttagccaggtgtggtggtgcatacctgtgaccccattactcgggaggctggggtgggaggatcacttgagcctgggaggtcgaggctgcagtgagccaagattgcgccactgcactccagcctggggcgacagagcgagaccccatctcaaaaaaaaaaaaaaaagatttatatctttggttaaaaaggaagatgagcaggtgttagagaaacgttagtaatttattgacatcaaagcaagactcttctcttaaagtaattggaaggaccgaaagaaaactacaaaaggaataaccttctcactcttctattcagtgttatttagtgagggatactcgtgccacctagaggaggtctctaccaggtatcggtgaagaattccacttagaggatgcttgccccctgccctattttgatggccctggtgatatctgggatggtggtgaccattgagaaagagagctacagcttttatgctcagctttttagaatattcttgaaaactgaaggtttcacggtagttttaggtatgtcttaaacaaatccttaacttcagctttagaatagttggtgtttaggctgggtgtggtgtctcacacctgtaatcccagcactttgggagccaaggcaggcagatcatctgagggcaggagttcgagaccagcctggccaacatggcaaaaccccgtctctactaaaaatacaaaaatgatctgggtgtggtggtgcgtgcctgtagtcccagctactcggtaggctg

SEQ ID NO: 20368 - DNA, 1018 bp, Homo sapiens
ggtcgcttgtcggggctcctggatcagagagcatgagctggtgcctggtgagtcagaagctggatcactcttgggttggtgtcagcagccagttctggacggccctcttaagccgtgctggcctttcgttctggcctttgatgtaacccagggtgtgtaagggctgcctgccctttacagagaaacagatctgtgctgggaagttaacaaacaggaggcaggatgtgagatgagagagaaggaactgtctggtcagtggggttcacccaagtctagaggttcatctgtgtggagggtgggacttaatataaggcaggaggcttgggtagaatctgccccagccaccacctggcgtctgcagtgatagaaagcctgggagaccttccacccggggccctgggaagctccaacactcagcctccgtgttttctgtgtctttctctggctgcagggatttccgaggtttcctttttgtgcatctggacattttcctttctctgctcatttacttatcctacaaacacaggcgggatggtgggcccggcccagggtcggtgctggcactggggtgatcacgatgtagagaaggtagtttcgaccgggtgcggtggctcacgcctgtcatcccagcactttgggaggccgaggcgggcggatcacgaggtcaggaaatcgagaccatcctggctaacgtggtgaaaccccgtctctactaaaaatacaaaaaaatgatccgggcgtggtggtgggcgcctgttgtcccagctactcgggaggctgagggaggagaatggcgtgaacccgggaggcggaggttgcagtaagcagagatcgcatcactgcactccagcctgggcgacagagcgagactccgtctcaaaaacaaacaaacaaacaaacaaaaaaccaaaaaaaaaacaaaaaaagacaaggtagtttctgtgcttggggagcgcgaaggcgttaagtctgcgggtgagagccgaggaggagctccctcaccctgctggctggatga

SEQ ID NO: 20369 - DNA, 1160 bp, Homo sapiens
agagatgactgtaatataaaacttctatatggtccaaaataccagaaaccagatcaaatgataaaccctagggtgagaaaagatatttccaacgtatatgacagagaaaagtgctatttttcttttctttctttcttttttccgtcctttcctttctcttttctcctttccttgtttcactctgtcgcccaggctggagtgcggtggtgcaatcttggctcactgcaagctccatctcccgggttcaagcgattctcctgcctcagcctcccgagtagctgggattacagacacgtaccaccacgcccggctaatttttcgtatttttagtagagacggggtttcaccatgttggccaggctggtctcgaactcctgacctcaggtgatccgcccgcatcggcctcccaaatgtaatcttcatgctgggattacaggtgtgagccactgcccactggcctgttttttttcttaatgcataaagagcttttaaaatcaatttgggtaaagaatttgaacagagaaagacacataaacatgaaaagatgcctggttctgtttgcaattaaagaagtacaacttttgaaatatgtgattattaaactggcaaaaggaacatttgataacatacagtgttggcaaggatgtagacggggtctctcccgcgtggttgggggagcgtaatctgatgcggtgtctttggcagtgttttaacacagttaaaaatgtgtggaccgtttgacctgtcagtccaatttctgggaatttctcaacagatcttacaaatacggttgaccctcaaacaacgttggtttgaactacaccgttccatttatacacagatttttttcaaccgaatgtggattaaaaaatagagtatttggccgggtgtggtggctcacgcttataagcccagcactttgggaggctgaggagggtggatcacttgatgttaggagttcaacaccagcctggccaacatggcaaaaccccatctccactaaaaatagaaaaattagccgtgcgtggtagcgggcgcctgtaatccctgctacttgggaggctgaggcaggagaatcacttgaactcgggaggcagaggttgcagtgagccgagatcgcgccactgtactccagcctgggcaacagagtgagactgtcc

SEQ ID NO: 20370 - DNA, 1035 bp, Homo sapiens
tagtcgggtttggtgatacacacctgtggtcccagatatgcaggatgcagaggtgggaagacccttgagcccagaatcgtgccactgcacggcagcctgggcaacagagtgagaccctgtctcaaaaaaaaaaaaaaactttttgagaatttgaaaaatgtagaaaagcactagaatataggaatcataaacctccccactgctaacattttgcactttatttgtatatctttcctttcttctgtaaaatatacttaaaaaaatacaaaagtggggtttaactatatacctgtcgttttgtcgtttccacttaactatctcacgaatattctcctcgctcatcaaatattaccaagtgtttcatcttcactcttgcttgatgtttcatcattcctgacccccgatgaggttgtccttctggtatcaaacgcacttgtgtcctatctgtttcttttatgctgcttatcaaagtttctagttacatatgttttggggatatttgatgtctgttttcttacaagagcgtaaactctgtgaggacctgtccccaatgctggacgcagtgtcctgcacgttgcaggtctgcaaatagtgactatatggatatgttgttgaacattacattttccaatttttgcttggatgggatggcctttattttaaaattaattaaaaatttttgtttgtttttgagacacggtctcgctgtgttgcccaggctggagtgcagtggtgtgatcacagctcactgcagcctagacttgctcaagcaatcctcccgtctcagcctccggggtagctaggactacaggtatgtgccaacacacctgactaatataaaatttttttggtgtaaagcggggtcttgctttaagttggtgcacaagtaattgcaccaacgtggttatttttctgtgcgaaacactggagtggcacccaggtggatgtaaacagagtgaataagacaagggccctgcctggagatgttgtagtaaaaacctcctgccttggcctcccaaagtgtcgggattccag

SEQ ID NO: 20371 - DNA, 1025 bp, Homo sapiens
tgggtttggggtttctgaagctgcctggatgtgcttctctggaatgttggggcctccttgtacccgtcactggacttgttcaggcaggtgcagtgtgaccagctgtcaagagtattcctaggtttgctttccgggaggcgggaggcctcattcttgacttaagtctctgtatctcctttccaccccttctttcttcctccctgtcctctcctttggtgcttctgcgagacaccaaagcctgagacagtcaaacctgagacaatcagctttgaacaagagatgcagaggcttttggtggctagttcttacacctgaatccgccggctgctcccaaggccctgggccaaacctcaaagcaaatagttacttttccttcccatctgacttgtaaaatctcttctcccaacccccatcccaaattgccacccaggcctgtctccagctctgtgtacctgtacttcctgcctttacctgggcattcctttctgagtgatgggagtttcgcagatgaaagtaacttacaccgaaggtgtgaatgaggcttggtctttgaatgtttgcattttaaaactgaatgaggcttggtgctgccaagggctggggctggggagcaggggaacggaacggaacggaacggagttagtctttactgaggacggaatttcagtttgggaagatggaaagttctggagacagatggtggtgatggtagcagaacaggagatgcacctaatgctgcaggacggtccaccggaacacacttgaaataggacattttctgttatgtatgttctatcacaacaacaaattaaaaatcggccgggcgcagtggctcatccctgtaatcctagcacttcgggaggccgaggtgggcggatcacctgaggttgggagttcaagagcagcctggccaacatggtgaaaccccatctctactaaaaatacaaaattagccggacgtagtggctcacgccttgcaatcccacctacgcggggggctgaggcaggagaatcgcttgaaccca

SEQ ID NO: 20372 - DNA, 1043 bp, Homo sapiens
aaccttggtctgtctgactccagcccccccacagtgtgaccgtccgtggtacctgccgggttccaaccttggtctgtctgaccccagcccccccacagtgtgaccgtccgtggtacctgccgggttccaaccttggtctctctgactccagcccccccacagtgtgaccgtccgtggtacctgccgggttccaaccttggtctgtctgaccccagcccccccacagtgtgaccgtccgtggtacctgccgggttccaaccttggtctgtctgaccccagcccccccacagtgtgaccgtccgtggtacctgccgggttccaaccttggtctgtctgaccccagcccccccacagtgtgaccgtccgtggtacctgccgggttccaaccttggtctgtctgaccccagcccccccacagtgtgaccgtccgtggtacctgccgggttccaaccttggtctgtctgaccccagcccccccacagtgtgaccgtccgtggtacctgccgggttccaaccttggtctctctgaccccagcccccccacagtgtgacctgaattttctgcaacctcctgtggccttgtcctggcaggaggtgggtaactgtcatgagtttctcagaccacaaaaaccacaaccaccaccgccccccacaaaaacggaaacgccccttctttcagcgctggccatgagggagcggtggtgatggatggctgaccgtggagaattctgcattccaggggactgaggtcagggcaggcgggagctgcgtggccctggtttccaggactcaggctctggtgcattctcggggaggctgagctccccttcccgggtgccctccgtctactgagtgtgccgagctcattgctttcctgcctcccgtcctctctgcccctgtggctctcccagggaaatacccacgggaccccaggtgaaggttcctgctgcccgcccctctggggctggccctgctgggaggaatgccggcccccacccccagccctgcccagactcatgcctgaggttttactgctttcattc

SEQ ID NO: 20373 - DNA, 1234 bp, Homo sapiens
tgctagactgttgtttatacaagcagttgataaaaatgttgattagcctgagtctggggatagagttggggggttatgccgctagacaccttctccaggctaggaggagtctgttagtcagttgctcagccgtcttcaaatccagccgattccaaacttgccctgattggattatgattcagcccacactcctcggtgtgatcagcatgtttattgtaggaggccctcacagacagcttgctatcacttagatagttcctattgatagttttcaaggaaagatagtctgaaatgacgtgtgtttggtgaatgcatgcttgcttctaacagatcccttcttttcctaagtgtgtgtgataactaaagtaagccggaaggtctgttgaagggttgatgtcgagtccagctctctgccatctggagaatctcccacttttgtctttttgaaaatcgagactccctccgtcggtgggttgctggtcacgaaatcacggatgacggttaagtgagcttaaggcccacgttctccctcttggatgtaatctgagaactgctttatctgctgggcatgtgtggagtgtgggtacaattgtttcctgcagaggaccctgtggaaatagctggctagatacgcccaatagtcagtgtgcggttgagagtcccccatttgtccagaaggcgcagagcttgtacttcctgagggccatgtggtaatcctgactgccctgccctctacccaacacccctctccccgcctcctctcattagggcattaatggagcctgagggagtctttttcttaataccattctctccgtcacacacaggatgcgaagcccgctggctaattaagtgtggcattttgtttcaaaattatccatagacagtcactagctgcaaagcagcccactgtccttgtgctgatagatgtttttcttaatattttagggtgactcagtccatttatttcatgaattttaccttactttgaaataggtttcttttcttacacaagtgtctttgaccacctaaagttacacacaaatctgtaatatacattgcagtttggcacctaaggattctgacatttcagatgtaggcgtgagggtgaattggaagtaaatgccttcagacattttcctggggggaaatcagtttcctaaatttgcagaaagtcccggcttcaacccttggatgcgttgctttaagctttttacaaatgttcttaagaata

SEQ ID NO: 20374 - DNA, 1245 bp, Homo sapiens
attcaagtgctgtttctacagtgaatgacggttttatctcatatcgttgtcgaacagtcaccaaacagggtgtggtgagttctgctgtcctagggatagggctttctctttgttttcctgggagaatttcatccagatgcatcagttccacatttttttttaatttgtctttttttggtcaatatgcctgggataaaaatctggatggatttaatctgtttaaaatcagaaggcgctgcttttcctcccgttaaacgtgatcaggtcaagacggttttcttttgatcgtggtggctcacagcacagctgcctcatctgttactcatttttcaggttttgatgtgaaatctgaagattgggcgggaccacgtgcaatagggaaaaatcgcagtgtgaccgccggagccccgaataggcgtgaatgtagctgtgagtgcagcgttttccagctctgggcatgttcttgactgcaattgtaaaaattgtttttacccgtgatctttcaaaaatactccattatggtatgtgaatatttaaagtgtgttccatagtagacgaagaatatagactggaaatccagatccaggtttcccgggttggaaacttggctgtttcccgggggtgtgactttggggccagttctggaatttctgtgtctctagtttcctggtgagtaaaatggagatgatggtaccagcctcttagggtggttgttaaggattgaatgacataatatttgacaagtacttaggatggtgcctggtgcatagcacgtgccgtttaaatgtttaccaggcgcttcggtattcattccacattttatggttatttggattataagagagaggaattcagcctttttacctctttgtacccctcccccattccaaagcacctagttatttatttgtatctagagactatcacagaacctggtttctcttcatttttttgcttcttttctttcttttcttttctttttctttctttctttcttttttttgagaccgtgtctctctctgtctcccaggctggagtgcagtggtacgatctcagctcactgtgacctctgcctcttaggttcaagcgatactcctgcctcagcctcctgagtagctgggattacaggtgcccgccaccacgcctggctcattttgtctttttaataaagacagggtttcactatcttgacgaggctggtcttgaactcctgacctcaagcgatccgcctgcctcagcctctca

SEQ ID NO: 20375 - DNA, 1049 bp, Homo sapiens
ggtgcagatttgaaaattaggattttctgccttcttcataagaagcccggaccagccaggacaggctcccactggtgactgtgtttctaggacttgggccagtcttttagtaataaaggacaacagtccagttaggagcaggccgggtgtgatggctcacacctgtaattcagcactttgggaggccaaggtggggggatcacttgagcctaggagtttgagaccagcctgggcaacatggtgaaacattgtctttgcaaaaaataacaattagctggtcacagtggtgggtacctgtggtcccagctactcgggaggctgaggcaggaggattgcttaaacccaggaggtggaggctgcagtgagccatgtttgtgtcactacactccagccaggacaacacagcaagaccctgtattaaataaataaataaataaataaataaataaaaataaagtaataagagcaatgttccttgagaggctttttcttgttccatcatttgtaatatattttttaatctctttgttttttctctgcataataaggcagtctaatacatggctaaaaatatagagtcttttgtccttctgcttgagttcacgcccccgctctgccgtttattagctgtgtgtccttgtgcaaggcgctgtacatctctgtaccacacgttccttttccatttgtgataacagcacctgccttattgtgtaaaggctacgcgagataatatacacgtgcctggcatgtggtgagtgctcaataaatgctattattgtgtttagataaatgatcattaagtttagtcattcatttcatagcttgagccttgggaatctatcacattactgaactgtaaaacggttatgaggtatatccatatatctatatatatatatctatatacttttttgagatggagtctcgctctgtcacccaggctggagtgcagtggtgcgatctcggctcactgcaagctccgcctcccgggttcacgccatgctcctgcctcagcctcctgagtagctgggactacaggcgcccaccac

SEQ ID NO: 20376 - DNA, 1075 bp, Homo sapiens
aaattagccagacctggtggcgcatgcctctagtcccagctactagggaggctgaggcaggagaatcgcttgaacctgggaggcggaggttgcggtgagccgagatcgcaccattgcaccccagtctgggcaacaagagcgaaactctgtctcaaaaaaaaaaaaaaaggaattattttcccccttgaaaccaaagagatgtggaacaaatgccttttctgtaactgagtttttgtctcatttgaagttagggtgcttagaagcccgtgagctaatgatgctaatttccccatcagaacaagtgaagagccggagttctcccagctgagggcactggatgggtgaacacgtcttgtggatggactctatccgtgtcatttcgccaatgataaaaataactctagagaagggaattttgttttacactgaagggaaaccagagttccagattgctaattttttttaaattctcattaacatttgttctttaagcccatgcgtatacttcttcccattgggataacaaagggtatggttctaattagttattggctggcatttctctaaagaaaattgaaaaattatggtggggaaagaaaatgctgtgtggtatttctttttttcttttattaatttctcctttatatagttaaaaaaaacctggggatgaccgtatatgttaagcctgcattttgcctggttcctctcaccttgacaggaactgtgagaaaacaccaaaaaaaaaaaggacaaaaatgtaaaaaaacattctttatacaaaattgtcctgtttctgcctgttgtcatggtaggtacaaaagtaattgaagcttaatttttttggcttccaaaacacatattatttcagcttccaaaacacacattattatatagctgtgcataaattgtaattagatggtaatagaactttgagagcatttataacaatttcatcagcaaatctataatcctgaagttaaggcagttagacttgttttaataagtaggttggtagatgattttcacatttctagagagaaggaatgtgatcgatagtcaggaggtggtgaaattt

SEQ ID NO: 20377 - DNA, 1020 bp, Homo sapiens
tcccagcactttgggaggccgaggcaggtggatcgcctgaggtcaggagctcgagaccagcctggccaacatggtgaaaccccatctccactacaaataaaaaattagctgggcgtggtggcaggcacctgtaatcccagctactcgggaggctgaggcaggagaatcacttgaacccgggaggtggagcttgcagtgagccgagactgcaccactgcactccagcctgggcgacagagcgagactccgtctcaaaaaaaaaaaaaaaaagaaacgttggggtcagtgttcagaaagtaaaagactctagtggccacttagaacctttcaaaagtcaggtggtatccagttctttgccttccacaaaactgatggaggactcaattttcaactgagagatcatttcaagtaattttcagtaataggtatatatgcgatttaaggcggatagcatggagagaggttaaagaatggtgtaacgcggctgtgataaaactcttttcgacctcatctacttctttatgtgaacaaaatgtttcattgttcacatatttcttgttcattttagagacatggtcctacattgcccaggctggtctcgaactcctgggctcaagtggtcctgtggctgggagccacagcacctgcacatctttacaacaaaaccagaaacatgaaccaaattgatgctgagcctcgtttcactctagcaaaaaataataccctatagatacgcgaactaaagcaaaaaatgttccgcccatctcattgagagagcattccaccaaaaagttactctgctacttaatatttattaaaatgtataatgaggccaggcgcggtggctcacgcctgtaatcccagcactttgggagaccgaggcgggtggatcacctgaggtcgggagttcgagatcagcctgaccaacatggagaaaccccatctctactaaaaatacaaaaaattagccgggtgtggttgtgtgtgtctgtaattccagctactcgggaggctgaggca

SEQ ID NO: 20378 - DNA, 1062 bp, Homo sapiens
gcagagagggtgctgggggccttgattttgaaccccagctctgacttcctaggtgtgcactgggtaaattcctcactctcgttaagctgcagcatcctcatctgtgagatgggagcggctatgagagcttaaaccgcatatgtctgctatcatgatcatgaacgcagatgctgtgtgtagaggattcatcagtgtcagacttgcaggaagagctcgagataagtccgttgctctcactcttccataacagccctgtgagtcaggtgtggatgcctccatgaggaaattgaagttcacggaggtgaaaggccttgcccgagtgcgcacggttgaatgggagactcagatcagcctgcctccaaatcctgcacactccccccgaccaggttgtgtccaggtccccctgagacttgggaagggaccattggctcagcttcctgcagaagctgccaggaggcacccagtcgtgggaagctggggcggaggaggggctgtgggtgaatcggaccaggggccatggaattggcctgaggcttatgctgatgtgtggagagacctgcctcaagaaggggtggtctcaaaacatcgaactgcgccccataaatacatacaactgcaatgtgtcaattaaaaaataagggcccgggccaggcgtggtggctcacgcccgtaatcccagcactttgggaggccgaggtgggcgaatcacgaggtcaggagatcaagaccatcctggctaacacggtgaaaccccgtctctactaaaaatacaaaaaattagccgggggtggtggcgggcgcctgtagtcccagctactcaggaggctgaggcaggagaatggcgtgaacccgggaggcggagcttgcagtgagccaggatcgcgccacagcactccagcctgggcgacagagcaagactccgtctcaaaaataaataaataaataaaaaataagggcccacacagtggtacatgcctgtaatgccagctcttcaggaggctgaggcaggaggatcactgaagcccagggcaacatagcagcctggacggcacagtgagaccc

SEQ ID NO: 20379 - DNA, 1052 bp, Homo sapiens
tgaatgtaggtgccatgtctgtttatccatccatccatccgtggatgtaggtgccacgtctatttatccatccatctgtggatgtaggtgccacgtctgtttgtccttctgtctgtccgtggatgtaggtgccacgtctcttcgtccatccatccgtctgtggacgtaggtgccatgtctgtttacccatccatccgtccatggatgtaggtgccacatctgtttatccatccgtccgtggatgtaggtgccatatctgtttgtccacccacccgtggatgtagctgccacgtctgtttatccgcctgtccatctgtggatgtagctgccatgtctatttatccatccgtccgtggatgtaggtgccacgtctgtttatccatccgttcgtggatgtaggtgccacgtctgtttattcatccgtttgtggatgtagctgccacgtctgtttatccatccatccgcggatgtaggtgccacgtctgtttatccatccattcatggatgtaggtgccatgtctgtttatccgtccgtccgtggatgtaggtgccatgtctgtttatccgtctgtccgtccgtccatccgtgcacatttgggttgtttccacccaaaacgctcttgcctttcgttgagaaaaagaaccttgtccctgaggatggagacagcacagcctccttctctccagacccaagctctgtcccccacctgcctcccagctgtaatagatgagcaggacccgtgaccctagggcatgactggtcactattagtctcctgtagttgaagcacacagttgggccccctgcctcggccttctctccccctcccggccaagtgtccctgccccttgaccccttcacccttcttcctgggtcagctctttcctcccctggtcagtggtttaggtgcatcgaatgcagacgcagtcaccctgaggccgcgggaacaacctctggtcccttgacttcttggcatctcagtttcttcttttatttatttacttatttatatttatttgagatggagtctctctctgtcgcccaggctgagt

SEQ ID NO: 20380 - DNA, 1012 bp, Homo sapiens
caaaaccagggtgttccgggacacagcggagcccaagtgggatgaggtgagtggcaggggctggcatctctgtggggaccccaccaccccgtgctcgtggcttgtctgctggggacggccagcccattggttggaccagctatgtctgcacccccctttctgctccctgctcctctggcttctgatcgcggtgtgtgtctgggtgtcagaccctgtggtgtcagctcaggcccccagactccaggggtgatgggaggcctctgggagctccagaaaatctgacgtgtccttcgtgggccgtgcttactccctcctccttgcaaagctgaggcacgcacctgccggaaagccaggcctcccagcttcggaggttcagggccctttgtcccatctttccccaggagtttgagatcgagctggagggctcccagtccctgaggatcctgtgctatgagaagtgctatgacaagaccaaggtcaacaaggacaacaatgagatcgtggacaagatcatgggcaaaggacagatccaggtgaggccagggcgccggggcgaggctgagggagcctccaggaggtggttccagttgaaaaggaattctggtcaaggagcctgctctttcgtgattttggttccaagctggttggaggaaagttcccaggaggtggttctcccctccctgctagaggtggctgcctgttgtggccccggaagcccaggcgtgtgcgtggctcctcaggtgggtcatctgcgcttctgcaagatggaaacaaccagctttgttttcacacgccagctttagtctatgggtggttgtttcccggaacgccatgttgagaaggactcagaggctgcgtcggtgaacgggagggaggaatgctgtgtgtgaggagccgtgtctgccattgacgggggaccggagttaggcacacggaccaggcgtttgctcttctgcccgaaagacttagggtcctgctggttggcttggggggaggggggtctctgacttgt

SEQ ID NO: 20381 - DNA, 1046 bp, Homo sapiens
tcccggggcgggttccccaccttcccccagctctctcctcctgggcccctgcttggctctttcttgagcagagaccagagggagcaaaggaagaactcgctgggaggccaggtctgtggtaggagggctcaggaagaggagtaggaccctccacagccacagcctcagaagaaaacctcagagtgaaagaatcacacccttcctcctctcctccctgagctgggaacccctgcaccctccccacccctcagctaggaggaagctaaaccttctgctcttcggggtggcctcgcaaaggtgccagcttgaaggagaagaaattcgttccctccatgctcgctttcccactcctgaccccattcccaccgctctgccccagcctgtttgctttcatctgaacacttcctgatatgcaaagggctgggtgtgtgtacctaaaaccatgtgcacacacggggcagacgagcctccacacagaagcctccgtcctggcctctggggtgcttgtgggggtcatcttctggggccctcctgcttcctggtgggctctgattacaggaaaagcctgggagcctgggccgaagtagggggtgaaggaaaaaagatgaagccaactgcattgaaattctggatctccttgacactgggaactgagcttgggaactgtgtcttgctacgctggggccacagggtgaggccactccccagagcccctcccaccgctggccacgactggccctcctggggtggactcctggccacgctgcatcgcaggctctttatctataaaacaggtgaatgaggccttcctccctgggctccagtgacgagtgactcgggtggcatggcagcaagcatgccaggccttctggggcaggaggtggaggaagtgggtacatttctttcccttatttcgaaaggccggtcgctgggggacagagctgacaaacggctatgtgaagtcccactggcaagtgagaaccggcccaggcccgtcttcctgagaagcagctggtatgggagccagggttgaagtcactcacggg

SEQ ID NO: 20382 - DNA, 1033 bp, Homo sapiens
aggagatcgagaccatcctggctaacacggtgaaatcccggctctactaaaaatacaaaaagttagctgggcgtggtggcgggagcctgtagtcccagctactcgggaggctgaggcaggagaatggcgtgaacccgggaggcggagcttgcagtgagccgagatcgcgccactgcactctagcctgggcgacagagcgagactccgtctctaaaaaaaaaaaaaaaagaaaaaataaatgtctttcccactagagtctaagccacttgagaacaggggccactgtctgtttcccatggtatctatagggcctggtggacattcagtaaatatttattgaatgaataaataaatggacacatagcccagtggaatccccaagtactcgcgttttgcggtattcatactcggtccttggcaagcatcgggcaaggtggcactcttaggagttgaatccagctctggtgtgtgggacaggcaggaggagaggaagagagggaggaaaagtcggttcgagaacccaggtggaaaatagattgagggaagcaaaacgagatgttacaggaggaatatgggtgattgtcttttccttttatatttctgcatgttttgtatattttttataataatatctgacttttatcccctatgaaagtgtcgcttaaaataaaaggaaaggggaaaggggggccgggcgcggtggctcacgcctgtaatcccagcactttgggaggctgaggcggacggatcacctgaggtcaggagttctataccagcctggccaacatggtgaaaccccatctctactaaaaatacaaaaaaaattagtctggcataatggctgggcatggtggctcacacctgtaatcccagcactttgggaggctgaggtgggtggatcacctgaggtcaggagttctatatcagcctggccaacatggtgaaaccccatctctactaaaaatacaaaaattatctgggcatggtggcaggtgcctgtaatcccagctactcgggaggctgaggcagggga

SEQ ID NO: 20383 - DNA, 1086 bp, Homo sapiens
ctgataaaagggcaccaaattcaggggagaagggaccacttctagtggagttggggatggcctggatgcgtgcatgtgtgtgtgtgtgcaggccaagggtcatttctggatgatacactcctgtcctgggctgcagaggttcttggcacacccttccctggcagctagtaggaatccaaggcaattctctttgctattactttactttaggggtacttaccttaagcagcagttgcgttgtgagcatgtgcccaagtgccaggcccataaatcaatcctgtttccagtgtcatttccaagacgcttcatcttcctggggggcagaggtaaagttggctgcagttttctccaaagctatagctggagtttgctgcatatctcagcccagacttacctttgaagagttattgatctgtaaaactggtaatgcaaataaaatactgatagcagcgtcatgttgcatttgtaaaatggcttacacttgccaaaaatgtttcatgccattctatttaaagataggtagggttgtgacgggggcgttgtagaaggtgctattttaaggaacttatttgtcaggaataaaaacccttttgtaatgcagattaaccctttaggtatcattctgtgccatttttttttttcttttgagacagagtctcactctgtcacccaggctggagtgcgatggcacaatcatggctctctgtggcctccacctcccagactcaatcagtcctcccacctcagcctccccctcactacaggcacatgccaccacgttgggctaatttttatatttttgtagagacagggtttcaccatgttgcccatgctagtctgtaactcctgggctcaagcaatctgcccctcttggcctcccaaagtgctgggattacaggagtgagccactgagcccagcccaattctgtgccagtttttaatggatcatctgaaacatctctatttctgtttcacctgcccaggtctcttgtgcctgcacatcatgcctgtatcccccatttggatgtttttctaagtgcgggccccacgtggtgatttgagaaatgatcggtggcacctcgatct

SEQ ID NO: 20384 - DNA, 1026 bp, Homo sapiens
gcttccgcctcccggggttcaagtgattcttctgcctcagcctccctagtagcggggattacaggcacccgccagtacgcctggctaattttttgtatttttagtagagacggggtttcaccacgttggccaggctggtcttgatctcctgacctcaggtgatctgcccgcctcggcctcccaaagtgctgggattacaggcgtgagccactgcatctggccaacattagctttatgtagttgaactatgtatatgattttggagtgacctgtactagaacagagaggaggcagagggaggagcaaggtgatctggaaggtgacgaatccagtcccatctgtggctgcagttagtggctgcaactgccctggcacttgccctttggtgtcagttcccattggctgaagagctactgagcttcatacagtctggaggtggggcttgagtttctgccaggaaagctgggagagccagggagaagccaagaggcgggagaaagtgcttcaagccgaggacctgccgttgttaaaggcctggaagtgagaacgtgccaggccctttgagaggttactgtcaacagtgagatgggtgagtcatcagctggggccccacggctcttgtttgggctggcttggtggcttcctgctgggcatagagtgagcagtgttttagaaagagtcatctgatgtcagcaggagggatgcaggatgaatgtcctgtcacacctgtcctgaaatcctccagcaccttcccttcgcctatggggccccccttccctttgcacagctgtcaaggccttgtgtgacctgacccctggaccccctgcctacctctgtggcctcaggaccaactccgtgctagaattgtgaactctcacgagagagagattttgtcggttttgtaacaaaacttgctcattgcagtctctggtgccgagaactgtgcctggcacacagtaggtgctcagtaaatattagctgaatgaatgcatgaaccagccagactaaactcatgtcattgtgcct

SEQ ID NO: 20385 - DNA, 1053 bp, Homo sapiens
gtaatttattcctttttgtcaacaccggcccataatcttcatggctgctggagtctcagaggtggggctggcagaagaattaagtcatctactcagagaaacttaggtttctgtggttgtgattgttggctactgttgttcttcgggaaaaggaaggaaatttgtggggaattggctggaagatgctgttaggaggatggaagatggggaatggcggggaggctctgcctcactcttgcgagtaggatggaagacttgttctctgtctgaggtatgatctgctttctgggacaattccggtaccttccttcgtagagggagggcatgatggctctcgtgggtgttgtgtggattaattcatatttataaagtgctttgaaggtgaggagagctattgagcagctcagctgtccagctcattgcgctcctcatccgggaaagcctcgagggactgggagaggccggcacaggacttaggaaggggcagggaatgtggcaggaggaccggcaggaacagggtatcagaccagctctgaggcagcgcctcccacagcggctcccgcacaggccctccataggtgttggttgtctgagtacgggtgggaaaaagaaaactcgagttcttggctccttgagctcctccccgcagcagaaacccctgttagctgaaacctgtcagctggcccgtccatgcgtttccggctgtgtggatttggtcattgtactcgctcgtagtggagtcagagacccccaaagggagtctcgcgcttttgccagggtttatgattggaggacttcactgccagcgttggcggcagctgtttggctgagcttgagccctttgggcgcaaacctagggcaggcggcttcaagacaaccctgcgcccactgcccctgccaggcccttggtggtggcgggtgttggtgatgtgtggggggtgggctgaggtgatgtgttgagtggactgaggtgatgtgttgggtgggctgaggtgatggggggggtggactgaggtgatgtgttgggtgggctgaggtgatgtgttgggtggg

SEQ ID NO: 20386 - DNA, 1327 bp, Homo sapiens
aatgcctcagattcacgcgtgcttatgttcctgagtgtttctggctctttgcaaaacccagttcttgtttccctatttcccgaagcctggaatcgtatggaaccctgtctctagctttctctgcagcagaagactcctctgagctgatcatttccaagtcttccataccccaccctcttcctcccacgcctggagcaaaaaagcaaaattgcctgaggccaccttgaaaattcctgaccagaggaatgccagaaaagggaattaggccaaggcctcttagggggttctgttgggcagccctgattcaggcagattggcacctgagctgtctaccctcctgctgctgccctggcctctgggcggctcctggggtggcctggatggtgggtgggagggggcactgatgtggccgcagtgtgaggagtccctgcctccctcttcggaacagcttagtggagagctgtagcaggaggcttcccggggaggtgctgtgcagtcatgtttgggctgttagccatcaactttcctcttgacaagagcctaaattaaaacaaatacccgagctgtcatttgcctggcagcaaggttttgtggctcccagaggaagttcctctgcttctcaggaagctgtttgcttacaaggctcacagtcctggggtgacaaatctccacaaatgccagatccatcgggaactgtaaagggggtatacccagggcacagggtggcagtgtgacttagagatgggaatgactcggtgttagaggttccctgccttcctctctctgagcattgttcctggtaacaatgataatagcgtctcctgagcacctactgtatggcaggcactgggatagtcactttctctttctttcttttttcttttttttttttgttttttgttttttgttttgttttgagacggggtctccgtctttgcccaggctggagtgcagtggtgcgatcttggctcactgcaacctccacctcctggattcaagcagttcccctgcctcagcctcctgagtagctgggattatgggcgcctgccaccacaacccagctaagttttgtatttttagtagagatggggtttcaccatattggtcaggctggtctcgaactcctgacctcaggtgatcttcccaccttggcctcccaaagtgctgggattactggcgtgagccactgcgcccggcctgtgctaggcactttctatccattctctccaaatctcacaactctgcaactcttacagagtaggaaagtgaggctcagttagcataaatcatagacctaagatcacataagtaacaaatggctgagctg

SEQ ID NO: 20387 - DNA, 1036 bp, Homo sapiens
gagcagttagagaattaattggaacagcaattctcccaccccaaatcccatcctaggggccatttgttctttctttgcatctttccagagagggtggtcattctcgacgcgacgtctcaaccagccaaacagttcttttccagctggtggaggtgggctgggtggaacacctgtactgcctcattccaggctctttgtgaccaggaatatgcttggtcattcattcattcacacttgctcattcattcactgaaactatttgtgcaaggtcctggggttacagtgaataacagatgtggttcctatcctccaagagacctcagtctagcaggagagacaggcattgaacgtttacaagagtcctgagcattcagaagcagggaacgacgcaggccttcctggtctggtgggtcgggaaagctccctggaagacaagatacttaagttaagaccagaagggagagtaggagttacccaggcagagtgggggtagagcgtttttgccagcgatgtcaacctatgcaaaagttccaaggcaggaaaaagtagaagagagcaaggagcagaatgtgccagatgaagctgaaaggggtgcagaggcccggccacaggttccttaggccaccaaaaggatgtgcgggtctctatcccgacagcagtgactcgggagactgaggcgggagaatcacttgaactcggaggcggaggtttcagtgagccgagattgcaccattgcactccagcctgggggacaagaacgagactctgtctaaaaaaaaaaaaaaaaaggaagccatagacaggtcttagtaagagaggaatgacatgctacatgtgttttaggatgtcttagagcaagccttcagttgctgttagacactgggaaactctttcctctaattgatcttcatatctttgatgtcagtctcgtgagcctgggactgctccaaccaacggacccagccaaaacgtggccactgtggccggagtctcacccttcttcactctcctttcgggagaacacgagtcatgtgtg

SEQ ID NO: 20388 - DNA, 1056 bp, Homo sapiens
ccgttatcccagctacttgggaggctgaggcaggagaatcactttaacccaggaggcagaggatgcagtgagccgagatcacgcccttgcactccagcctgggtgatagcgcgagactcagtctcaaaaaaaaaaaaaaaaaaaagaaaaagaaaaagaaaagaaaaaaagaggttctgagaaatgtgtagatgatttcactgttgtgcaagcatcatagtatattttacacaaacctaaatacaaaaatcacctggctgtatatttcacacaaacctaaatactaacatacagcccaggtacatagtaggctcaatggtatagcccactatgtgatatagatatgatatatgatatagacagcttactgctcctaggtacgaacctgtatagcaggtcactatactgaatactataggccgttgtaacacaatggaaaatgtttgtgtatctgaacacgtctaagcgtacaaaaggtacaggaaaaaatacaggattataatcttctggaccacctttgtatatatagtcctttcaggtcatatggctcaggactgtagtttgaacccatgtttctcattttttttgtttgtttgttttttgagacagagtctcgctgtgtcgcccatgctggagcgcagtggcgcaatctcggctcactgcaacctctgcctcccgggttcaagcgattctcctgcctcagcctcccgagtagctgggattacaggcgcgcaccaccacgcccggataatgttttgtattttagtagagacggggtttcaccatgccgtccaggctggtctcgaactcccaacctcaggtgatccgcccgcctcgtcctcccaaagtgctgggatgacaggcctgagccaccgcgcccggcccacattaagtctttaaatgccccgctggggactaagatgcccctggtggaatccaggagccctggtggtggcttctgcggggcccaggccgagatgagggagaggccgggaggagtggactgggctggcccgtgggccgggggtcggtggtttctcgtgccctcccctcggc

SEQ ID NO: 20389 - DNA, 1009 bp, Homo sapiens
ttcttcttcttgttatagtaatttttttttttttcgagatggggtcttgctcttgtcgcctaggctagagtgcagcggtgcaatctcggctcactgcaacctccacctcccgagttcaagcaattcttgtgcctcagcctcccgagtagctgggattacaggcttgtgccaccacaccaggctaattttttgtatttttagtagagacggggtttcaccatcttggccaggctggtctcaaactcccgacctcaagcaatcagcctgccttggcctctcgaagtgctgggattacaggcatgagccaccgtggccggccttgttacagtaatttacatattgttcccaccttgctagcattgctgaaggcagataccaccttatggcagtaaaggatgcaggttctggggtcagactgcccacgtttgaacctcagctctaccccttactagctgtgaggatttaaaaacgttatttcacgtctctgtgccttggatatcttatctgtaaaatggatgtgttaatagtgtctatttcctggaatgttgtggggattaatgaggaaatctatggtaaaaaaatcacggtgaataatcaatcaataatgactcctatgattcacgctttgttttctaagcacctgccacaggacctggaataatttagataaggactgactgcaagtcagacacctctgcaggaacagcagaagaagatcgatttttggtggctagctccactgaaatggaatcccactgggtcagagcaaaacctggaatccatatttttatttatttttcattatttatttatttatttatttatttattcatttttttgagacggagcctcactctgtcgcccaggctggaaagaagtggagagatttctgctcactgcaacctctgcctcctgggctcaagcaattctcctgcctcagcctcctgagtagctgggactatgggcgtctgccaccacgcctggctaatttttgtattttttagtagag

SEQ ID NO: 20390 - DNA, 1050 bp, Homo sapiens
ctacacagacacagcaacaatccgatttctccttcttttccccacatttcccccttttctattcgacaaaaccgccatcgtcatcatggcccgttctcaatgagctgctgggtacacctcccagacggggtggcggccgggcagaggctgcactctgggcactttgggaggccaaggcaggcggctaggaggtggaggttatagtgagccgagatcacgccactgcactccagcctgggcaccattgagcactcagtgaacgagactccgtccgcaatcccggcacctcgggaggccgaggctggcagatcactcgcggctaggagctggagaccagcccggccaacacagcgaaaccccgtctccaccaaaaaaatacgaaaaccagtcaggcatggcagcgcgcgcctgcaatcgcaggcactcggcaggctgaggcaggagaatcaggcagggagcttgcagtgagccgagatggcagcagtacagtccagcttcggctcggcatcagagggagaccgtggagagagagggagagggagagctctttcttttcttttttttttttttgagacagagtcttgctctgtcacccaggctagagtgtagtggggagatctaggctcactgcaatctctgcctcctgggttcaagtgattctcctgcctcagcctcctgagtagttgggactacaggcacacaccatcacgcctacctaatttctgtatgttttgtagaaatggggttttgccatgttgcccagggtggtcttaaacacctggactcaagcaatctgcctgcctccacctcctaaagtgctgggactataggcgtgagccaccccacctggtcaagagcaatacttttttggtctgagtattttatttggagagaaatagaacttggccattgagcttatatacaccgagatagctgccacattacagggaaaaactatgtacaatcaaatatatatatttttttctttgaggtggagtttcgctcttgttgcctaggctggagtgcagtggcacgatcttggctcgctgc

SEQ ID NO: 20391 - DNA, 1979 bp, Homo sapiens
acgtgtcgagggagggacctggtgggaggcgactggatcatggggcggtttcccccgggctgttgtcctgatcacgaggggagttctcatgagatctggtggttttaaagcgtttggaagtttcccccgcaggcttgcttgctctcctgccgccttgtgaagaaggtggttgcttttcctttgccttccgcggtgattgtaagtttcctgaggcctccccagccttggggaactgtgagtcaattaaacctctttcctttataaattacccagtctcgggtagttctttacagcagtgtgaacacggacaaatacaggtgctgttattatttccattttccatgagaatcacgaggcctggagaacttcaataacattgcccatggtcacccagcttataagtagcccttaggatttgaagccaggcagtctggcttccaggtccatgctttcgcacaccaagctgtaccgcctcaaatattagtacttccctctcaggatagttacgaagattaaatgcaagagaataattaaagagtgtagcagaacacctggcgtagagtgacgatggagggtattcgtgtctctgtgtgtgtgtgtgtgtgtgtgttgttactgattttttgtttgtttgagatggagtcttctgagtagctgagattactggtgcccgccaccaagcccggctaatttttatattatttatttttttgagatggagtatggctcttgtcaccccggctggtgtgtaatggcaagatctcggctcactgcaacctccgcctcctgagttcaagcaattctccagcctcagccccccgagtagctgggattacaggtgcccgccaccacacccggttactttttgtatttttagtagagacggggtttcgccatgttgtccaggctggtcttgaactcgtgacctcaggtgatctgcctgactcggactcccaaagtgctgggattacaggtgtaagccactgtccctggcctattttattttaagacagggtcttactctgttgcccaagctggagtgcagtggcatgaacacagctcactgcagcctccacctcctaggctcaagcgatcctcccacctcagcctcccatgtagctggaactataggcacatgccacgagccggctaatttttaattttttgtagagacggggtctcactatgttccccaggctcgtctagaactcccgggctcaagtgatcctcgctccttggcctccacaagtgctgagattacagatatgagccaccacacttggccctgagactttttatttttaatctttatgggaaatgaatttcctactaagtagtcatgttacctgaacctgattcatctgtaacctgatgggttttctgcccttcccatcagtgactaatgagattgttgctctaggaagaattccttgtgttcagtggatgtctgagtaacttaatttgaaggattgaattttcagcctcagctgtgatagagtaattttttcccatccctattgtgaagagatattaagaagccatttgaggccgggcgcggtggctcacgtacgcctgtaatcccagcactttgggaggccgaggtgggtggatcacttgaggtcaggagttcgagaccagcctggccaacatggtgaaaccccgtctctactaaaaatacaaaaattatccgggcagagtggcacatacctgtaatcccagctacttgggaggctgaggcaggagaattgcttgaacccgggaggcagaggttgcagtgagccgagatcacgactctgcactccagcttggtgacagggtgaaactccgtctcagaaaaaaagatgggatcctccatggtgctgttatcgttactcttcctcgatggtgtctttattgttgctgttataagtccaggaattttcagttggctaaaccaggctactgcttatatttgaatctctccaggtaataaagtttcc

SEQ ID NO: 20392 - DNA, 1077 bp, Homo sapiens
tgcacatgtacatacatgtgcacactgccacatacatgtgtgcacacacaatctaggagaaagagccctcaagcatacagggaggcattagagtggagcgattaagggaaggcgttttcgcactgtgggaaacagctcattgaaattagtgcagttggcaacagaagcacccgggcggtcttccttggccacccttgtcctttgttgcttcatttttctctacagcattccccaaattaccaccgtggatgctgcaattttgcatgtgggtcttattcactgtctccctccagtcaaacgcaagctccaggcaggcaggggtttttctctctcaagatgagtgcattggacacggcgagtattattctgtttttggactccgtttcggttctatgcggacgcgtatgtgtacactgggagctgatgtagaatgtatttcttgctgtgagatgaacaaaaaggtttgaaaacacggaattaaaccatgtttctgaagctagactgcctgtgtgacattgggagaagttatttgacttttctgagcctgagtcccctcatctgtaaactgaggctaataagcacctcttctctcctgctgttgatatgagaaataaatgggtcatatttctaaagcgttttggacgggtcctggcacgtaggaagcacccataagtgttaattaaccactactacaggtcatttttctttgagttgcttcttctttctttttcttttttgtcgagacagagtcccgctctgtcacctagactggagtgcagtggcgtcatctcgggtcactgcaacccctgcctcctgggttcaagtgattctcctgcctcagcctcctgagtagctgggatgacaagagtgtgccactacgcctggctaatttttgtattttagatgagatggggtttcaccatattggccgggctggtcttgaactcctgacctcaggtgatccgcctgtctcggcctcccaaagtgctaggattacaggcctgagccactgtgcccagctgagttgcttcctcagagcttcccactccccagtcattctggatcgcagatggtttg

SEQ ID NO: 20393 - DNA, 1567 bp, Homo sapiens
gttagtagcagagatttaggaaatgaacagatcagcgatatcctagtagcgtttagtgagtgctggcaatgagaataaacatgtttttgtgagttgcttttccgagagatagggagaccattgaatataattatatgctgctgtttggagcaacctccaagaagctttcaagttgatttgctctgtttccagcacacctgctacacttaaaggtcaaaatccaaggaattcgtcaagtctgttgcagagtttaaagaaaccactcggctgggtgcggtggctcacacctgtaatccctgcaatttgagaggccgaggcgggcggatcacgaggtcaggagattgagaccatcctggctaacacggtgaaactccgtctctactaaaagtacaaaaaattagccaggcatggtggcgcacgcctgtactcccagctactcgggaggctgaggcaggagaatcgcttgaacccgggaggcagaggttgcagtgagccgagatcacgctactgcactccagcctgggcgacagagtgagactgtctcaaaaaaaaaaaaaaggaaagatccttatcaaaaattgaaaggccgggtgcggtggctcacgcctgtaatcccagcactttcggaggccgtggtgggtggatcacgaggtcagcagttaagagaccagcctggacaacatggggaaaccctgtctctactaaaaatacaaaaaaattagccaggcgtggtggcgggcgaccttgctgggtgtaattaacatccagtgacttgggaggcctgaggcaggacaatcgctggaaactggaaggcggagcttgcagtgagccaagatcgcgccactgcactctaatctgggcaataagagcagaactccgtctcaaaaaaaaaaaaaaaaaaaaaaaattgaaagggagccagggaagctgcagaaaggtgccgtagccctgtgaggacggtgtcactcccagttcctgtatttgtgggctggaaagggaattgcccccaaacttttctggttttgatttgagtcttactttgaggatcagtcgacttaagtagaagtttttagttagttacaacttgaatgtagctaatatgtgtttttaattacaaatctcagtactttgctgccttggaaaacccaaaggcttcctacaatgttagaagcgacagtaagtgggtttgtgtacatgctctgttccgggtgggtcctcagaacagcacgtctgcaaagttaaatttcggtcctataggaagatggggatgaacttccatcactgaaaggggaaactggtgggataaatggagacattaattggcttctgtcccagacaaatgccttgagccttataaatgagaccccaaattagctgcttcctgatcctaggacaatagaggagagtgaggcttgctgaaaaagcgggataaaggtgtgacccctgtgttcttttgaaaattgtaacaagtaatagttcatggaaaactggtgaaatcctagagtgtgtcattaaaggaagcctttgtgagcactgtgagaggaaatgggaatgctcccagatccaa

SEQ ID NO: 20394 - DNA, 1108 bp, Homo sapiens
agctgaaatatttataacagcagaaccccacaataaaatacgatagaacttcttggcaacagtttattgctcagttaactattttgaagcatttctgataattagcttgtgggtaaattagattttgcaaaaagtttgcaaaatactcttgattcttgaagaggtgaggttattgagaaagagtattttgacccaagatttatgtgaaagcttgaatgtcattttagtaagatggtttccttggctgtctacgtcaagagcttatttagcgtaaaaacattgagttgtactgcgcatcagtttttttcattctgttgaccaataaatactttcaggaccataatcccttcttggcttaggcatctcaggtgtcaaggatgatagaagtcctttgcctgcgtttaataccaattgtagcaagtagaagagtctttatgcttggaatgacacctttgtttgtggctgccatagcctaatgtagtcaatacgaaataattgactttttttcttttttaacaggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatg

SEQ ID NO: 20395 - DNA, 1070 bp, Homo sapiens
cattccggtacaactaacaaactctgaatacacaaataattgtgggtacaaagaaattgttcatcagtttgagaagttgaatttgtcaaaaattagagtttttgagatggagtatcactctgttgcccagggtggagtatagtggcgcaatctctgctcactgcagcttccacctcccgggttcaagcgattcttctgcctcgtcctctctgagttgctgggactacaggtgcccaccaccacgcctggcaataattcgtattttcagtagagacagggtttccccgtgttagcccggatggtctcaatctcctaacctcgtgatccacctgcctcagcctcccaaagtgctgggattacaggcccgagtcaccgcacctggcctagtattacatcttttttttttttccttttttcgtgagacagagtcttgctttgtcacccaggctggagtgcagtggtgctatcttggctcactgcaaactccgcctcccgggttcacgccattctcctgtctcagccttcctggtagctgggactacaggtgcccgccaccatgcccggctaatttttttttgtatttttagtagaggcggggtttccccgtgttaacccggatggtctcaatctcctaacctcgtgatccgcctgcctcggcctcccaaaatgctgggattacaggcgtgagccactgttcccggcctacattttttaataaattggttttgaaactgcaatggtgcctgcctgtaatctcggctgttcagcaaggtgaggcagaaggatcacttgagcccaggagtttgacaccagcttgggcaagataaaacttcatctcacaaaataaaatactacttttgtgacttgggttccgtggtgaatataggagaatcgtcatgaaagtggcagtttactaggatgtgactttgcatttagtttaaggattatttagatttttttgttttttaaagagacggtatttatgtcttttaattttagaatatgttaatgtctgtcccagcatgttggaacataatttctttaaagggagggatcattgctttttctca

SEQ ID NO: 20396 - DNA, 1068 bp, Homo sapiens
ttgtttagtagaggcagggtttcaccatgttggccaggctggtctctaactcctgacctcgtggtccacctgcctcggcctcccaaaatgcttggattacaggcgtgagccactgcgcctggccatttttttttattattattattttaataaaaacatatgctgggcacagtggctcatgcctgtaatcccagcagtttgggaggccgaagtggacggatcacctgaggtcaggagtttgagaccagcctgaccaacatggagaaaccccgtctctactacaaatacaaaaattagccaggtgtggtggcgggcacctgtaatccctgctactcaggaggctgagacaggagaatcacttgaacccgggaggcagaggtgcagtgagccaagatcactccattgcactccagcctgggcaacaagagcaaaactctgtctcaaagaaacgaaacaaaacaagaaaacacatttgataccaactcataaccaagtctggattacttctgtagctcattatcactgataaccaagagttgattaatcaaagtagactacctgtcagtctatgtacagaactaaagataatccttattcttggttgtcgagtacagttttaggaaatggatcatcttaaaatagggtaatacggcctggtgcagtggctcacgcctataatcccagcactttgggaggccgaagcgggtggatcacctgaggtcaggagttcgagaccagcctgaccaacatggagaaaccccatctctactaaaaatacaaaattagccaggcgtcgtgtcacatgtctgtaatcctagctactggggaggctgaggcaggagaatcgcttgaacctgggagttggaggttgtgatcaactgagatcgcgccgttgcactccagcctgggcaacaagagagaaacttcgtccaaaaaaaaaaaatacagggtaatactttcgcagtttttaaaaatctagtgaaattcggctgggcgcagtggctcacgccggttaatcccagcactttgggaggctgaggcgggcggatcacgaggtcagaagattga

SEQ ID NO: 20397 - DNA, 1583 bp, Homo sapiens
tacaggcgtgagccactgcgcccagccaatgtaaaaacattctaaatggctagttgagtttgtccagatagggatcgtaactgaagaagctgtggctatttagctaatactggtggttgcacctttccttgtcagactccagtctagctgtcccacgtgtagctccagtttaaagtcactcgcatgcctttgctcatgcttctgcttaaacctgaagtgtgttttgttttctccttatccattgagattagttcaaatttgactttccctttaattgctcctccttctgggtccctgaaatactttatttggaatagcacttcattcttcttcttcttttgtttttgtgctctcttgcccaggctggagtgcattggcacagtttcacctcactgcaacctccgcctcccaggttcaagggattcttctgcctcagcctcctgagtagctgggattacaggcatacgccaccatgcccggctaattttgtgtgtgtgtgtgtgtgtgtgtgtgtgtgtgtgtgtgtgtgtgtttttagacggagtcttgctctgttgcccaggctggactgcagtggcgtgatctcggctcactgcaggctccgcctcctgggttcacaccattctcctgcctcatcctcccaagtagctgggactacaggcacctgccactgctcccggctaatttttttgtatttttagtagagacggggtttcactgtgttagccaggatggtctcgatctcctaaccacgtgatccgcccgcttctgcctcccaaagtgctgggattacaggcttgagccactgcacccggcctaattttttgtgtttttaataggttttgccatggtggcccggctggtcttgaactcctggcctcaagtgatctgcgcgcacgcatcagccacccaaagtgtgctgattacaggcatgagccaccacagccagcctcctccttgtaaaatagttatgtatttgtctaccctccatttctaaatttttaagttgatgtggacttagattatgtctcttttttttctattggtatatcgtatcgtttgttggacatagtacacagtactcagtaagtgtggattttcttttaaaactgtaaatggcttacataatcacatttccatggcgtctgtgttgccttttattttctttgcttccctgcctccattaacgtgaaattaaatttttttaaactttgaggtattgtccaagattttctttttgcattaatactttgttaaatatctcaaccttgtaatccagcactttgggaggctgaggcgggcacatcacgaggtcagaagatcaagaccatcctggctaacacggtgaaaccctgcctctgctaaaaatataaaaacaaatcagccgggtgtggtggcgggcgcctgtagtcccggctactcgggaggctgaggcaggataatggtgtgaacccaggaggcggagcttgcatttagcctacatcccgccactgcactccagcctgggtgatagagcgagaccccgtcccccaaaaaaaaaaaaaaaaaaaaaaaatttttttttttttttttttttttttttt

SEQ ID NO: 20398 - DNA, 1024 bp, Homo sapiens
ccgtctcaaaaaaaaaaaaaaaaaaaaaaaaaagtttttctgtgggtaaatgctgtccaacagcgtcagatgctacagagaaatcatgcaggaaaggaaaagcccatcaacatggcagacttcattgtcttgccacggccactccagccttcagcagccatcaccctaagcagtcagtagccatcaacatcaaggcaaaaaccttccaacagcaaaatattatcacttgctgaaggctcagatgagcattagcatttattagcaataaggtgtttttaaattatgtacagtttagacataatgctgttgtacacttaatagattacagtgtagtttaaacataacttttctatgcactgggaaacacaaaaattcatgtgacttgctttattgcaatatttttttttgcagtgctctggaactgaacccgcagtatcttccaaggtatgcccgcacctgaaatgtgcataagagacaagtgtgtagaggcggaaaatagattggtggttgaccgggctggggttcgggtacatgggaattgatggttaatgggtttggggcttttctttttgaagtgatgaaaatctaaaattatgatgattgcagaattctgtgaatatactaaaaaccattgaatggtacagtttatttattttttggagacggagtctctctctgttacccaggctgtagtgcagtggagccatctcgggtcactgcaacctccgcctcccgggttcaagcaaatctcttgcttcagcctcctggttagctgggactacaggcgcctgccaccatgcccagctaatttttgtatttttagtagagacggggttttactatgttggccaggctgttcttgatctcctgacctcatgatccacccacctcggcctcccaaggtttacaggggtgagcccctgctcccggccgaatagtacactttaaatgggtgaattgttaggtaggggaattatatataaataaaggtattattaaagggataattgttgcttctataatt

SEQ ID NO: 20399 - DNA, 1049 bp, Homo sapiens
gacatacagtcagggcaacgtagtgagaccctgtctcttgaagcaatagaagtgtctcctgactcaatgctacttctgttccttaatctgctaccttaagggatgcagagggggttgggggaattaagaggagtcagtggggttttaaaaatgaacaactcctacataccaataatgaaaagacaaataattaaatatttggcaaagtgtttgaatagatatttctccagagaacatacgcaaaaggctcataagcacatgaaaaggtgttcaacactattagttatcaaggaaatgcaaatcaaaaccacaaagagatacagcttcacacccactaggatgactagtttaaagaataactaacaagtgttcctgaggacgtggccagattagaatcctgtgttgctggtgggagtgtaaaaacggtgccgctcctgtagaaaagtttgggatgtccttcctcaaaaagctagttaccatgtgatcctgaagttccttctaggtgtatactgaagtgaactgaaagcatttattcatacaaaaacttaaagaacgttcgtagcagcattgtttataatagtccaaaaatggaaacaacccaaatgttcattaactaacgaatggatttttttttttttttcctgagaccaagtctcgctctgttgccaggctggagttcagtggcacgatctcgggtcactgcaacctccgcctcccgtgttcaagcagttgtcctgcttcagcctcccgagtagctgggattacagacattcgcctagacatcatggcagcctaatttttgtatttttagtagagacggggttttgccatgttttggccaggctggtctgaactcctgacctcaggtaatccacctgcctcccagagtgctgggattgtaggcgtgagccaccgcacctggcctaatgaatggatttttaaagcatagtatatccatacagtaggtgaagtactgatgcatgctacactaggcatgaaacttgagaccatgctatgggaaagaagccagtcacagccgactccatacg

SEQ ID NO: 20400 - DNA, 1031 bp, Homo sapiens
ttttttctttcttgagacggaatcttgctttgtcacctgggctggagtgcagtggcatgaggtcagctcactgcaacctcagcctcccaggttcaagcaattctccttccccagcctcccaagtagctggaattacagtcatatgccaacacacctggataatttttgtattattagtagagatggggtttcgccaggttggccaggctggtctcgatctcctgacctcaagtgatccgctggcctcagcctctcaaattgctgggaatacaggtatgagccaccgcacctggcctgtttttcatttcttactgcaaaagatgaatttaaatgtaaagtcagcagtacagccatatcaagtaaataatgaaaactactggccaggcgtggtggctcacgcctgtaatcctagcactttgggaggccgaggcgggtggatcacagggtcaggagattgagatcatcctggctaacatagtgaaaccccgtctctactaaagatacaaaaaaaaaattagcctggcctggtggtgggcgcctgtagtcccagctacttgggaggctgaagcaggagaatggccagaacccgggaggcggagcttgccggtagagcttgcagtgagctgagattgcgctgctgcactgtagcctggtcaacagagtgagactccatctcaaaaaaaaaaaaaaggccgggcgcggtggctcaagcctgtaatcccagcactttgggaggccgaggcgggcagatcatgaggtcaggagatcgagaccatcctggctaacacggtgaaaccccatctctactaaaaatacaaaaaatttgccgggcatggtggtgggcgcctgaagtcccagttacatgggaggctgaggcaggagaatggcgtgaacccgggaggcggaggttgccgtgagccgagattgcgccactgcactccagcctgggtgacagagcgagactccatctcaaaacaaacaaacaaaaaaactactacttatgccgcaagtaacttgtcagtggtttgagt

SEQ ID NO: 20401 - DNA, 1051 bp, Homo sapiens
gagaaaacatgtcaaacttcttaaaaatctgaatgtaaagttaatccttctactaaaccgaattggacccaagggttatttgtggtcattttcttccttagtattccaaaacagaattttaaagtattttttgtttcagtgtcttttctaattccataaaaactgtaaaaagattcagactttgatctacctgtttttcctgtacttagtgttttaggtcattgatctccccagcctcttattttccacctcaggtttcactggagcttcacctgtttggttctactgcagccgaacgtgtttatgagggagtatcctcgtaaattgagaggagaaatctcccattctgatggagcaggggattactcccccacccccaatatttttatttttgttttttaatctttgtgtcattccaactttagtacatgtgctgccaaagtgagcacaaccctgccctaaatattgagaccaaagggaaaagtagcttttgcagtcaaaattgtagaatcttggtaaaagattgtcttgtttttgtttctttttaacctagcaaaagctgatttggaaaggagtcttaaagtttcatagaaggttacacaattcatgttttcctcttttttttttttttccttttgagacggagtctcactctgttgcccagactggagtgcaatggcgcgatcttggctcactgcagcctccacctccttggttcaagtgattctcctgcctcagcctcctgagtagctgggattacaggcacctgccaccatgcctggctaatttttgttttttcttcagtagagacgggtgtttcaccgtgttggccaggctggtctcaaacttctggcctcaggtgatccgcctgccttggcctcccagagagctgggattataggcgtgagccaccgtgcctggctcatgtagttacttttagagtgaggagaggtacctctgtataggctggtatatgaagagtaaaagttgtccttgagtgtcaagattattgtcttttgaaaagccttaatcaaagtattaaagtactaaa

SEQ ID NO: 20402 - DNA, 1028 bp, Homo sapiens
atggccatttgttactagattttgtcatttagactcatacaacagtttcctaaacgttgtccagctttttatcacagagatagcttagatctacgtctctaggaggttgaatttttttttttcaaatgaagttagcctttggcagaatataagtcaaaggaaaagtgaaaatttcctcctcctagctccctcccccacaaatgggaacgtgctagttaaggatgtggtagttgctgaaaatagagcttgctggcattccaaatcctctgatggtgtcaacacctagtgtgttggttttcttatggctaccttgagccagttctgtgtttaaaaatataatagacctaggtgttggtagcagtgtcctaagctcagagctttccctacatacattttatttttttatttttacaagtgtctttcataccaaatacccacataaaaatttaaaggctcacccatatcttgttacaactgttatgtttagaatgccaaactgtgtagttcagaccatatgaccatgatcctggcttatctcttctgaaatttttatcttgaatttattgcccttccaacaatctaccatagtagctggacggatctgttgttggtgggcttgatttgtgatcagatcaggattttatcgagctaaagcaatatgaaatgtgtttaactcttcattcatatctaaagtttgaaggagatgcattactgtaagagttatgacagtatttcatcatttggcagatgtggtaaatctgccatcacagaatgcacaggaatcactgggttccttatctttcaaatggggattagtgatgtctctcttgcctactaatttgcagggtggttatgaaattttgggcttttgtaaactgtaaagtgtaatacttgtcggtactatttgttgtgaaacattcttatctaatgtgaaaggtcagataattgtttttgttactgctgtgctaggatcatattagatgataacctacctttttgagttattcttagcaagtgtagtcttctgg

SEQ ID NO: 20403 - DNA, 1086 bp, Homo sapiens
ttaattttttaatgggcacatattaggtgtatgtatttatgggaaggctaaattaaaaaaaaatttttttttgaaacagggtcttgctttgtgacccaggctgaagtgcagtgtcgccattatagcttactgcaggctcgacctcctgagttccagtgaccctcctgcctcagcttccctagtagctgggactgttgcaccggcctaatttttgtgtttttttttttttttttttttttttgtggatttgaggtctctatgttgcccaggctggtcttgaattcctggactcccaccttggcctcccaaagtgctgggattacaggtgtgagtcactgcttctggcctaaactttacatatgtgtatatgacattatgcagtacctcagttcacagcccacgttgacaaaagtttttaatttatgtaacaagattgaagcaggtagagcgttactcccattttctggttcaagaaagtgagtttgagagagagatttttttatgatcatgtggctaatcagttattaaatggtaaagccagaacttagtgtctgctgacctttagatcggtacacttactctcagccactcaaaagacctctgtgaagtaaggtggtgcctttcaggggagtagggggtgagtagcgtatgcttgatgcttgttctttaacaattctaatagcatctacttcacatcttgatgtttgtgatgactgatatccatggtgaattgtagacaaaatcttttcactttcctaaagaaacctgatggtttttttcagagataaaatcccatctcaaggcacagcgaaattaaaatgaggtgaagtttaggtactctcagaatgtttattcgcatacagattcttaaaaaacatgatttattgtaggcagatgtcacctctttaagcaaaagaaaaaaacaaccaaaaaaagaaaagccccagccgggttccgcggctcaaacacctgcaatcccagcactgtgggaggccgaggtgggcggatcacctgaggtcaggagtttgagaccatcctgaccaacatggtgaaaaccagtctctactaaaaatacaaaaattagct

SEQ ID NO: 20404 - DNA, 1043 bp, Homo sapiens
acggtttctccatgttggtcaggctggtctcgaactcccgacctcaggtgatccgcccacctcagtctcccaaagtgctgacattaaggacctgagccaccgcgcctggtcaagagctgtcttttttttgagacggagtcttgctcttgtcgcccaggctgtagtgcaatagcgcgatctcggctcactgcaacctccatcccctgggttcaagcgattctcctgcctcagcctccaagagtagctgggattacaggcatccgccactatgccaggctaattttgtatttttagtagagatggggtttcgccatgttggccaggctgatctcgaactcctgacctcaggtgatccgcccgcctcggcctcccagagtgctggggttacaggcgtgagccactgagcccgctgagagctgtccttttaaaacaccagatcctcatctctagctagcttattctgctagttagtgaagaacagggaagggagcatgtgtggaatgaactttttactacggtcttgttaggaaaaaaataggtagtagtaaattaacgttgttaataagtttagaagtatttagattaactaccagttctttgactgtaggccagtaattttccattgccgtttcagttaatggactaactttctggagtaaagtttatttttctccttcttaaatgcatagacagaactgagtaacgtagtgttaaaaatcccttctacgactgggctctgtcccccaggctggagtgcaatggcgtggtcttggctcactgcaacctccgcctcccaggttcaagcggttctcctggctcagcctcccaagtagctgggactacaggcgcgtgccaccacactcggctaattttttgtatttttagtagagacgaggtttcaccatgttggccaggatggtctttatctcctgatctcaggtgatctgcccacctcagcctcccaaactgctgggattacaggtgtgagccaccgcacccagccaatttttgtgtttttggtagagacagggttttaccatgtt

SEQ ID NO: 20405 - DNA, 1020 bp, Homo sapiens
atatttaggaaatatagtgaactaaatttcgtcttgtaaattcttaaattgctatttgtattcaacaaggttcctgttggggggggggataagatggggaagtacagctcaaggtctgctttgtctttatttcagtgtttaaaaatcaaagagatatgaatgtgcttgtattggaagtctcctcctccgccccctcatctccagatgttcccctcttaatctgttagtgttcttgggaggaaacaaattgtacttgaatgctttctattttgtgggtattggggctttttaagtaaacttgctgtgataactagaaaggatgtgaggaaaggtctttttctttttgaaagctcctttaaaaaactgatttgaaagcttgtgattgtagtttccaaataaagtacaggttagtgataattatatttttgatgtgagtggtgaggatttctgaccagagcccttattggttattgaacatgggactctgatacagccacattattacagttgttaatgttaggtgtccccttcaggatctaaaggggtaaggaaataggatctacaaggtgaggagctattgctgtgacttggggcataaggtagggactcagtggaaaggagaggaggaggaggagacagaaaccaggaatttctacctgtgtcctctacctgtgtccattcctttattgagtgcggtatttttttgtttctggtggcaaagttttcccggagttctggtcaccaaacagaacttagcaggtgtcgggggtggaagaaggtaagacagtgtattggcaggatttctttgttgggtacttgtacccaaatgctgggtttccagctgcccttttatctctctgttactgcagcaggcttattttattttgcttgctgtgttgaattagtgcctaaacttctttgtatcctcatttaattctatcctggggcgttggaatcaatttatatggattatttaacagtacgggaggaagagctaacctgtgttcaggaaaatgacaa

SEQ ID NO: 20406 - DNA, 1033 bp, Homo sapiens
cttttttaatgagtcccacaaaagttccttatgagccaacagggccctgctattcaaatgaaagttagcacagagctggttactaaagaatatgcaagggcacagggtacgcaacgcagcaaaatgaagtcagcacaaaacgaaagacacaactcttattaatggatcagaataaatcaatgaggaatagagagaaacgcgagcaaggaaaaacaacaaagactcagtgaggttaatatgtctacattgaattcagaagtcaccggaaaaacaaagcacacaaaatatgatttatttctataaaagacaaatctatagagataggaaatagatgagtggttgcctagggctgggagtaggaatggaggttgattgtaaatgggcacaaagtttgattttagtttgatgggaatgctctaaaatgggactgtggcgatggcgggataactctgtaatagactaaaactcattgaattcttgctcaaaataggtgaattcatggtgtggaaattgtttctcaatgaacatattctttttattttgttttgctttttgaggcggagtcttgctctgtctagagacggggttttaccatgttgacccagctggtctccaattcctgacctcaggtgatctgcccacctcagcgtcccaagtgccagggttacaggcatgagcccccgtgcccggccccagcaaacatattctttaaatattgtcacttgtcagtcttagcacaataagaccaaaggaagcttgcagcaagcaccacctctgaggtattctggcaaaaaaaaccaaaaaaaaacaaaaaacaaaacctgaacctggctgtcatccaaccaccactttacaggaaatttaaggaataggaaacaatttaaacagcatcacaaggaagcaaagaaacaagtccagagggccgggtgtgctggctcacacctgtaatcacgaggtcaggagatcgagaccatcctggctaacatggtgaaaccgtatctctactaaaaatacaaaaattacctgggcgtgg

SEQ ID NO: 20407 - DNA, 1047 bp, Homo sapiens
agtcataaaatactgatttgaggggaccataagaatcatataaaggcctgaaagcaggccaggtacagtggcttatgcctgtaatcctcgcacttgggaggcctaggtggtggaatcatttgagatcaggagtttgaaaccagcctggcccacgtggtgaaacactgtctctactaaaaatacaaaaaaaaattagctgggtgtggtggtgtgcgcctgtaatcccagccacttaggccgctgaggcagaagagttgcttgaacccaagaggctgacggtgcagtgagattgtgccacttcactccagcctgagcgacagggtaagaccctgtctgaaacaaaacccaaaaccaaaaaaaaccctgttgaatggcgtgttcttttatatagtctacagtattcataccagctgtcgtattttatgacctggacttccaggttaaattctgttcctcttacaggtatgaaaagatgagagggggccggtatagaagaaaatgtgaaaataaccattaaccctgctaagtttgacagggagaggcggagaaagtggcgtgctgttgccacccatgttctgaagactgtgaaatgggagataaggtagaggcaaaaaagaacctttagccatctagaagtgaagctcaaaaacagagcaggccgggcgcggtggctcacgcctcatcccagaactgtgggagcccgaggcgggtggattatgaggtcaggagatcgagaccatcctggctaacacggtgaaaccccatctctactaaaaatacaaaaaactagccaggtgtagtggcggacgcctgagtcccagctactccggaggccgaggcagagtggcttgaacctgggagacggagtttgcagtgagccgagaccacgccactgcactccagcctggacgtcagagtgagactccatctcaaaaaaaaaaaaaaaaaagccaggtgtggtggcaggtgcctttaatcccagctactcgggaagctgaggcaggagaatcacttcaaccggggaggcagaggttgcagtaagctgag

SEQ ID NO: 20408 - DNA, 1410 bp, Homo sapiens
aaaggcagcacggcaatgcagggaagatacataggctgattgggggtgccaggagggaggacaggctcacaggctcacgctggccagggcggtgggcattcctatgggagtcaggtctgagtctccaggatggagaccactaggcccccaccactcctgcctgcatcgaacccatgaatctgagcgctggggctgggtgcggcggctcacgcctgtaatcccaactcttagggaagcagaggtgggaggacagcttgagcccaggagtccaagaccagcctggacaatatagcgagaccccattctccataaaaaggaaaaaacaaggacgaaaagaaaagtctgagtaccggggcccccgtctgctcccctcaccacttggccgtctctctccgcccccacaggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagac

SEQ ID NO: 20409 - DNA, 1052 bp, Homo sapiens
agcctgggaggggcaggcccccggccagaaatctgggcctttcgtggtcagaggacaccggcggcccctttgggatccacccccaatcaccaccaccttgttcttctctgaccctggatactctgggtgtccattttttggagccctgagaccctgtttgaagagggatccatctcagccctggttgtggggcgagggtcttgctcagcctgcaccaccctccaccctccagtaggacccagaggcagctgggctttccatggtaaagcccccatcccctgaggcttctcaggactctcagtggaggaggtgcctggggagcccagcagctggaggaaagggagtggccccagccatgcgagggagggcctcccccgcgttctggagtgggtggctgagcccagctggggtgggaggccctctgggggaacccctctggtgtagtctgggagtaacctcttgcttggtgctcgacgctctaccggtggaggtgggggtgggtctgggtgggagagacggccccaccctgcctgcagaattgaccctgagccatttgtcctccaaagcacctgtcacacgtggctcagagctgagggacctgaggtcacctggtctaactcaactcctcctcctttaggaggaaggaaccagagagaggaggggattggtccaagctcaacagagcagtctttctgctatttcaaggagttccttcttgtgaccccccctttctccacccaaaaccagcacctcccgggttctgccctctggtcctgcctgcgtccatgccctgtgtccgagtcccaagtggttcatgttgtctctgttctgtgcccgcagcctcggtgatccctctgctgccacactgggacccgggccctccacacccggctttccgcacccggcccaccacacccaggccctcagcacccaggccccccgcacccgtcatgctcatgtcccgtgtctagcccggagtccacaagcccctacgttccctctcagtcccacaggcgcagggaagtggccttgccccgcccccgatgactctg

SEQ ID NO: 20410 - DNA, 1031 bp, Homo sapiens
tagagagtcagatacaaagcatgaaatgaattatttaaaaaagaagaataggggccgggcacggtggcttatgcctgtaattccagcactctgggaggccgaggtgggtggatcacctgaggtcgggggtttgagaccagcctgaccaacttggagaaacctcatctctactaaaaatacaaaaaaaaattcgccgggcgtggtggcacgtgcctgtaatcccagctactcgggaggctgaggtaggggaatcgcttgaacccgggaggcagaggttgcagtgagcagagatagcgccattgcactccagcctgggcaacaaaagcaaaactccatctcaaaaaaaaaaaaagaagaagaatagggaaccagaagggctttgcaccaggtaccatcatgcgtcagcccatcgtgtccctgtcgtctttcccatccccagcctcgtttccctcttggagggtgaggtgcccctttggagaaccctggcttccccaggttcccctctgacacatgtctgctagtgatctcccctagagatggaattccaagttgggtccctgcagtctaaggactgggaaacggcagacagctgcctcccctgggccttggtaatgtttccgaaaggattcgcctgctttctggtgggagtgggctgctgagtagtcactggggcagtgaggaattggagtggcattgcttgactcttgccccatttgtgacggcatgtgctgatcccttgaatggagtgtggtactgggccactgggtcgagactactgggagacggggactatgactttgtctgcagctcagcattgccaagaaacatgacccgctgctccgggagttccaggagggccgcctactcttcccgcccacctacaagtttgataggaactccaacgactatgacaccaggtgaggagggagtggggggccagaaggtctaggaagtcaggttacactgaccctgctggcatgggaactgtctcagaatagaagtgttagggggggcaggaattggtctagtca

SEQ ID NO: 20411 - DNA, 1150 bp, Homo sapiens
tcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaag

SEQ ID NO: 20412 - DNA, 1116 bp, Homo sapiens
ccatgctgcacggacggtgtctgcttcaccatgctggtctagggcgaaaattgggtccagaagttcttcctctggaaccccgcagggaactgtttttaccatccagaatgacacttttcctgggctgactcactggtaagtggtgcactgagttggttcctcttgaagacagatgttttggttattcatttagctacatttagcagggaagtggcaggatttcattggggcacagtccctgattctttcgctaaggatctttaggaaggggtagacctcagtgtccaggggtctggtgattgtgactgtgtaagagaagcctgaggcttttggtcaccctagtcctgacaaaaagaaagggaaaatgttaacaaatgaggaaacatggagactttcattggagttttagcctggagcttcagccatccactgcctgacaaaggccagcatgacgtatgttggggttcgtggaagtatttgctgtccacctttcattccttcgggtagaactcaaattcttggagctagaagaactctccagaggatctactggatctgctttgttcagatccaaactttgagagccctcagtgttagagagttattttttaatctctcagacccttttgaaaatctttctcggccaggcacggtggctcacacctgtaatcccagcactttgggaggctaaggtgggcagatcacgaggtcaggagtctgagaccaacttggccaacatggtgaaaccctgtctctactaaaaataaaaaaaattagccaggcgtggtggcggacacctgtaatcccagctgctcaggaggctgaggcaggagaatcgcttgaacccaggaggcagaggttgcagtgagcagagatcatgccattgcactccagcctgggcgacagagcaagactccgtctcaaggaaaaaaagaaaaagaaaagaaaatctttctccattccatggagaatcatgccaaaagcttaggtgatcactgtcctccaggataactgcaaatagaagaaactctctttggaattagaattttaaaactcatctgcagtgggagagaaagcaagtccacctcattgtggtacatgttgtggtctcttcag

SEQ ID NO: 20413 - DNA, 1068 bp, Homo sapiens
cctgtcttgacgcatatttctagtcatttccagatgcctacataatccagtaaaactccttctgtgtagatcttctgatgtacttgtatatgcagatttttagcaaatattcctaaaattgaattcctagaattgctgggctggtagggtttttaattctgatatcgtgaaatcgatcgctagagaaattttggtacctctctttggatcaaaggcatcagcatttttaaatgaagcttgaactgatttgtgtactggaatccatatcaaactacacaaatttgctaaatccctaacgaaaacagtaatgtttcagcaaactgtgagcagacccaaagggcgttgatggtattaattatacatcagcttgagtggaagtcaaaccaagctagttttagaagctatccagaactggtaaaggtaaacctgaatctttttaaaaattgtgataaagtacacgtaacataaaattcaccattttaaccatttttaagtatacagttcagtgacatttaagtccatccacactgctgtgaaactgaaagctggatcttaatttctagtctctaaactgaactgaaatcaattgactttcatttggaaaaagccccacttcactgtggtctgtcactttgatggtgtcagagggtccaggacctcagtgccagggtgcgaggagagcagtgctgtgcagtggggaggaacctcaccatcacccagtctcctcgccagagggtccaggacctcagtaccggggtgcgaggagagcagcgctgtccagcggggaggagtctcaccatcacccagtctcctcaccgtcacccagtctcctcgccagagggtccaggacctcagtgccggggtgcgaggagagcagtgctgtccagcggggaggaacctcaccatcactcagtctcctcaccagcacactttttctccatgtctcgttttgctcctcctctggtatttgtatttcttaaagaggattttgaaaagagatggtgaagttggtattttaggtagaagggaccaattgtttcctcaagactaagttggtccaaccaaact

SEQ ID NO: 20414 - DNA, 1040 bp, Homo sapiens
gaacagatctcaagagcaaggaacatcatcgcaggtctgaggaggctagattcccagtcctgttggagttttttaaatctgatttaatgatctgaccctcccactcctatctctgccccatccgagtctggctgctttcccagggggcagagcagctgtgccaaaaggaactctaacgtgaaaagcgcccttcacttgtagcttgtgcaggccagtcttgcttacccctttagattaacaaaactgccttcacttgtctcattgggattaaaggatcagaatatcaagagagattgaagggggaagatgccagccaacaggctgatcctcttagaacctgccctctgattcctgcagctgaagagaaaccaaatgaaggcgattagtctctgcctggggtcccccttcccaagtggtaccactagctgggaacctcgccccctccaccaggccctctccccagcctgtcctttaggattgctgagtcagtggttagatgttcttacggctcttctctgaaacggagttactgctccttcttaggcacccctggctcagccaagccctgacccacctgacgggttttcatgtgtgcctagctgggtggtggacttggagaggcacagggacagcttggggctccaggggggcattgaggcagcactgatgcagcttaggattagcaaggtcaaggtgactggctttcacccatatgttcctctgtatggatttcactgagcctcgattgctgccccttttcatggcattttgttctgggattttgctttgaaagttagggctctttcagccttgtggtgagcagtgaattgtcctcgtcctctgcttcactttccagattttgcccagaaatttccctgcagtgcttaggaagctgcctggtagagcaggtttctaagtttgaggcgaagcagctctggaagctgcctctgtccttgctgttggaggcagtgatttaagtagcagttgcctagagatacatcctttctgttttaatctcaaagagagaaaaacccagtccc

SEQ ID NO: 20415 - DNA, 2074 bp, Homo sapiens
aattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgcttgaacccgggaggtgaggtggagcttgcagtgagccaagattgcatcactgcactccagcctgggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaatta

SEQ ID NO: 20416 - DNA, 1324 bp, Homo sapiens
tatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggcttttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggttatgtcgtgagcgcccgagtctcttgatctctaatgtcacattgtcgttttcctggcaggtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaagg

SEQ ID NO: 20417 - DNA, 1045 bp, Homo sapiens
ctcctgaccccgaggcccgcctcagcctcccagagtgctgggattacaggtgtgagccaccatgcccggcctttttatttaaatccaatttgacaatgtttgccttacaaatggtctaaatacctcaattaaggttaatgtaactatcaatgtggcaatgtagctcagtttaaatctaccgtcttactcttttttttttaaattattttttctgcttttctcttgtcctgccttcttctgaatttagttgttttgtgactttatctccacttttcacttatttggctacatggtttttttcttattgtttgctctaaggtttacagtatatacatagctcacttactgtgatctactttgaccattagtctactacggatcacttcacatatagtacaagaaccttagaataatacactttaagttccactcccactcttagtagtatttttgtcataacattttaattgtacatgtattataagtgctataatactttgttactctttttgctttgaacagcctttatcttttgtagaaattgcaaaatgagaaaaaatatttttttgcattttacccacatacttaccatttctggtgttcttcactagtttgtatagctccatctggtgtgcttttttttttctttttcttttcttttttttttttttgagacacagtcttgctctgtctcccaggctggagtgcagtggtgcgatctcagctcactgcaacctctgcctcctgggttcaatttctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctg

SEQ ID NO: 20418 - DNA, 2121 bp, Homo sapiens
cttaggctggcctcaagctcctgagctcaagcgatcctccttagcctcctgagtagccgggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggcgtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataacccccacgaggcgctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccgctgcttgtttacaagtggtgtcaaggtagaactttcatgagatcgccctgtgaggaacggggcaggaatttagttctacgtcaaaaatctcatctgggtagcatgattggtttactctcttgatgcgtggtagtaaagggaagtagtgttcgtgttaaactgaggaaaagcccatagtcaaagcaatccaaatgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctacttgggaggctgaggcaggagaatcacttgaacccgggaagtggaggttgcagtgagctgagattgcgccagtgcactctcagcctgggtgactgagcacaactccgcctcgggagtggaaaaaagtagaatttgctgaggggagaacaaaagaggttaactctggagaatcctggggcatggc

SEQ ID NO: 20419 - DNA, 1085 bp, Homo sapiens
acagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgcttgggatcgtagggccctgtagggaagggtcctggctgtggcttctgggctgccggttggcgagtctggctctttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtatgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggt

SEQ ID NO: 20420 - DNA, 1022 bp, Homo sapiens
ccagctgaactccctgggaacaagtcagttgggctgatcactgaactcacatttctggacctgaggtaccacacttctagtacctgcgtgctggtggggtgtgtccagggtcccgggccccaccctgtctgaatgctgaggaggctgggcccccaggggccgctagggcaggggagggtgagagcaggactgggtttctctagactccagttctggaaagaagagcaagggaagtctgtttacagccacctcttgctgctcagcgaggttaacagcttccgcgggcccagatcagagctgcagccctgcattagaatctcagaggtctactggggcaggaccctgatggccagcgagtgggtcagcgttgcagcaacatgccctgctcagatctttcccattttccctccctttcccttaggagcctgttcctctcacgccctcacctggctgagccgcagtagttcttcagtggcaagctttatgtcctgacccagctaaagctgccagttgaagaactgttgccctctgcccctggcttcgaggaggaggaggagctgctttccccatcatctggaaggtgacagaaatgggctgggaaggtccgaacagcagggtggatgatacgttttgggcaagttggagagcctttgcccagattggcccagcaaggagcggttttagattagagacactggctggattgaggagtagaaggctcaaacaacccaaggttagttggtctttgtgtgacagtgggaagaagtggagagaacactctgtctccccgacttccttcttgaccctccttccgtatctttcattcttccccactggcctttccagatgaggtccaaaagtaagctcactcttcagggaaaagtgatactaaacccaggcgtgaggagtcatccttctgctcttacttttccctgcatttccttaggctggcccagactctagattcctgggcacttacctgtatctgagacccttagacctcctgtctcagtttctccacc

SEQ ID NO: 20421 - DNA, 1057 bp, Homo sapiens
aggcgtgagccaccgcgcccggccctgagttctatttgttgtcaagcctgaaaagagactccttttctccaccagacctctccaaactggcgagtagaatacagacagtatgagaactggaggctgcaggggattctaacaatgctgagggtatggacgttgctgtttgtggttcagatttaagagacagaaggcagaaggtagggatgatagctgccttccaccaggatgtgtagcgacagcccagaccccgttccagtcagaaggttacgggattctctaggtcggaaccctggttgctgtgttaccactggtgccaagtagttgaggtgcattcgtggaaaagaatgccagatccacgctgcttttgaaagcttgcccaccctcaccatgcccaagtgcccgttggttgccattgcattatgatcaggaaatcagtagccccagagatacctggcaatagctttttgagaatctggaatacagttagcactcaaacatttgtagaatgaagggcagtagaattatcatttctcctcctgtctaataactgtgacaagggagtggccggtgactttttttggtagagctttttcaagaaaaagtttagtcctacggacagttcggtagttattctacttcagacactgggcatgtttcatgttcttcaaaaagcccagttatactttggttttttgttgtttgagacggagttttgctcttattgcctagattggagtgcaatggcgtgatctcggctcactgcaacctccgcctcccgggttcaagtgattctcctgcctcagcctccccagtagctgggattacaggcatgtaccaccacaccctgctaattttgtatttttagtacagacggggtttctccgtgttggtcaggctggtctcaaactcctgatctcaggtgatccgcccgcctcggcctcccaaagtgctgggattatagccatgagccaccacacccggctgtactttataaaataggcatacctccttacaaagaatatgttcagaatctttacgtatcgggtccatttcc

SEQ ID NO: 20422 - DNA, 1025 bp, Homo sapiens
ccctgtctctactaaaaatacagaataagctgggcatggtggcgtgtgcctgtaaccctagctacttgggaggctgaggctggagaatcgcttgaacccgggaggcggaggttgcagtgagctgagatcaccccactgcactccagcctggacgacaacgagagactctgtctaaaaaaaagaaaaaaacccttgtatgtatgtcatttttcatatataactgtaggataagtgattgtatctgtaggattaattcctagaagaggaattgcctggtcaatggatattttatatgtatataagatatacatacatatagaattttgacatatattgctaaattgccctccataattatgaaaccagtgtacaccctcactaacagcataatgaggatacccatcatcccacttcttgaccaactctgtgtgccatcaattttattttgctttgcctgataggtaaaaaaatggcatttctgtacagttgtaatctgcattttattgattgtatgaggctgagcattttttttcacatatttagtagccatttttatttcctgtgagaattgtccatatcattgcctattttcctgttgatttactggttgtcatcttagtgatctgtaggaaatcttgacaaagtaaagaaattagctctttgcctatagtataaattgcagatattttttccagttcagtgttcgccttctgcttttattggtttttggtgtgaagatagtttttattttcaggcggtcgagtttattaacctttgataacttctgggttttgtgtcagagttagggattcgtccagcaatactttacatgctttctacagttcttccagcacttctatagttttgtttttacattaaagaatttcatgtatttgttgggaggccgaggcgagcggatcacgaggtcacgagatcgagaccatcctggctaacacggtgaaaccccatctctactaaaaaatacaaaaaattggccaggcgtggtggcgggcgcctgtagtccc

SEQ ID NO: 20423 - DNA, 1058 bp, Homo sapiens
agtagctctcagcaggttgggagccagaagggagatggttttcccctggagtcaggccactcagaggcccacctctttaccagctgctctggccaaagtccgtgtccttctgcactggtcgatggcatgccgatgcctgtcggctgctcttccgccggcatactcctgacaacatccagctgcttatgtgtctgcctgctagggtcttgggtttttataggcccaggctggggggcgtggcaaaccagggtggtcttggaaaatgcaacatttgggcgcgaaggcgggagtgcttgtcctcacctgggtcagtggacacaggcccaagggtgaagccctacccagggacccgcctttctctacacagcagttccctgcccccctcccatatcagtcccagccagtcaggaggctgaggcaggagggtcactgagcccgggagttccaggcttcagtgagctgtgatcactgcaacatttgcctcccgggttcaagcgatcctcccaccttagtctcctgagtagctgggattacaggtatgcggcaccacgcccagctaatttttgtatttttagtagagatgggttttcgccatgttggccaggctggtctctgcactaccctgggtgacagagtgagaccctgactcaaaaaaaaaaaagtaatttatgtgttctgaatttcttcaagaaacttctatttccatattccttccgataccctgtagcagtaagcttatgggcccctcgcctgccttgcccatgtctgtcagcccttgttgaactacatgccatttttgtctgaatgtctgatgagactgttagcttgatagaattagtaatctattattcttggctgggcacagtggctcacacttgtaatcccagccctttgggaggctgaggcaggaggattgtttaagcccaggagttcaagaccagcctgggcaacatagcaagaccccatctgtaaaataacgtataaatgggccggacacagtggctcacacctgtaatcccagcattttgggaggccgaggtgggtggatcaggagattg

SEQ ID NO: 20424 - DNA, 1117 bp, Homo sapiens
gtggagtgccgtggtgtgctctcggctcactgcaacctccgcctcctgggttcaagtgattctcttgcctcagtcccccgagtagctgggattacacacacgcaccaccacacctggctacttttttgtatttttggtagagacgggggtttcaccttgttagccaggacggtctcaatctcctgacctcgtgatccacccgcctcggcctcccaaagtgctgggattacaggcgtgagccaccgcgcctggccaaaaaaaaatttttttaaataagcaaaattctggtttatactacaacatgatgtaccttgaaaactttttgctaagtgaaataagttagacacaaaaggaaaagtaatgtatgattacatttacatgaaatacctggaataagtaaattcacagaggcagaaagcagaatggagtttgccaggggatgtggagagggaggaatgaggagttatggtttaatgggtagagtttcagcatgggatgatgaaaaaactttggaaatgaatagtgctgatggttggataatatgaatgtatgtaatgccagtgaactgtatgcttaaaaaatggtttaaataggccgggcatggtggctcacacctgtcattccagcactttgggaggccaaggcgggcggatcacctgaggtcaggagttcaagaccagtgtggccaacatggtgaaaccccgtctctcctaaaaagacaaaaattagctggtcatggtggcaggtgcctgtaatcccagctactcgggaggctgaggcaggagaatcgcttgaacccgggaggcggagattgcagtgagccgagatcacaccattgcactccagcctcggtgacagagcgagacttcgtctcaaaaaaaaaaacattagattgctttttccatcttactacctcaattttttttttttttttaaggcagggtcttgctgtgctgactgggctggagtgcagtggtgtgatcgtagctcactgtagccctgaccttctgggctcaagcgatcctcccacctcagcctcaatttttttatcataatattccagaagacattaaaaaaaaaaaaaaaagaatcggctggatgcagtgactcacacctg

SEQ ID NO: 20425 - DNA, 1035 bp, Homo sapiens
tggcgcaatctcggctcactgcaagctccgcctcccaggttcatgccattctcctgcctcagcctcccgagtagctgggactacaggcgcccgccaccacacctggctaatgttttgtatttttagtagagacggggtttcaccatgttagctaggatggtctcgatctcctgacctcgtgatccacccgcctctgccccccaaagtgctgggattacaggcttgagccaccgtgcctggcctaaattttttttttgtagagacagggtctccttctgttgtccaggctggtctccaaggcctgagctcacacaaccctcccacctcagcctcccgacgtgctgggattacaggtgtgagccaccatgcccagccaagtacgtggctttgcagttagaccttcctgctcagagcctcagttctacctctttctagttattccttcacctctttgaggctcagcttcctcatctataaaactgaacaaatagtagcgtattactccgttttcacactgctgtaaagaaacacccgagactgggtgatttataaacgaaagaggtttaattgacctacagttctgcgtgactggggaggcctcaggaaacttacaatcatggcggaaggggaagcaaacacatccttcttcgcaaggcgacaggagagagagcatgtgaaggaggaactgtcaaacacgtataaaccatcagatctcatgagaactccctcactatcacgagaacagcaagggagaaactgcctccatcatccaatcacctcccccttcgacacatggagattacaataagggatgagatctgggtggggacacagagccaaaccatactgagtagcatctaccttgcaggatgtttggggtaagaggtcgggtaatgtacacaatgtgccttcacagtcactggcacgtggtaagatcttagtcaagggcagccgtcattaatatactgcagaagtgtgagtgattatgtgtaggctcgcttctctagggagagggtctcctacagctttcatgag

SEQ ID NO: 20426 - DNA, 1182 bp, Homo sapiens
cgagactctgtgtcaaaaaaaaaaaaaggaagaaagaaaaataaaagaaaaaagaaagagaaggagagagagagagagagagagagagaaagagagagagagatggtcttgctctggtgtccaggctggagtgcaacagtgcaatcccagctcactgcagcctccacctcccgggctcaggcgatcctcccacctcagcctcctgagtacttggaaccacaggagtacgccaccacaccagccatgagccctgtggcctctctggatgtaccagtgactgtcctttctcaatggaagcttcctcctcatcagaggaaagggcttggtagggagggcctaattgcaaaggtcagtggccaagcccttcacctctgagtggagtgattaaaccagagccaggttgaaatctgggaattaccttttttctccagacttgagttcatctgtaaaatgggcctaataacagtgcctatctttagagttgtgaagattaaagaagacaatgcttataaagctcttggtggccggatgtggtggctcatacctgtaatcccagcactttgggaagccgaggcaggaggatcacttgagcccaggagtttgagaacagcgtggacaacatagtgagaccacatctccacaaaacgtgaaaaacattagccaaatgtggtggtgtgcacccgtagtcccagccactggagaggctgaggtaggaggattgcttgagcccaggaggtcgaggctacagtgagctaagatcgtgccactgcactctaacctcggcaacagagccagaccctgcctcaaaaataaacaaataaataaaaatttaaaaagctcttggcactatattgtggcctgacccagaacaggagctcaatgaacgccgccattcctactgctagcagcggtggtaacttccttccaggcatgctccatgtgccggccttagctacagcccacatctcactgccctttggagttttgcctctctgcctccagagctgtgtgagtgatcaggacagacacatgccagccctggccaggggcaggaaactcaagaccagcagggacaggtcacgtagggtggagggggccaccctgtttgccaaggactatccttgctctgtcctgaaccctctgccctctctgcccagggccagggagaagtcccctaaggcg

SEQ ID NO: 20427 - DNA, 1056 bp, Homo sapiens
tccctgcctccaccctccccgtcttccttcccctccccatgtggcctggccagaacctcttaaatccaggcccttagacctaagggaaggctttctgctcttcaacagtagaacagtttctgtcaccaaggcagggcagcagaaccatcacgttgtcccaggctttcccttctcctcgctggggcgggctgccttgccgggtcatatgtctctctgctttcctacccaggagcttttcaggggaaagaaagtgttttgctagatggtcaggaaagggtacaactgaaagaggctgtggacatctcaggagccccctaagagccgtaaggtgcctcagacgccgtcccaggctgccagggttttttgtcaccaggactgatcgtaccccaggctgtgggctgagtctccttgttcttgatccggtgaaaggcaggctgtagcccttggccctgaggagcttagggtttagtaaggaaatccggattcggtggggagggagcaaacgcatgagaaaacccagcagatacatgcaggacaaagagacgacgcctaagggtgctgggaactgacagttgtgctacagccatacaggccagcctctctggacctgcctcagctgggcaggctcctggactctcccagaggctgtaagaggagggctcctgtttactgatgctttccttggtagactcacgtcctgtgcccagagcagcaaagggttaagccgccagctttcccttcttgtttctggtgctctttaacctgctctgtgctccgcagacctgaccccagcgtggagaagccccgcctggtgcagaagcacaaacaagcttcctctttgaagcctgtttagtttggaagcaggaaagcagattttgggatagaatacccgtttttcctgtttgatgttgtttgctgtaccatacacccatctaccactgcttcccaacctcagccatgcactgtgtggacactgcagcctcagggtgccgaaagcatgggcattgtgtgtgtgtgtgtgtgtgtgtgtgtgtgtgtgtgtgtgtgtattcccac

SEQ ID NO: 20428 - DNA, 1069 bp, Homo sapiens
atgggtttttctttctagaactttccctgccctgaatttgttcagtatgcattgtcacttgtgaggacttcttttcacaataaatacccaagtgctttagaatgtctggatggtggccaggcacagtggctcaagcttgtaatcccagcaatttgggaagctgaggcagacggaacccttgaaatcaggaattcgtgacctgcctggccaacatggtgaaaccctgtctgtactaaaaatacaaaaattagccaggtgtggccgggcgcggtggctcacgcctgtaatcccagcactttgggaggccgaggtgggcggatcacgaggtcaggagatcaagaccatcctggctaacatggtgaaaccccgtctctactaaaaatacaaaaaattagccgggcgaggtggtgggcgcctgtagtcccagctactcgggaggctgaggcaggagaatgacttgaacctgggaagcagaggttgcagtgagctgagatcgtgccattacactcctgcctgggctacagaacaagattccaactgaaaaaaaaaaaaaaagaatgtgttgatggtgattctcctggaagtcaagcctgctttctctgtgccatcacagaggtgttgctggcagactaatcttgagacgacttcttacctctttgcaccaaggctcttattaaggggtctttcctgactttagatccggtgatgagttagcccaaaagagtgtgctcagtctcctatagggctcacaggtttggcttataccctccaagtggcccaatgggagctacagggtgttggaggtggtcatgggaaagaaacagctcacaagaagagcgtggggcgagagccagccgttccccactgcctgctggagcaagctcagtgaggccgctgacaagagtcctcagaacactaaacaggtgattaaaacatcagtataagtctttccaagcttcacagaaagccaaaaacttagtttggacagcaacagaaattttccgctctgtagctttataaactggtccgctgtttcttcctctgctctgtggccagaggggagctctgt

SEQ ID NO: 20429 - DNA, 1065 bp, Homo sapiens
ggagacggaggttgcagtgagtcgaggtcacacctctgcactccatccagcctgggcaacagaacgagattctatgtcaaaaaaaaaaaaaaaaagctacattgagccaggcacagtggcccatgcctataatctcaacactttatcagtctaaggcaggagaatcccttcagtccaggaattcgagaccagcttggacaacatagtgagacccccatgactacaaaaaaattaaaaaatcagccagacatggtggcctacacctgtggtcccagctacttgcagccgtgcacggcaaggctgcagtgtgccatgtttgcaccactgcacttcagcctgggcaacagagcaagaccgttgctcaaaatttaaaaagacaaaaaaaaaaaaaaaagctatctagatttagcttttatatttaggtctatgagacattggaaataaatttttttttgagacagagtctcactcttacacccaggctggagtgcagtggcacgatcttggctcactgctacctctactccccaggttcaagtgattctcgtgcctcagcctcctgagtaactgggactacaggtgcacaccactatgcttggctaatttttgtatttttagtagagacggggtttcatcatgttggccaggctggtctcttaactcctgacctcaagtgatctgcctgcctcagcctcccaaagtgctgggattacaggcatgagccactgcgcccattcctgttgttttgttttttgagacggtcttgctctgtcacctaggctagaatgcagtggcagggatgactcactgcagcctcaacctcccaggctcaagtgatcctcccacctcaacctcccaagaagctggaactataagcaagcaccaccacacctggctaattttttaattttttatagaaatggggtctcactatgtttcccaggctgctcttgaactcctgaactcaagtgatccccctgccttggcctcccaaagtgctggaattacagacatgagccagtgtgcctggtcttcaaattaattttgtatatggtgtaatataag

SEQ ID NO: 20430 - DNA, 1869 bp, Homo sapiens
tgccctgggcatcgctgctgctgccagcgcccttcacccatgcttcagcatggtgcctatactcacttcctgcaggagtctgctggatacctgcagctggagcacaggagagatttcagctcttctgggagtaggaagctctcctttgacactcgttccttagtgtgctttctggaagaccatgggtttgctactcagcaagcagaaatcattgtgtctgcattggtccaggtactggaggccaacgtggacatcgtctacaaagatatggccaccaagatgaagcaggagatcgctcttcagcaaataatgtctcagactgtgaatgtgaaaaacgatatgattactttggagaagagtgaattttcagccctcagagcagaacgtgagaaaataaaactcaaactacatcagttaaaacaagtaatggatgaagtgattaaagtccgaacagatactaaattagacttcaacctagaaaagagcagagtaaaagaattgtattcgttgaatgaaaggaagctgctggaattgagaacagaaatagtgacattgcatgcccagcaagattgggccgtcacccagagagataggaagatagaaactgaggatgctggccccaaaaccatgcttgagtcatacaagcttgataatattaaatatttagcagggtctatatttacgtgcctaacagtagctctgggattttatcacctgtggatctaataaagtgtctatttaaagagggggggaaaaggatttaccatttcaaccatttcttaagtgtacaactcagtggcattaagtacattcacagtgttgtgcgaccatcactactatccatttccagaactcttcatcattccaaacgccgtaaccattacacagtaactcctcattcccccttcccctggcaacttctactttctagctctatgcatttccctattgtaagtatctcatataagtagaatcatgcaatatttgtctttttttttttttttttttttttgagacaaggtctctctgtgttgcccaggctggagtgcagtgtcaccattacggctcactgcagcctcgaactcccaagcccaagggatcctcccacctcagcttcctaagtagctgggaccacaagcacgtaccaccacacccagctaattatatgcacgcgtgtgttcacgcgtatatgtgtgtgtgtgcatgtgtgcgcatgtgtgcatgtatgtttgtgtctgtgtgcatgtgtgtgcgtgtgtgtgtaaaaatagggtctccccatgttgtcaaagcttctcttgaactcctcagcctcgagtgatcgtcccaccatagcctcccaaagtgctgagattactggtgtgagtttccacctttgatgcacaaaagtgtttaattttgataaagtccagtttgcttttttttttttttttttgaaactgagcctcactctgttgcccaggccagagtgcagtggcttgatcttggctcactgcaacctccacctcccgggttcaagtgattcttgtgccccgcctttcaaatagctgagattacaggggcccacctggctagtttttgtatttttagtagagatggggtttcaccatgttggccagtctggtctcaactcctgacctcaagtgatctgcctgcctcagcctcccaaagtgctgggattacaaatatgaggcactgtgtctggtctgcttatttttttcttttgtttcctatgcttttgatgtcatatccaagaaatcattgccaaatccagtgtcataaagattttcccttatgctttcttctaagagttttctagttttagctctttttaggtctttgatccattttgaatttgtttttgtatat

SEQ ID NO: 20431 - DNA, 1062 bp, Homo sapiens
ctgtagtcccagctactcagaaggctgaagcatgagaatcgcttgaacccaggaggtagatgttgcagtgaaccgatttcaccccactgatcagcctgggcaacagagcgacagagagagactgtctccaaaaaaataaaaatataaataaataacataaaatgctaactataatataacgcatcctgagctggcatgaaaacgagaaatctgcagatcttaagaactaaatgaacaaaagatttctgaaaagtaagcgagtgccaaagctggctggtgcttgccctgatgatttctgtcaagccctggaagctttgggcttactcactaaaaactgcttggactatggtgagcgggcctgaaagcgtggggtgcgccctaggtgaggaatgatgtaggaggccctgcctaaagctgggattccagctttaggaaacctcatggtgagcattttacgaccatgagctaaccctcacctgagttttgagtctgaattcatactacctatgtactctgaaaaaccttgagcagcagatggtttaatttaaagtgatctctgtgtctgacagtgtcccagggtaacccgcagaagcaaagacaagtcctctctggaaaaaagcagcttctactcaggccacaaagaattcccgtggatacagttccatggaaatcagcccacagcctttaatatacttaaagtaaataattatcattcccaaaaaagctaccttgtaaaggataaacaaaggtgaccaggcatggtgggtcatgcctgtaaacccactacttagggaagtcaaggcaggaggatcacttgagctctggagttccagacccgcccgggaaacatgatgagaaacccatctctacaaaaagatttaaaaattaatggccaggcgccatggctcacgcctgtaaccgcagcatgttgggaggccgaggcgggcagatcacctgaagtcaggagtttgagaccagcctggtctcgaggtcaacaaggcgaaaccccgtctctactgaaaatataaaaattagctgggcgtgatggcaggcacctgtaat

SEQ ID NO: 20432 - DNA, 1008 bp, Homo sapiens
atccgcccgccttggcctctcaaagtgttgggattacaagtatgagccatggtgcccagcttttctctataaatttgactactctgtgaacctcatataagtggaatcataaaatatttgtccttttgtgattggcttatttcactcagcataatgatttcacgttttatccgtgccgtagcacgtggcaaaagttcatttctttttaatgctgaataatattctgttgtatgcatacatctaccacaatttgtgtgtccattcacctgttgatggacacttgggttgcttccactttttggctgttgtgaacgtaaatgtacaaatatctctttgagatcctgctttcaattcttttgggtgtatacccagaagtagaaagtagaattgctgaatcctatggttgctctatgtttaattattttattttattttattttattttttgagatggggtctcactctgtcgcccaggctggagtgcagtggcacactctcagctcactgcaacctgcacctcctgggctcaaacgatcgtcccacctcagcctccccagtagctgggaccacaggtgcgcaccaccacacccagctaagtttttgtgtttttggtagagatggggtttcaccatgttgcccaggctggtgtcgaactcctgagctcaagcgatccacccacctcggcccaaagcactgggatttaaggcgtgaggcaccgtgcccggtcatctgtgtttaattttttgaagaatcgtcatacattttccacagcggctgtactattttacatcctcaccaatagtgcacaggagttccagtttcttcacattctcacaatacttttgttttttagtaacagccatcctagtcggtgtattggtgtgaagcagtattgcactgtggttttgattttgcattttcctaatgacaagtgatgtcgaacatctttttgtgtgcttatttgttgtgttcattttaaatgtataatttctcctttctcagttgatt

SEQ ID NO: 20433 - DNA, 1011 bp, Homo sapiens
ggctatcctcatcattttattgttaatgacatgaagagaaactttattttcacatggatactttatgttttttcccttacccactgaaaacatgacagatttcttggttcattcgccgtggctcacgcctataatcccagcactttggaaagctgaggcgggcagatcacctgaggtcaggagcttgagaccagcctgaccaacatggtgaaaccctgtctctactaaaaatacaaaaagtagccgggcatggtggcgcacacctgtaatcccagtaatcccagctgctaggggtgctaaggcaggagaatcacttgaaccagcaaggtggaggttgcagtgagctgagatcccaccactgcactccagcctgggtgatggagtgagactccatctcaaaaaaaaaaaaaaattttttttctcagagtatactttgttttttttgagacaacatcttgttttgttgccagtgctggaatgcagtggctcactgtggcctcaaccttctgagctcaagggatcctcccacctcagcttctgagtagctgggaccacaggtacatgctaccacaccccgctaatttttgtatttttttgtagagatgagatttcaccatgttgcccaggctggtcttgaagtcctgagctcaagcagttcacccaccttggcctcccaaagtgctgtgattacagccaccatgctgtccttatactttttaattagaggttagcaggtgtttattattaacaatagtttcagtattcatttttattaagttctgtgcacattaatcccttccagccagcaggcctctagttagtctaggcctctgatttcagcttgaatatacactttgctcttttggagaaacagagacctctgcctaagtgaaacaggacatgtaaagggaggaggaataccaggctgagatttcatacctttgtaatctctaaagaaggttgtattgtctctacaacaaggaaaaagttgaaggacaaagggcataaaat

SEQ ID NO: 20434 - DNA, 1003 bp, Homo sapiens
ttggttttatgtttttggagggtttttttgtttgtttgtttgagacagagtctcgctgtcacccacactggagtgtagtggcgtgatctcagctcactgcagcctccgtctcctgggttaaagcaattctcctacctcagcctctcaagtagctgggattacagctgtagcatgccaccacacacccacctaatttttttacatatttttagcagagacagggtttcaccatgttggccagactggtctcgaacttctgacctcaaatgatccacccgcctcggcctcccaaagtgctgagattacaggcgtgagccactgtgcctggccatagttttaatagtcattttcctgaataatgatgagcatctttttatgagtttactgacaattattatatcctcatttgggaaatgttctaatctgttggccatttttaaacattggggtgttttcttattgagttataagagttcttcaaatattcttgacacaaatacttgtcagatatacatcctgtgaatatttctcgtggtctgtgactggtttgccttttttttttttttttaaacatagtcttgaacagcaaactttttttttttttttttgaaacagggtcttgctctgtttcccaagggatcctcccaccttagcctccccagtagctgggactatgggtgcacgccaccacacctgtctaatttttgtaattttcgtagagccatggtttcgccatgttgcccaggctggtctcaactcctgatctccagcgatctacctgccttagcctcccaaagtgctgggattataggcatgagccacggcgcttagccttccggtggaattttgactacacagtagggacttccacttttaactgtttcaaatactctagaattgccatcatttaggacaaaggcttttgaaggtttgatgttttcgtgggctattttttgtgatatcattattgtcagtgacaggaaaaatgaatctttagctgcct

SEQ ID NO: 20435 - DNA, 1047 bp, Homo sapiens
gtcctgccttgatgcttattctgcagatacttacgaaacacgtattgccaacacagcctgggagatccagacacataaggcaggtatcttcctagttcgagagacagtttgtgccatatataaagatgtgagtggcaccataagtgaatttgaagagttcttgagttttgttgagctggtaataccccggtgaaggcgtgcttcaagagcactgatttggcattaacgtaatcattgtatctttgaagcagaaaagttttcaccttatatgcctttgagtgcaaatactctctttgttctattcttttcttcagtaatttctgctgtcctgatacattagatctccattctttgtcctatatgtcactttttctgtcatcactttaatctgtttttgcttttcttctgcattctaggaaggtttctcaagtttgtcatcttgatatatttttatagcattgattctactctttactacttctagttcaggttttaagtcttctattgcattatttgttctcttacattatatcttataacctttattttttttgcctgccttttagtcagtccctttatatctttttttttttttttttttttttttgagatggagtcctactctgtcgcccaggctggagtgcagtggtgtgatctcggctcactgcaccccctctgcctcccaagttcaaacgattctcttgcctcagccccccgcgtagctgggattacaggggcacgcgctgccacaagtagctaatttttttgtatttttagtagagacggggttttgccatattggccaggctggtctcgaactcctgacctcaaggtgatctgcccgcctcagcctcccagagtgctaggattacaggcatgagccactgtgcctggcctcagtccccttatatctgtctttgctttttcatttttcatttagcatacttcacagagtctataatttgaagaattcagttgaaggtcaggagcagtggcccatgcctgtcatcccagcactttaggaagtcaaggcagacagatcacttg

SEQ ID NO: 20436 - DNA, 1387 bp, Homo sapiens
caatctcagctcactgcaacctctgcctcccaggctcaagtgatcctcctacctcaccctcccacatagctaggactacaggcacccaccttcatacctagctaatttttgtattttttatagagatggggtttcaccatgttgccaggctggtctcaaactactgaactcaagtgatttacctgcctcagtctcccaaagtgctgggattataggtctgcgctaacatgcccagctgtatatactgtttgtaatctgcttttttcctaacatttttaatatattcttatatggaatcatttttatagttacccagaattcttttatattccaagatttctttaaccaatctttgctttattgaaccaagagaatgttcccaatttttttacagttatgaatagtgtatcaatttcttgtagcagaatttgagcatatattccctttggttaaattgctgtaagtagattaaggttctagacattgatatatcaaaaactcatactctttggatgcacttaatggctactacatcttgggaatcagagaacccttctttcccaagaggaatacttactttttgcctttccaacaaaaacgtagagtgaaattctgctcttctagtctcagaatgggaaaataatggggatttgtagtatgtgaggctgaggacagctaacaagttgttttatacatgtggaagatgttgagttagaagagagactggatgacatggcttgggccagaggatccccatacttttctttggtgatcacaaggtggtcttgattccagaggatgctttggggagttcgctattgaagctgtcttttagtgtgggacaggtgctgagtagaagagtcctaacgagcttcagactcttcctacgccccatcttcatcagctctctcagctctagtgtcagataccacgtatgtgttttggctcgaggagaacacagagccagcagaccagccctcagcctatgtagtgatccacaggctacctagggggcagtggcggctcagtgagactaaggtaggtctccacttcaacgactgtgaaataggtatgtcaaacctaacatgtccaaatccaaactcctgaatcctgccccacccgctgcccgccaacctggtcttcctttacccttccccatcttggtaaatggcagccttgatttttgggctgcttgtgtcaaaatgcttggggttattcttggcacttctttgtcacacttccatatctaatccatcagcaggtaatgtcttctttaccttcaaaacacacacagatacaattctgtcttcccactgcaccctggttcagttctctgaaatgccttctgactggttgctctggttccttcccccttctactcttcagt

SEQ ID NO: 20437 - DNA, 1082 bp, Homo sapiens
ttaaatacaaaagtaagatgtattcattatgggagaaatcttttctttctttacagtgctctttgtaaagtatttagaaaactcagcaaagaagaacaaataaaaaattacccatattcctaccacctagagataactccaccgttaaaatttggtaaaattttttcaatttttttcctacatatcacatacacactttttttctattgctttacaactattttcatttaatatgtttggaagtttctctcacatgattaaaaaatgtaatacaacttaaaaaaactagtattcaattgtgtgcatgttccatcttaatcatctattgttgggcactttagattgcttccaatttttggcgattataaatgaccactttttgtatgttttctctgttgcttctcttcctgctttattgctgagactgctgtttcttcttggctataattttataattattacataagtattatccagaaatccttataaaagtataacattaaaactaagagtaaaatttcttttaactctgtgccctccaaaaagatagtagtagacatcagggcgtgtattcttccagacctttcactcatctacctacatacttacgtacgtgtccatcagtaatgcggggtgaagcaaagattatttctcagagagaaagacataaaactacttacaggtagtttgaggccagaattagatagcattttggttacaaaactggaaaccagaaaccacctactgagccctgaggagggttcctctctttatctgtgcctcccgtggttactgctgaacaaggctggttttgcatgaatagatccaccttctctcacatctcacatttgaagttactctaacttatatccttctgctttcagttttttcttttgttttaatcatgttgaattagttggaaggcaaagggagaattttttttaaaaaactttttataaaaaggaaatgtggacatttgacctggtgctcgttcaagacttcagtctgacccagagagtgttaatggatctgtttccaattcctactccagggaagaggcttcctcagacacagcttcgaag

SEQ ID NO: 20438 - DNA, 1020 bp, Homo sapiens
gctgcgcttccaggcatggtctgctctgtgcctggtgctccacactgcgtcagcagagactcgaatgcctactatgtgcaagataagtctcttaactcccagcactagctgacgagaggttcagagctttagaggaaatattcagtgccaaaaagagtttgtttttcaccacttactagttacaagatcttgagagtaaacaagtcagagctgctgcgggcttcaactaacctgatcagtggtttaaagatatggtctctgaggtccattccagtccttatgttctgtagtactatgatttgtttttttttttctcatttccaccctgtcacatggcttagttttttggttttggtcttttgctcctgggttattcgtatcttgctcgttttttaaaaataagaggttgagaaaaactaacctggattgttttctgcagagaatgttgtctagcccagctgtgttcctcagcatctgagggctgagtcctgctcggttagtcaccgtctgagtcagtcctgggcctaggtcccggtgttgtctgaaagattggtttcttgaaactgccattcaaatgaaacaaggtgtctctagagatcacatcacaaggcagccactttagtcagtgacacacacagcccgaaaacgatggtatcttctgaggttttaaaggatagggacagagtcatctcggattcgggagaagtactcagtcggggtgccatatggctcctgacagaccctttcctggtgagaggcagatcacacctgcacttggactccactgagagaggttaggaagctggcagcctataggctctgaatttgtgacaaatagtatgcttttgcttcctcttattgccttgatcacagttaccactttagcttttacttgcttgcctagtcatgctatttgcatagcttcgaagtctcttggaattcaaagactgatatatttattttgtacttttaatttttaaaaatataatgtttgtgtctgatttgctttttaaattaaca

SEQ ID NO: 20439 - DNA, 1030 bp, Homo sapiens
taccattgccagcattttctccaagccactgtgactattcctgcaacatgcttggtgctgattgtagcaaataatgtctttagacaagagaaatgccattgtatatttggccaagctcttgtcaaaccttccttctccttggcctctttgaatgttttgtggttcagtctggactgtaccatagaagctcctaatctctgttatccaaatagaatgtaatacgtgtctgtctgttttcctttttctctatcttcacccaacaaatgattttgtttaccttgttctctctccttttgctcttcttccttctgttacatatcattatctattttatttatttgcataatgtcttttttcaggacttgttcaggtctggagaatttaatgcagttgcccctgagtttttggagtagaagaccatgttctgggctcagtgcttaagtagactaaagtttacctgttctgttgtgccagttttgtgctaggattgtaaagatgaatacactattgttactttctctgattgtgtagtctagtgtataggtcagcaaactttttctatgaagggccagatagtaaattactttatagggcatatgttctttgttgccaccactcacctttactgttgtaccaccaaagtagccatggacaatatgtaaatgaatgagcatgactgtattccattaaaactttatttacaaagacagatggtggattgaatttggcctgtgggcctagtttgccaacttctgttccagtggaagaaatggttacataaatagaatacagtaaacagttgattcttgttatttgtggtggttatgttctatacattcaataaattcaccacaaacactgaattagtgaatagtggattgttgctcctaagggaaatacagaattacattccttcaagcctctgatcacaacattttaatcaactggtcaatatataaccttgctttttttgggtttttttttttgagacacagtctcactctgttgcccagggtggagtgcagtggcg

SEQ ID NO: 20440 - DNA, 1081 bp, Homo sapiens
gttagcattgaagggtgcatgaaagctctgatcagcctgtgtttggcttaaatgccagtcattggtggaggtaaaggatgaacccgtgtttcagcatctacactccaccattaattagcattgtcagttcttagaatgagtctgaatctgctagtttggtttgccttctttcagtttaggcaattgtattcctagactatgaagatttttgtttttcttacttggtccccagatgtcagtattgaatatggtggtgaggcgtgaccctggcaacactgaacctgtgaaagccaaggaagagctcatatttcactgtggattcaggcgcttccgagcctcacctttattctctcagcacactgcaggttagcaatggggaagctgggttcttgtccatcttgtcttttgggaaagtgacttgtggtggaggggtgccaaaatatatggtttcaaaatcttacatctctgggttagaggtattttcagtactctggcttaagagccaatgatgtttttattcaaaatgtctgaacctgtctgaagcatcccagtgatgcaacttctgtgtgatactgaggcttttttgccatgagtatttgttccatagcaggttttgaatagaagttggcagctttataaaaagggtattagggtgggtgcagtggtgcagtggttcacacctgtaatcccaacacttgtggcattagaacggggaattgaagaccaaaaaaggtaagatttaatcttgtttttgtttctgttttttttttttttttttttttttttttgagacggagtctcactctgtcgcccaggctggagtgcagtggcgcgatctaggctcactgcaagctccgcctctcaggtttacttacaccattttcctgcctcagcctcccaagtagctgggactacaggcgcccgccaccatgcccagctaattttttgtatttttagtagagacggggtttcaccgtgttagccaggatggtctctatctcctgacctcgtgagccgcccgcctcagcctcccaaagtgctgggattacaggtgtgagccaccgcgccccctcttgttttt

SEQ ID NO: 20441 - DNA, 1081 bp, Homo sapiens
atatgctgcatttggggattaggggagcccctgagtcattgattagaatgatactgggaacaaagaggtatcagctatgttaaatgaaaaagtgtgatctgggtaaatgaagcatcttgaaggatgagggttggctttaaaaattttatctgagagactcaacatatttggagaaagcttcctcgctattgggactttgaaaggtaactccatgattgctttctgctttcttgtggcaggttggctggtatgtcacacttcatgtctctgaagtccccgtctcagtggtcgagtgcttcaggcaaggaacacccttgattgcattttctttactacctcatgaacagaaggtaaattgctgtcttgtgggaaaatggggggttgtgaaactttccagctgcttctgacagtctaaaattctgtttatgtgtgactaaaattttgctcattgggatgcaaaaagtctgcctttatgattaggaattggagaataatagagaagtcaatgatggttttattcatatcgtctgaacctgtctgaagcatctcagtgatgcaatctctgtgtggttctgagacttctccaagtatgtttttcagaccagattttgaataagggttggcagccttaaaaataaaggtttggctgggcgcggcggctcacgcctgtaatcccagcactttttgggaggccaaggtgggtggatcacctgaggtcgggagttcgagaccagcctgaccaacatggaggaaccctgtctctaccaaaaatacaaaattagccaggcgtggtggcacatgcctgtaatcccagctacttgggaggctgaggcagaagaattgcttgaacccagtaggcggaggttgtggtgagccaagattgcaccattgcactccagcctgggcaacaagagcgaaactcttatgtcaaaaaaaaaaaaagtttatgccaaagtgcagatctcttttctcttggtggccagtagttgtgtatgttgtggggtatgtgatagttctttgatcggttttggtaagggctcaagaagaaggggcttgaatgagtgtggttttgagattgtgg

SEQ ID NO: 20442 - DNA, 1031 bp, Homo sapiens
ttgctcaggctggagtgcagtggtgcgatctgggctcactgcaagctctccctcctgggttcacgccattctcctgcctcagcctcctgagtagctgggactacaggcgcccaccaccatgcctggctaatttttttgtatttttagtagagacggggtttcactgtgttagccaggatggtctcaatctcctgacctcatgatccgcctgccttggcctcccaaagtgctgggattacaggcgtgagccaccgcacccggccgtgtatggttagtttcttaggaatgactctgtagttgccaggaatgaggcttttgttttatactttagactgtattagaatttatgttggttgggaatagggatctagtacaattattttactcttagcttattggcctttggggtagagacaggtgtggatttcttctgaaaaaactgtaatcctattctacaggatgagagtagtgaagaagaggaagaatatgaaactatgactattggggagtctgtgcatgatgatctgtatgataagaaagtagatgaagaagctgaggcaaaaatgttggagaaatataaacaagaaagactggaagagatgtttccagatgaagtggacacgccccgtgatgtggctgctcgaattcggttagtcaacaagtctatcaacaaatctaaattcagtcaatacgtttttaaaaacttggctcagagctgtgtcactgtgatgcaaaagaagaaaaacacattttttctgctcctgaagagctaacatttaatatgggaaggcaggacatacatacgggaaatggtcatatgtaattaagttctagactgtggtgcagactcacgttacaggacttgaatgaaggggaaatactaaggttaattagcaaatacttcttcccaaaggagccagtactcaattgaagtatataatgtttggaaattttagggggtttgggtagaatagcagaagtagaagagtgaagaagtagatgattatatctgttctggaggtgagtgacta

SEQ ID NO: 20443 - DNA, 1049 bp, Homo sapiens
tgatgctgtgtgcccaagtgggcagtcaccacccagcccttccttgggcgtctcccccagagtgctgtcgggaccacatctgtcctcaccctgtgggaccgcctggccctccctccctagcccttccagcctgggacacacacacacacacacacacacacacacgcacgcacacgcacacatcttacctctcatgcgtgttttaccttttgatgttcagagtggctcactggctgggagtccttacctcggggagagggggaggttggttccttggggggccaaagaaggcagggaatgcctggagggtaactggggggccaccatgaccccttctctctccagaaacagctgcttctccccccatcccagggtcccacccccaacccccagaggtggcccttgtttacagtgaggactcggccactgtgtctctgtttcctgaaatataaactgtagcgaccccagactgtagagatttttatgtgtttggatacatctgctgtgtggaaaaaaaaaaaaactacaaaaaccctaattttgtacatactgtatttttactattgaactgtattctagtggctgttcatgctccaagactttagttaccgagacatgaatactatccatgtaataagcacttgcctggaataaaatataaaactgaaataaacctgcactgaaacctgagatggagctgccagcctgcagcatctgggtcattttattgcaaaaggaggctgaggcctgtagggaagcatgtggcaggagcggtgagatcacctgtctcgaccctgtctgcccagcatagtcctcaagcggctctgacccggtgcctccgccgctctgaaaatggcagttctggtcggtctgaaacttttgcaaagcttcgtatttcctcagaccattttacaagcattatcttgtttcatctttcaacagccaagtgaagtaaataagccagacttagccccattttggcagataaggaaacaggattgaggtggcccagtgacttgttgaggccacacggctagctggagacttcg

SEQ ID NO: 20444 - DNA, 1128 bp, Homo sapiens
ctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccctgatctctgacctctgctgagtgctgggcactgctccaagggacaggtgggcctggcggcctgtgggtttgggtgcctcctgcagtttgggagacatggaccagcatctggtcttgtttccaggagcatagaagccacatcgttgagacatcaggaaggtaaaaacccagcggcttagccaagccctaagcctgtccccagaccaaccctgggacctatacagaacagagggccagagctagggctgctgcttctgctccagcccctttgcctctgtcctcccatcccctcaacaccctgcttctcccggggacgcttttgagtgggccctgcccggggagctgcagagcagcagcacctttctctgagaagaggtccttggttgggtcaaggacagggctgagcgtggaagggggaggagtcaggggctctgtgttaggatgcggctttctctgcctctgggcagcctgctttggcctttccttgtatgtgggtgtttattacaagtggctttgtgtcagacacgctcggctccccacctggacacacactcaccagtggcctttcagtgtagcgggaggaagccggtgtccctggatgtgaagctcacactgatgggctggggcaggggcctgggccggcgagggggccggggggaggggacagagctgaggatttcctggagtgccctgcaggcacagaggaggtcagcaaaggtcttgaatagattttctctggaaataaagaatccttag

SEQ ID NO: 20445 - DNA, 1028 bp, Homo sapiens
agaaatgtatgcaggagtgggtgtgggaagctggcctcactggtgggtggggttggagactttgccaggcctggtcaggaaaagctgctacaaaacagcaaaactgctcctagtgcagcgatccccaacctttttggcaacagggagtattttcctggaagaccatttttccatggagagggagggcggggctggtttcgggatggaagtgttccatctcccatcatcaggcattagtcaaactctcctaaggagcacacaaaacctacactcctggtgtgcacagttcacaggagggcttctgcttctgtgagaaccaaatgtcccactgatgtgacaggatcagagcgccatcgctgctcacttcctgcatgcggccctgttcctgacaggccacggaccagtacctggggtttggggtcccccgccctaggggatgaaagaagggaaacctgggtctaatgggttactgtgattctccctgcgatgcagggaagagacaggacagaggtgggaaggaacatggtcaccaggagtcgggacagcactcttccaggtccttcccctggggctgagtaagcaccctgcgcgtagctcttcctggccgcctgtgggctctgggatctaaacggactatgcagccattctcactttcattcacagctcggacagggacagtgtgtgttgaggcggaaagacaaaacatgtatgtgagagactttgtatgagccggttcctgatgaagtcctatctttcagcctcgtatttactgcccaggcagatggggctcttttcttcaccctcccgctttttttttttgagacagaaaacttaatagaaattttgtttgcagttcttacattctcagtgtgagccaatctgtgacccaccgccccacccagaagtggcccagtcctggtgcagggtaggaagggaagggtggagtgagaagagccccatttttcctcagtgccagggggctggagacaccacccccttctcctgcctctgggctccaggaaggagtg

SEQ ID NO: 20446 - DNA, 1064 bp, Homo sapiens
gcagcccagtttctccagcaggagggaacaggatgctttttggaaataaaagtgaggcacggtggcttgcacctgagtcccagctacgctactcgggaggccaaggcagtaagagcgcttgagcccagggagttcgaggacagcctgggccacagagtgcgacctccgtctctaagaacaaacacaaacatggtcaggaggctgtcactcagagacaggcagaatcaagagctggtcctggagagaccagtggggctgtgtagactgggagctttggttgtttgctgagagcaggaagctgcaggaagaaggcagtggtccccagccagaatacggagtggcttggaggtggtcaaaggtttgaagacagccacagtaaagtggacagagacaagaaaaataggtaccaaaccgtgcatccaggtagtcacagaaaggaaatgggtttagattgaagcaatgtgggttaaagttagaccctggggaaaccttgcaggggtctgtaggcctgtgaagaactggactaggtgagaagaagaagcttttgacccatgtcactccctggcccagaactatatcctacccacaggtgggttgagttcaggactgctgcttccagcccccagcagcaaggttcaagtgagagctgactcacctagggccccttgttagagcctcagagccaggtgaaaagccacacacaggctgggcgcgatggctcacgcctgtaatcccagcactttgggaggccgaggcaggtggatcacctgaggtcaggagttcaagaccatcctggccaacatggcaaaatcccgtctctactaaaaatacaaaaattagtcctgcctggtggcacatgcctgtagtcccagctactcgggaggctgaggcaggagaatcgcttgaacccgggaggcggaggttgcagtgagccgagatcatgccactgcactccagcctgggtgacagagcgggactctgtctccaaaaaaagaaaagccacacaggtgtgtgtgtaggggcaagggagtttcctactgtcttcctagcagaaaatggggaga

SEQ ID NO: 20447 - DNA, 1050 bp, Homo sapiens
ctcaccacctgtggagctttttcatgctgctccaggtgtaactgggtccttcctggcacctgtgaggtgtaccggcgtggttctgggtgagagagggcaggtgagaaggaggttgctacctcccaggtgagctttgggattgctttaaaatatggggaatgggggttggcttgcactctagggtcccacatgtccttgtgactcagggagggccctgattgttcctctgcctataaagagtggagtccatgtctcaaggccaatgaaaagttaggtctgtgtcagccaaaggaatggaggcagggtctgtgttaggccctgggatccagagccttgtcttggggtaggggaaggggctggggacaactgaggctgtgcccgactgagaagggccctgtcactggaactcagcaggctgcttggccactgcggtctgtgggaagcgggagcgcagggctggttttctcccgggcgtaacctaaggcctccccgcactggagcaggcctgcaccggcctggcatcgccccttcccgaagggctagggagatctggaagaggcccgctggctggcccagcccctgaactccggctgctgggaaaccactgaggcttcccctcccaggacgcttccccctccgcttcctcctcggcctcttccctctgcaggagggcggggctgggagcaggcctggctcacactccagttgttgattggccaaagggcctgaggcctcaggttttctggggcgcctgagccagtaagagtgtgggaggtgggtgctctcctccccagggggccttagccgactccagtcccccacgccaccccttgcccgggtgtttggggcgtgtccacgagcccgggctgtctgctgcgttcgtcagcggagcggggcgggcgtccggggtcagaggagagggctgcttgtcccggcggctccctggcctggagtctgcagactccaagggcctgggccagccccgtagccagggaaccagaatggtggcgcctgggagaggacgaggcaagcgggagatggaggtgcctc

SEQ ID NO: 20448 - DNA, 1022 bp, Homo sapiens
gagctactggtcggcttgctgcctgtttccctgttttagggtccttcccacctcttaagggaggagtccgaaggagtctacccatgggcctgcttgctctttctcccactgctggctgacctcatccacgccagtttcttcaaccactcctcatacattcattgtgcccagatccagacccatcctgaacttccagcatcctcattcctcacccgccggcccatggccgtgtgaaactcctctgattgtctgcacctgcttctcctgttgccttgctcaccatccacccagctctccagaggacaaatctctgttcttccccctcctttcccaccaggtgtaaagtcttccactaaatcccaccaattccaccttagaaacctctccccagtccagcccgatagagctctgtaatggcctcagcgagttccggggagcttcagagtaaagaagtagaaagagtagatttaggtattttgggcagagaacaagatgaaatctgctttgtttggggagtgaactggaagctttcaaaagaaagagtagaatgggaaatagatcccacaggcaggggagttggttgagatcaagagatgcgagatcccaaaaaatgggaggccctttctgatacaggacaggccagcattttccccctttgataatttccaggttttgttgttgttgttgtgttgttttgagacggggtctcgctctgtcgccaggctggagtgcaatggcactatttcggctcaccgcaacctctgtcttccaggttcaagcgattctcctgcctcagcctcccaagtagctaggactacaggcgcacgccaccacacccagctaatttttgaatttttggtagagtcggggttttaccatgttgggcaggatggtctcgatctcctgacctcgtgatccgcccacctcggcctcccaaagtgttgggattacaggcgtgagccactgtgcccagccaggtttttttaattcttagtccgacaattttattttattttatttta

SEQ ID NO: 20449 - DNA, 1038 bp, Homo sapiens
ggcacttaccatgagtggagcttgcaggactagaagctgctctgtgtgagtcagtgagagagtggcgagcgaatatgaaggcctagaacatcactgtatagtattgtagactttataaacaccgtacacttaagctacactttattttttaaaactgtgctatgatgttgcaacagctacgacatcactaggcaataggaatttttcaacttcattttattttattttattttactttattttattttgagacagagtctcgctctgtagcccaggctggagtgcagtggtgtgatctctgctcactgcaacctccacctctggggttcaagctattttcctgcgtcagcctcctgagtagctgggattatagatgcccaccaccacatctggctaatttttgtatttttagcagaggcagggtttcaccatgttggccaagctagtctcgaactcttggcctcaagtgatctgccgccttagcctcccaaagtgtgagccaccgtgcccggcctcaactccattttaatcttatgggaccccctgttgtaagtgccatctgttactgactgagatgtccttatgtgactcatggctgtatgtatttattgttaaatgattcaatcaaactaactaacatatgcctcacccaattttttgtgtggtgagaacattttaagtctaatcttttagcaattttgaaatatgtaatatgtcattattaactatagtcaacatgctatgctaaaaactaaaacttattcctgctgtctgaaactttgtgccctcccaccaacatcttcccttttcccagcctaccctcccttgttaaggatttttatatcttatgttcatgaaggatacctggtctatacctttcttatcattataagaaataaggccaggtgcggtggctcacccctgtaatccccgcacttcgggaggccgaggtggacggatcacgaggtcaggagatcgagaccatcctggctaacatggtgaaaccccgtttctactaaaaataaaaataataataaa

SEQ ID NO: 20450 - DNA, 1038 bp, Homo sapiens
taatctctgtgctccatatacggatatgcagtgtttttggtggaggattgtactgattttcataagctgtgactgtgtgaaacactcgtgtatgtgccactgggatgagtgctctgtgtaactgtgtgtgatctccctgggaggttcggatgggtatttggttctgcctgtttgccgtagagcttgtacaacatagtgaatcttactaatcagttttacttccttttctttattcctcagccttaattttaaagaccccgaagcagtcagagctctgacgtgtactctcctaagggaagattttggactttctattgatattccattggagagactaattcccacagttcccttgagactcaactatattcactgggtagaagatctgatcggtcaccaggattctgacaaaagtactctccgaagaggaattgacataggtatatcattttaaattcttttttggctaaacagttttcataagttttgcgagatcaaattctttgtaaacttttctactgggtatttgttgttgtacaaaagaagctggctacagatacaggttgagcatccttaatccgaaaatccgaaatgcttcaaaatctgcaacctttgagcactgatgtgttgctcaaaggcaatgtgcgttggagcgttccagatttgggggttagggatgttcagcctgtaaatatagtgcacatatttcaaaatctgaaaaaaaaattgaaatccaaaacacttctcatcccaagcattttggattagggatcctcagcctgcattaccgttcttttttactacacctggccttttctcccactgatttctcttgagaagggattgtcagtccaaacagggagcaagaggttaagggaagtacaaaatgaaaatgaggctcttatttatatagcttttcattttatttttttaatttaaaaatttttttattttgagatggggtctcgtgttgcccaggttggtcttgactcctgggctcaagcagtccacctgccttggcttcccaaagtgctggga

SEQ ID NO: 20451 - DNA, 1038 bp, Homo sapiens
ccagctacatgagaggctgaggtgagaggatcttgagtccaggagtctgaatccagcctgggcaacatagcgaaatcctgtaattaaaaaaaaaaaaaaaaaaaagatatagttttgtcattgtttgtttcctctctatacttactattgtacttaatcagctatttaacaaaaacctattgattagccacattgtgctcagttctaggaaagccttaaaaaacaagaaagatgtcactgccacagtcacacgctagtttatacactagtggggaaaatggacaaatacataagccgttaaccttttagtatgggagaatccgggggatgtgcagtgggatcacatgaaaaggagaccgtaccctgactttgggatttagagaatgatttgaaaccgaaatggtctcttggttgtgttttaaggaatgagtggagtgagccaggtagaaagaagagtattccaggcagaggcagcagcatgtgcaaagaatactgggcagaggggaactgaagaagtgaagcgtggctggggtgcagtggacaagagacaggaggaggtgggctggggatggttatactttgtggtgctttataaggcccactgaggagtttgaaatttttcttaagggcgtggtatggaggattcttgtgccttgcccatccccatcctcatccactaaagttttatattattttctgagacacagtcttgctctgttgcccaggctggagtgcagtaatgtcatcttggttcactgcaacctccgcctcctgggttcaaacgattctcctgtctcagcctcctgagtagctgggattacaggctcgcaccaccacggccatctaatttttgtatttttagtaaagacggagtttcaacatgttggccaggctggtctcagaactcctgacttcaagtgatctgcccacctcaacctcccaaagtactgggattacaggcgtgagccaccgcgcccagctgatggttaggatttttaagatttttgttttgttttgcattgtttggagacagagtct

SEQ ID NO: 20452 - DNA, 1957 bp, Homo sapiens
aggaaagctccgagtacctcaagtgcctgacccagcaggccgtggccctgcagcgcaccatgaacgagatctaccgcaacggctccagcgccaacatcccgcccctcaaggtgagtccggggcggagcggcccctccggcccggcgagcgcgggagccccgctcaccgctggtttccccgccccgcagttcacggcccccagcatggccagcgtcttggagcagctgaacgtcattaacggcatcctcttcattcctctcaggtgaggcctccgccccactcgagtgtctcccggttgggggttttttgtgagtcggagtctcgccctgtcacccgggctggagtgcggcggcgccatcccggctcactgcagcctccgcctcccgggttcagcgattctcctgcctcagcctccccagtagctgggattacaggtgtccgccacctcgcccggctcatttttgtgtttgtagtagagatggggtttcaccacgttgaccaggctggtctcgaactcttaaccttgcgatccgcccgcctcggcctctcagagtgctgggattccaggcgtgagccatcgcgcccggcccgccccgcttatcttccccagcatcctcgcattccgcgagtgaagaccttggtgtttctgcttcacacaaagtatcttggcgttttcccaccagtccctaagaagcggcttcattccctccccacgcttcccatcctgcggcgggggggggctgaggagcaggccccgggctccccggggtggccacaagcagtgtggcctcctgtggggagtggatttggtcagcaaggcgtggcagcagccccccaactccgctttcctccccctgcgctggagggaggccaccgagggcagcgaggggagccccgaggccgggtcaggtgcggggtccttaccttctccgtgttcagggaccttccgccttcaggagggaagcgcttgttcacacacattccccactgaatagagcgcagagcctgagcttatcccacaggaaagccgggaggcgggtggagcccccaggactcctctgagagccacctccatccccacccttatcctcagccaaaaagacctggagaatctgaaagccgaggtggcgcggcggcaccagctccaggaggccagcagaaacagggatagagccgaggagcccatggctaccgagcccgcgccagcgggggccccaggagacctgggctcccagcccccggctgccaaggacccttctccgagcgtgcagggatagagagggagccagacggacagccagccagcggccccgtcaccagggagcccgactgcgggagaagggggcgagcctgcgggcggaagaggaagcaaggccctcttcctccacgtctcaccccaccccacccccgtgtcctcctgggagcctggcctgcctgccccgcagaaggtgtttttgcgctggttcaatgaatagatgatgcagaggccccattggagacacgtgaatggcgtgtgcggccatcagttcccggctggggggcaggtgttgcttcggcccccgccgtccggccggcgtgtgcgagtgcgcccctggctgtgagtgttgaccgttcctctcccctgtacatagcccgagccagtcctgagtgggtgactcctgagtgggtgacgcgcagacgggatttctcaggtcatttgtatggtcgacatgatggctgctgctttggctgccaccacccccgggcccagcctgtctgaaagttcagggtttaggccgaaaaacccggtggggaggggtggggagccggagctctgtggcggggctggagggctggggtgcactttagtttggggcgggacgggagccgccgttgtgactggcgtggtctggctgctgctcccgaacggaggggtcggggttggcttgctgggccctcagagcccagtgggtggctc

SEQ ID NO: 20453 - DNA, 1057 bp, Homo sapiens
acccaggctggagtgcagtggcgcaatcttggctcactgcaagctccacctcccgggttcacgccattctcctgcttcagcctcccgagtagctgggactacaggcgcccgccactacgcccggctaattttttgtatttttagtagagacggggtttcaccatgttagccaggatggtctcgatctcctgacctcgtgatccgcccgcctcggcctcccacagtgctgggattacaggcgtgagccaccgcgcccggccttgagtagtttttcaatgtcactcttgttgatttagtgacatcctacatctttgacaagatttgctatttcacttggcagttgatttgtattatgtttgcatgacagtgttggcggtttacaacactgcacattcactgtgatatttataaagacattgacccagtggcaggggtatacacacccatgttaactggggcagggatgggggatggttggaggttgcctgatgtcacctttataatttttttcttttttttttttttgagacagaatcttgttctgtcgcccaggctgtcacccagtgggcctggaccccagatcctgcctctttggctggtgctcgtcacccagagctgccctggtgttgagccactcacaggacaggcctcggcgttgctctgtggagaccctctctccctcccgctggggcagggaggagatggaggccgagaggggcaggcgatgggctctcctgaggctgcaagcaagtcggggtgggatggaggaagagaatttaaggaacagcgagagtgcatgaggctctttgagtagttgagggaggaggacattgcaccgatccaggtgcctcaggaagcactcgcatgcctgggcctcgttttttctttctttctttcttcttcttcttcttttttttttttttttttttttgagacggagttttgctcttttcgcccaggctggagtgcagtggcacgatctcggctcactgcagcctgtgcctcccaggttcaagtgattctcctgcctcagcctcccaagtactggggttacagg

SEQ ID NO: 20454 - DNA, 1143 bp, Homo sapiens
acctgggtcttattcacactgcattttggggttcctgagctgcttgtttgagcgagaggtgcttcaggttcaggtcttatgcctagccccttgggtgagagggcctattctgattggcccccaggccctgctgtggagtctgggtctgagttgaactgctgagaaagagccccagacctccagcatcgtggtggagcactggagatgctctggagccagcctgcctggggtcaagtccgggttccatctctgactgtgtgacctcggggacgtgccataactgctctgtgcctcggtctcctcatcggtgaagtatttccctcttagggatgttgtgggaatgaagtgggtgaaggaatgcgagtcctgagaaccgtgtctgctttgtgcacgtgctcagacgcatcaacgattctgcttctcattcgcttctggtgccttttaagtgctgccagggctgtccgcactgtgaacggtccttgacggggtgttatcttcagaaagggaagactagcacccggccccccaggcttccaaagcatcatccatgcaaccatgttggctttcaattccttggagttaaggctgacggccatctggttctaacccggcctcctgtcttcctgtcccactgacttcccgttcttcagctgctctaggcttccctgtctgtctccagaccctagcccacctctgttcccttcccaggctcagctcatccatcaccaactgccatggacccctcttcagcaccctgccccctcctgcagtccctccgcccagccagtacctggtttctgtctcagcggggagctgactcctctctgtgcccccagcgcagggctggactctgaggaggaggactcagtagataggtattgagtgatgagatgagggaatcggctttctgtggccgggaacactcctgctgcagggggtccacctgatgggtgagtcagagaaagactcaggcctgttgaaagtggatcaacaggcaggcagggagatggccagtagccagccgtccgtcctgttcacagcctgcggagtggtgaggctgcctctgtgttttcatggatctgagattcagaacgtagctggtttacagccatggcccagttgtgtgctctggagtttcactgc

SEQ ID NO: 20455 - DNA, 1110 bp, Homo sapiens
gtctagctggtgagtccctttctttgtctgatggccaatgcagacattagcttttaagatggcatagtgagtggccaaaagccgggccctgtcacttcccagctgtgcgactgtgggcaggtccactcacctctctgtgccccagttaccttatctgaaaacggggggtagtaagagtggctgcctcaaaggtggtcgtgaggctgaagcgaacttgtggtgccctcagcctggctccttggaagcacctgggaggtgagagtggaggttgttgttactggggtttgttcttgttgctcctgcatcagccgtcctcgggggaggaggctgcagctgctgctgagattgctggtgtgtggccggaggttttcagcgtgtcgccctctctgtggagtggacgagcgcagggctgggaagcaggcacactgggtccttgtgctgctgtcctatctctttgttcttcacccctgggttgggaagcccgcagcctactgcctccctttgacagaagggactactgagaataatctggctgggtcctgggccagcgttctcccagcttccagaaagtccccagtggcgagcgggaggtgctcccaagaacttggatggatggatggatggatggatgctttgggcagagagaggagcaggggagccacaccccatgttgtctcacttgcattggggagagaagggatccttcccccagagggtaggcagtatctgttctggctttggagttgagaaagactcagatcataccacgtctctgtgggcagaatcgattcttttaggattgtcctttagtccagattgatgagtttgtgagtcttgtgtaaaccagaatcaccatctccatcacacagccaacactcgtttgcctaaatcacggtagaagttcccctgatcactgtagaatgttttgcggtgacaggtgcatcaccacgggcttaggtgcagggtacactccaggcctggcagtggagggctgtcctgaccctgttccccggcccagcccagggcacatgacccctcagttcctgtcccaccccgttccctggaagaagcttggtttccagtagggaatcaggtgcagagtgtgcagta

SEQ ID NO: 20456 - DNA, 1048 bp, Homo sapiens
gttaatctcttactgtgcctaatttgtaaattaaattatattacagatatgtatgtgtagaaaaaacatggcatatgcaggatccaatactagccttggtttcaggcatctatgcagggtcttgggacatatctcctgtggatgacagggggctactgtattttttttttcttttaggcagagtctccctctgtcgcccaggctggagtgcagtggtgcgatctcagcccactgcaacctccacctcccgggttcaagcaattcttgtacctcagcctcccgagtagctgagattacaggcatgtgctaccacacctggctaatttttgtatttttagtagagatggggtttcaccatgttggcctggtcttgaactcctgacctcaggtgatccacctgcctcagcctcccaaagtgctgggattacaggcgttagccaccatgcctggcctgctactgtaatttttctttcagccaaatgagtttaagatgctgtcattgcagccctgaggaaggctgcatgagagagaagagtaggctgagtttaccagcgtcctttgtcttttgggaggagccaggccgtctaatctcagagtggcagcctgtctcgcctgcccagcatgcagtggatggggtctgcaaatgtaaggttaggaacgggatggacatccagcaagctcaggcagcccagccttgtgcctggtgtggccccggaactctctgtcctctttccagactatgcattcactctgcctctgaggactgagccttggagggtcccagtttgtcaataaacagggctgctcctgctgcttccgttgcctgaggcctggagcctccgtctaggtgggggatgagtgcagctgcctgaagtcacaaccacgtgcacaacccaccctccttcccaggaggtgccagtaagtggtttgaggccggcatgcttctgaagaagtggtgagcggggctcctttgctggccgtcagtatcccgatgctatgagcccacggcagggctgcaccttccccccgatccgcttcggccagtggg

SEQ ID NO: 20457 - DNA, 1050 bp, Homo sapiens
gccagtctgctgtgaccacaggctcaggtccgaccctgctgcttggccacagcagtggctgggcaagtgggaaccactatctcttgggagcccccaaaagctgggaaatgctggaggaaccaggcctttcccgcttttgcctggctgcagggttcggctctgcccctgccccccagccctcgtgtgtccacaccgcagtgcctctgcccctcgggggactggacacacatcctgccagaggcgctacgaagctttgcccagatgaagccaggtgggctccgcgttcactcccactctcccgaggggtgctggcctccccagggtttgccttcttacggatttagacgaggttcgaggctcacctatcagggcagctctcaggattgtcattttcctctttgcctgtgggtttaacttttgtatttttttaatcacaagtttgatacaaaatgtttttatcgtactctttggagatgcccattctacttttgaatttagcttttactaattcgcatctggaagctcagcaagtgcacaagccttactttggttaccgtggaaaccactgccgcccctccccgatgtggtgcgctcaataaaaatgctggaattcacagggggctttgctgaggcatgggctgggatatcggggtgggggtggcggtgggatattggggccagagctgtggttttaatgatggccccatcccccactgttctgggacaaagctcaactactcccaggcccacctgcctgaaagcccggggctggtggagccgcagcagctgcactgcgcctgaccagaaccacatctgtgggagtgtctgggagcactggggtgggaccctggggtgcgtgtgctttcttgggtgttactgtgaagcccctacttgctcccaacctcctttttgcaacctagcctcagctcccacctgggaggggccgtagggacacccagaggtgcctgggagagacccctgcctataagactccctgcctataagggcactccgtgtatcccagcgagggacacaaccccacgtgttgct

SEQ ID NO: 20458 - DNA, 1027 bp, Homo sapiens
ccttctagataaggggccagaatagtttcttacgaagtatttgggtgattggatagttttagatgatctaaaatgctgcatcagggaatatctagctttttgctttactgtcatcagctttgatcaatacacgggttgttgccaagtcctcgtattttgctccttaaaataacatgtaggattttttccttgtttgcttcacctgatttattgggcgatctctttgtcttgtctagatcactgtcgtcttcctgaaagatgagaagtaccattctttgcctatcatcattaaaggcagcgttggtggacttctggtgttgatcgtgattctggtcatcctgttcaaggtcagttctactcatggcatcacagtgagggaagactgggctctagttttgggcacagaactccttaggacagccaacctctgacttagagcagctgccctggcctcgtggccacttttttctcctccttcaactgcacacccccatttagacaaatgagtaaaacagtatctgtctgaaaagagaaaactctgagttataaagagtgattttatatatatttctttggtacctccctattctcaaggcccagaacttaatactgttatgttcggttacctgtgagttcaatagggcctggaaggtcaaccctaggccagcatttataacttacttggaagaggccttaacggtaaggccttaaaacagatgtgactgttgttcccctgttgaaatcttttccttgccttcccctgtcttaatgtgcaaactcttctactgctatttaagatcctctcctctctgtccgctacccgtctctgcccttaagtgttgcttttttttcttttttttttttgagacggagttccgctctttcgcccaggcttgagtgcggtggtgcgatctcggctcactgcaaccttcccttccccccaccctgaccccgggttcaagagattctcctgcctcagcctcctgagtagctgggattacaggaatgtgccaccatgcctggctaa

SEQ ID NO: 20459 - DNA, 1049 bp, Homo sapiens
ttgccacatctccaaatgctgtattttcacatggcaggatacaaaacaggaagcaagaagtcagtagcaaaaggatgttggatttttcttcatgtgccttcccttttcagggatgaaacagtttccaaaagctcccaggagacatcctcttacatcttattagtgagatctgaatctcatgtcagtcactggcaaaggagaatagctgtgtcatgatcacctgagaccaacgatgattcctgaataaaatccaaaaggagagaggggcccctgggcaggccagcatccgtgtttgctgcaaacagtagtacccggtgccttgcttctcccttaacctctacttgggcatctttggggcacttttgggaatctgtgggtttagaagaagataaagggaggtggctttgagaaatagggacatttcttctactcacatctggcctgtttcccgagtcaccttgggacttcctttcacttcccaaacccagggtcttgagtccccctccttctcctgtagaatattccagccctctttctgttcttcctccctctttgttgctatggtacctccctattctcaaagcctaggacttcactcctatttagttcagctacctatgagctaaataggactggaaggtcaactttaggtcaaccagcatttataacttaattggaagaggccttaaaggtaagtttgtccagcccttcaccccgtacagaaacctctccaaagcacccctgaccttggtgcttaaacatacacgtgaagggttgctctgggcaggcagagaagtcttgttggctctctggccccacctaagtcctgggaacttcctctggccacaacttggaagggccatacctgggtctcaggaaggacatctcctgaactttctagctgagccctgccagaagagagattagactcccgaaattgggagagcctttggaaaacaaaacctgcggatgacttctaatagctgagctctgcaagtagtacacatggatataatttgcatttattatgtcccttaggtaatacacac

SEQ ID NO: 20460 - DNA, 1055 bp, Homo sapiens
gcctccctgcaacctctgcctcctgggttcaagcaattctcctgtctcagcttccctagtagctgggactacaggtgcatgccaccatgcccagctaatttttgtatttttagtagagatggggttcaccatgttggccaggatggtctcgatctcttgaccttgtgatccgcccgcctcagcctcccaaagtactgggattacaggcgtgagccatcgcgcccagcctaatatcagtattttaatttacaaattgtcttggatttggccagtagagccccttcaagctgttttgacatactccatgattctttaagcactttctttctttatggcacaacaaaacatcttgcttttccagactcattttgcatcttacctgctccacatctggaatcagccatttctccaaggagctggtgggcatggtttgaggggttcgggggttgggggctatacatactggtttgtgttgtcacgtttacctacagccctggatatatttacagtggtgtttgttctttacagtcagagtgtccaagaactgtggaaggtctttgtattactacttttgacaaaaatttatgatgactgaccacctttctttcctgttaactgacatttcaacttgacaaatgtgatctttaccacatttactcatttgagtggctgagtacattctacatgtatagtattatgctgttttctttaagccattttgaggagcacaataaactggaaaaatgatttaccaaatatatggaattatatgtagtctgtttccttaatcctgatgctgtgttgttggcatgtgatccttcagaagtgaatatcatctttcatggggtggcaaaaatgccactattttgagaaagtctttttgattcctgggtacctgtaatgacctaaagctcttttatgccttttggaaccttgtatcttgtattgtttatttttgttttctccattaagtcatctggctccaaacagcagttttaacctcattcgtctctgtattttgctttatcccctctacactgcattgctgtagtggg

SEQ ID NO: 20461 - DNA, 1078 bp, Homo sapiens
ctcccaaagtgctgggattacaggcttgagcgaccgcgcccgaccttaagtttatttattgatatatttacaaattttgcaattgagattaaaggagataatgtacttaaaatatgtagtaaaaaaagccgggtgtggtggctcatgcctgtaatcccagcactttgggaggccgaggcaggcggatcacctgaggtcgggagttcgagaccagcctgaccaccatggagaaacgtcgtctctactaaaaatacaaaattagcatggcgtggtggcgcatgcctgtaatcccagctacttgggaggcttagacgggagaatagcttgaacctgggaggcagaggttgcagtgagccgagattgcaccattgcattccagcctgggcaacaagagtgaaactccatctcaaaaaaaaagaaaaaaaaaaaaaggtagttaaaaaagtacgcaattggctgggcgccgtggctcacacctgtaatcccagcactttaggaggccaaggcgggtggatcacgagggcaagggatggagaccatgctgaccaacatggtgaaaccccatctcttaaaaatacaaaattagccgggtgtggtggtacgctcctatagtcccagctactggggaggctgaggcaggagaatcgcttgaacccagaaggcggaggttgcagtgagccgagatcgtgccactgcactccagcctggcgacagagcgagactccatctcaaaaaataaaaagtatgcagtcctgataaggctaagtttcttttttgaccatagccttcaacctttctgcctcctcagaagtaacagcagttatcagtgtgactcatattggccttttctgggtgtctgtgtacataaatatgtacccttagtaaatgtatggtattgtttaatgtcatcaccttgcatgtaattttttacaacttgttttttcactctgtgatacatcttagaatctttctgtggtatataattatctcattttttaccacataatattttataatgtggataaagcataatttattaccctggtaactactgggttattagaaatcgtgccttagc

SEQ ID NO: 20462 - DNA, 1045 bp, Homo sapiens
attattatgccagcatggtggctcatgcctataatcccagcactttgggaggccaaggcaggattgcttgaggccaggagttcaagaccagcctgggcaacatagcaagaccccatctctaaaaaaaaaaaaaattagccgggcgtggtggtgggtgcctgtagtcccagcaactcaggaggctgaggtgggaggattgcttgagtctgggaggtggaggttgcagtgagctgagattgcaccactgtactccagcctgggtgacagagccagaccctgtctcaaaaaaaaaaaagaaaaaaaagtaataataattatgccaggacagcaggtggacggacacctggtccttctgactcagagcctgtggtccagcaccccctagtggtggaacaagccagacacaggataaggatacatttagtgtctagtttgtacctggcaaacagagtgacaagattgggcttaatactttccagctataaaattctagaattctgtgacccaagtttaatttggggtagagctttttaaaaaaaaaatagagatggagtcttgccatgttgcccaggctggacttaaactcctggcctcaagccatttgcccaccttggcctccgaaagtgccaggtgattacaggcatgagccaccacacccagcctccacgtttaactttgaaagaagattttacttcatcatcaagtcccaatatttatccttgatagactgctttggttttttgtttgtttgttttgagatggagtttcactcttgttgcccaggctggagtgcagtggcgcaaactcaactcactgcagtctccgcctctcacattcaagcagttctcttgcctcagcctcccaagtagctgggattacaggtgcatgccaccaccacaccggctaatttttgtatttttattagagacgggatttcaccattttggccaggctggtctcaaactcctgacctcaggtaatctgcccacctcagcctcccaaagtgctgggattacaggcgtgagccactgtgcccggccataga

SEQ ID NO: 20463 - DNA, 2033 bp, Homo sapiens
tcagcgactcctgctctcttctgcttatttcctgtgtggtccccaagccctgctgagccctcctcttccctgtctctgggccttgttgccacttataccccttgcctcattcaggcctcaggcccctccccagacttatctagccaccttccccctggtctcgctgctgctggcctccctccagtccagccaacacattcaggcggggacagccctgataaagcacaacaaatctgcctgcatctcttgcctgaagtttgtctgaagcttctcaaagccacaccctggcgctagcattcacacgtctccgggttctgccacccgctcgtctggggccgcctcactccctttcccgagcaccagccagctggcttctgtccatttcctcctcatcctgtggttgccttccctccctgcctccacagttgtacccctggtgcctctcttcctgctataccccctgctgaggggtgtctttcccctcagcccaggaattttaaaagggatgaagcatctaagacaacagggggaaccgaagtcaacagtcctgagagtggctttctgctccctagtcttggaaggatgggctccccaagaccactggtggcaaagaaacctggggtttggccgggcgtggtggctcacgcctgtaatcccagcactttgggaggccaaggcaggcggatcatgagatcaggagatcgagatcatcctggctaacacggtgaaaccccgtctctactaaaaatacaaaaaattagccgggcacggtggcgggcacctgtagtcccagctactcgggaggctgaggcaggagaatggcatgaacctgggaggcggagcttgcagtgagccgagattgcgccactgcactccagcctgggccacagagcgagactccatctcaaaaaaaaaaaagaaccctggggtttgggcagagagagttggagctgatgtggcgctgagggggctgctccctcccatctgagtctcccatctctgcctgcactcttctggctggcactgtgccagcctgctaacctccctgggcctcagtttcctcctctgtcaaatgagagaggatcttctctgggtgtagaaaaggacgaggtggtgagtgggtctgaaggcctctggtgtcccataaagcgactctcctcaccatctttgccacccattggggtgtccagcacccatggaactctgtctgtgcctctgtcctggagggagacttgacctcctgctcaggaaaggctctccaagcccttgttgtgaaattcctgcctgctgtccggaactcagtcttcccatccgagggacgaaggtttcgggaagagaggtggacaggaaggggtcctcatcagcggtcccaccctcctctccttccttcgccctctccaggccagaaatcagcgaggagctcaaggacctgatcctgaagatgttagacaagaatcccgagacgagaattggggtgccagacatcaaggtcggggaactgggggtcttgggctgggctgggacacagaaaacaggagtcactttccctttctggagggatcaacaccaggatgcatgtgtgttgggtttgagtctgtggactttggacccctccaggtgattctggtaatggcctgacctctccccctctccctgccctcccggccccgacagttgcacccttgggtgaccaagaacggggaggagccccttccttcggaggaggagcactgcagcgtggtggaggtgacagaggaggaggttaagaactcagtcaggctcatccccagctggaccacggtggtaagagagccggggtagatgctcccttgtcctggagggcctgggggacctgagccttgctctgtgcctggctccttggggggacagaggcctgcctggccagccagctgtgatcctgggccactggagccgccattctgctggaggcccatggagagggaggtcttgtggtcgggagaccaggaggcttggtgaggagagtgactgatttaaagaaatagcgggcgtgg

SEQ ID NO: 20464 - DNA, 1021 bp, Homo sapiens
agctgtccagcacggcgggaaccccagcattcatggcccccgaggccatttctgattccggccagagcttcagtgggaaggtgactcgcaggccctgggccaggctggggttcaagtggggggcgtaatagcttgccgcagtggcccagtttctaacctgagggtgccagggtctttgtgtctagggagtgacatatttgcctcttccttggagcctgacaaactccacaactttggccttctcctgttttccagcaaagtggtcccaaatctcccttgcagatatttactgttggttgctctgtgctgggttctggactggactgtggaagaggcagaaacaaagagaaccctgtttcctgccctctggatggtttcgggggaagttgggggtccccgcagatcttgggacatggcaggatttgaactggcccttgaagaatggggaggatctgagcaggacctggagcctagagaataaaccagagaacagaagggctcagggtggggggcagagggtataaagggcctggaagtttgggctttctcctaagtgacaggagcgtaggcaaagttgtctgaacaagaggttacacggtctggcgcagttccctgggcacatggctgtttcacctatggagtgccagccaccccactgccagggaggctgtgggtgagaggcatttggacacgtgtgagtatccaggaaagaggtcaggaggccgggcacagtggctcatgcctgtaatcccagtgctttgggaggccaaggtggatctcttaaggctaggaatttgagatgagcctgggcaacatagcaagaccccatttctacaaaaaaaaaaataaaaacattagacaggtgtggtagtgcacacctgtagtcccagctacttgggaggccgaggtgggaggatcgcttgagtccaggagttgggggctgtagtgagctgtgatggtgtctagcctgagtgactgagcgacaccttgtctcgaagaaagaaagaaagacgttggggat

SEQ ID NO: 20465 - DNA, 1034 bp, Homo sapiens
caggcttccacatgtctgccctatgcggcttttcagggtatttacagagcagatgacatggagtaatgagcacggggctgggtggtccgggaccctcactgccaaggcttgaatgcagcctgcggcttgtccctttgcctgggcggctccctacagaccaatctggggagaggggcagggagtggtgtccctttaagacttggaggctttcaaatgttttgacctctatccaaaacaagaaatatatatttctattgctatccatatctgtaactgaaaccaaaattttacaaagcagcatatatctttactacatgcaatatattctgatatattctacttatttaggaaaaaaaaaaaaaagcagttgccacccactaaattgatttcatgatcctctcttgggtctggatccacggtttgaaacagtgctctaaatggcatctttgcaattgattatggacaattaagtacttagaagaaggaatatcaagccaatcagaaattaagagaaagctgatttgaaattatgattgaaatgggatatgtatgagtatgtgtgctttaaattttttattatgtagcagaaaaagctaatatcttgagttgtagggactcatgtgggcacaggtttcccgggacgtcccgaccacctgaatggccgggtgccctgatttcagctgaatgcccctccccgcatccttctccataggcccgtcatggaagtgccctgtgacaagcccttctcggaggagcaagctcgcctctacctgcgggacgtcatcctgggcctcgagtactgtgagtgcggggcagcttgcccactggggctggggctaggggatctggcaggcggcagagcccaggctgagcagactctgagcagctcccgtcagtcagagctgacctgccaatcagcttcagtgggagtggggcatgcacgtgtggcggggccaaaggcctttttgtggggtggggcgggcggtggactccactgggcatgtgccagatccttcgtcgtgtctggtcctgtg

SEQ ID NO: 20466 - DNA, 1073 bp, Homo sapiens
tgcccaagccaggccctggaagcctgaggggtggggcaggagttgtgcttaggagatagaggacagggctgcctgagagtgagctccctgtccctaggggtatgcaaaggaatgagcttcctaaccctggggatatgcaagcagagactggattcctctgaggggaaagctccagaaaggcttgctgggggaataaggggaagggctaggctcagatatggccacccccaaccccgcttaacacttacctgggccacaccctcagggccagtagcagatgtccagtgtgcctctccggacctcagtccacatgtaccagcctgttctagcccctggtggctgcacagtagtgacatttctgtccctccttccttaggcaatgaaagtcctttccaaaaagaagttactgaagcagtatggctttccacgtatgtatcttctgatcctgtccctgggagctcctagcctggaggcagaggaggagacctcgatcctgagctagttttggctaggaatggggtagagagggagacagcgtgagcagaggcctggggacagaatgtgccctgtgggttgggacaagaccacgggcatgcaagactcttgcttgagactggtttgggggccacggtgaggcccagccacctggaacaggtgtttgagttctcttcctggtcacaggtcgccctcccccgagagggtcccaggctgcccagggaggaccagccaagcagctgctgcccctggagcgggtgtaccaggagattgccatcctgaagaagctggaccacgtgaatgtggtcaaactgatcgaggtagggggtggtggtgagcaggtgggaaccagcacctgagtctcatgggagccgcttctggtgctggggagcccctagcacagacccagggatcttgcccaggtggcagatgtggctgaggcctctgaggacagggccagacttggggtggggctgcaggaaggctttgggggcccagcctggtcagggatgttcccaagttcccatggagggtgaggggctgccccagaggcaagaagtgagcccctcattgcagct

SEQ ID NO: 20467 - DNA, 1032 bp, Homo sapiens
cacacactctggggacccttcgcctcttcctcggtctcccaccgtcagtcctcacagcagccatgggagtcgttttaaacctcacctaaccgaggcactcccctgctcacaacctccccctggctttgggggcctcctgggctctgtccaccaagctctccccacccccaaaccaagcccggagtcccagccaggaaatgactctcctatatgcacagtgcaaacttccatcctcgcctcatcctgaaatcctgctcagtgctcagaagagagctcaggtgccacctcctctaggaagccatccctgaggccagcacaatgagtgagggggctttctctccagatgtaactcctcttgctatcaggtgcctcttatgtggggaagactccactccagccacgtcagcctccctgctgttcttcatactgagcaagcactgtcccctcatggcgtttgcacctgctggtccctgcacctgaaatgctcttccccagataactacactgcctactgccccttccttccttcaggtgtctgctccagtcctgctcccaaaaggccttcctcaactacactgtatcagcagcatctcccagcccctttctcttgatccttcttactcggctgtatttttcttcctatatgtaccacttgacatatcatatctgaatcactggctttcttgtttgttgcttcttgcccccacgagaaattaaactgtatgagagcagagacttggtctttttggttcactgctgtatctccccacacaggcttgcacagagtctggcagacagcaggtgctccgtgactatttgtgcttgcatcccaggcgtccatgtccctggctgctccctagcctgtgaccccccccccaaccttgcccccagtctgaggccacttctgctcctctatccatgacattccgagttcctggaaggccaggtctgggagaactataaccacatttgcatgttggaaatccctccagcagctggtgtggaggatggggtagggtggggtggaggtgt

SEQ ID NO: 20468 - DNA, 1031 bp, Homo sapiens
ccactgcgcctggccaggatggaccccttgaatctaccctccatcttttcttcagtttggttgtatttttcatgtttatctcttgttctgagagatttcattaagttgactttttaaaatcaccactgaggttattttcccctaataatcttttttttttagcaggcactttggagggcaaattattagtttgattttagtgtaaaaactgcctagatagagtcctataaggaatatataaagaactcttacaacccagtaataaaaagacctctgtcaccataggttagttttgcttgttttgaaactttgtatagctggagtaagtcgctgcattcctcttgcctggtggtggtggttttttgtttgtttgtttgtttgtttgtttgttttttgagacagagtcttgctctgttgcccaggctggagtgcagtggagcaatctcggctcactgcagcctctgcctcccgggttcaagtgatttctcgtgcctcagcctcccaagtagctgggactacaggaatgtgccaccacacccagctaatttttatattttgagtagagccggggtttcaccatgttggccaggctggtcttgaactcctggcctccagtgatccacccacctcggcctcccaaagtgctggaatgacaggcgtgagccgctgcgcccggcctgtgtctggcttcttctgctcaacattatgtttgtgagatgcatccatgttattgtgattagtttcctttattcattttcactgttatccagaattccattatatgaatatgccataattttaaagttcacgttactattgttaagtgtttctaaactggaaattactccagacaatactatgagcacacctgtctgtggcttttgatgagcatctgaatgcaggccaaacttggcctgccaaacagtttctgccgttgtttgtaccagttcacactccctgccaaacagtttctgcaatgtttgtaccggttcacactcccacggcagcacatgaaagctttatttgctcca

SEQ ID NO: 20469 - DNA, 1073 bp, Homo sapiens
ttatgggttttattcacattaccaaaatgctattaccacaccttccaaaatcacaataagcaattcttccttagtccaatttctgcagacaacctctggggattgtgaaaccctgaaaggcatgttctgtgtttgtgtttcttcatttttctggagagagggcccacacctttctttacattttcagtaagcgcatcctagaggtgactaatgcccagttgcgaccacatgctctcctaaggccctgtgctcctgtttggagccacaaaagcttttggagggttgtaagctttaaatgtgtcttgcctttgcagccatttgcctacccacagcatcacggcccacccaatggtaaccattcggatcagtgaccggcagaggctcatccagccatatatccataactactcctggctgctctttgctgccctggctctctatagcgcccacctggccagtgcagaggatgtggatggggagaagctggacccccagacgcgcagcagtgccaccaccctgcggagccagtgcatgcagctcgtcggggactgtctgatgaaggctcatcagggaaaaggtgacttcccaatgcacagaaaccaaaaccagccctcagttgctggtgaaaaaaagccttggcaaatgtaaaatactaagcttagtttacaggtggcaacatccacttttccacaaaaggggcttaccctggtgtggaacttaatttttaagttccccgatggattttagagaaatgttggcattgaagttcaacatttaatttctctgaaactaatattaatacctcaaactaattttaaataataattaaaactctttatatctgtggatgcagtctagtatttgaatctaccaaactttgctgaaagaatccagacttcttaacctggagtgtaaatctgcttccacacaagtgtattctagatgagagctgtttacgagtaaaatagtttagcaatatatcgacatgaatctgactcgactaaggagtggtgggaagaaagcaacttgaaagttaaaccttggagacatctaagttccttcagataatggca

SEQ ID NO: 20470 - DNA, 1026 bp, Homo sapiens
tgggattacagatgtgagccaccatgcctggcctatgggaaggtttgatagtaatgaaaattgagaaagccagtctactgaattgcctgacaattttgagggcttatttgatcattatggttgcaaatttaaagtcatactagtcagcttgcttgtgtggtgtttcctccatgacattcagctgttttgatataggtataagatttctcaggcaagtacatggaggaaggaagggacacgggagttagtgtttgctaaggtatgattatgggccatggaatctaagctgagaagggagcagagagaaagcatggcaggagtagtagatagtgaacatgaggcagcgtcctgggctgacgcccactggtattgaagaaaaggctgctgttggagtcctacctgggtgagcaggagagctggggtcagagtagggtgctctggcatcagtgtgtcagagatgatgtcatcacatgataacaaggtccaggaaatgaccatcaaactaagatggctaagggcgtggaagagaagatcactggagatgcagatggcagagaattgagggaaaaaggaatggagacatcattttcatggatgttgaagtcaccaagatggccaggatcatggtagaaaagacagtgaggctggtgccaaagtcatcaatgaagggaggcagaggggtgagcgtgattgtgtggagaggatcaaatgaggtcatttgtgaaaaatacttaacacagtatctggcacccaagtagtggtgggagggatgggtttatattcacaaagaagataaataatctcatctccatgcttctgggtaactctcttgagcccgtcagagggactcacttgctgttttgtgtgttaccttctataggtattatatttgtatttacttaagttcctgtgccgctttgctcagctgactgccacttgctctttttcatgtaagaaatcattattattattaagaaaaagatgttctggcaattaagtgaatcagtgatttcctctgtttctagt

SEQ ID NO: 20471 - DNA, 1015 bp, Homo sapiens
tttctactatataatatattaattattttctttgtttcggtagatgtgggccagtttctggcaagcatgagagcgattttggaatcccttttctcacagtacagtggaaaaaccatagtagaaagattatgtaactcagtgttttcaatggcagctcgtcaactggtaagaaaaactagcagctatttgtaaagaaccggaagggggttgggggtctgcatccccaggcccagcctaaggtggacgctgagtgcttcatccatcttccattaggttatcttcctgctggacttctgcactttagacatcccacactgcgtgctcttgagagagttcagcgtcctcacagaactcctgaagaagctctgtagtggccccgaaggaggactgaggaaggtaactcgagtcagcacttgagccgccccgtgttctctctcaggagtgatgggacacacttagtgaagtggaccacggactgcagataggcacagctgagcagcctctagaaggctcccttgattttatcagtgggcttgccaacaagggtgaatgtcagtccaagtcgatgtggcctggtcagcattagaaaggagacgcagaggccgggcgcagtggctcacgcttgtaatcccagcactttgggaggccgaggcgggcggatcacgaggtcaggagatcgagaccatcctggctaacacggtgaaaccccgtctctactaaaaatacaaaaaaaattagccgggcgtgatggtgggcgcctgtagtcccagctactcgggaggctgaggcaggagaatggcgtgaacccgggaggcggagcttgcagtgagccgagattgcgccactgcactcccgcctgggccacagagcgagactccgtctcaaaaaaaaaaaagaaaggagacgcagaaaaagctgtagagatgaatctcatcattttatagttgatgaagttatataaaaaccatgtaagtgagtgacaaaattgaagtctagaagagaaaatgtatgttga

SEQ ID NO: 20472 - DNA, 1035 bp, Homo sapiens
atgtagtttatgctccaagtggatcagtcacttgggatatttgacagaaaaaagatttctagatcccaccctaagctactgattcaagatctctagggatagggcttaagaacctgcatttttctaagcaccccgagagattctaaagtgatagcacccctgtactaggaaaccaagaactatctctttgggctaaatatgggaaccagagagctggaggagattttgtggtagactagtccaaaccacatctttgaggtatctaatgatgtggacttgaaggtaacttttcttttgtggctgataacttatcttgtatcttttgactgaacttagtgtctttaaatctcttacatttttgcgggtgccttactgttttgagttgctgttagagccatgatttcattcattcccagctgcctggcatgataggccatcagcaggtgtctcccccaattcactgatggggacctcagagcacctgtagggtgcctaggttatcatttgccaaggttgctcttaggctgaccactgtttagatctagtattaatttagatctagggtaacgttgactttataagcctcaactttgtttttaattaaaaaactatgctctattttttgctgtcacattaattttctcttactttctgctttctggcttatttccagactcttctgcccatctctgagtcttccttaaaaaactcacttcagtctcatcagtatgtgttctcggccccagttagccatggctcattcgaatctccatccttatttctgcatttcccataccttccctttcttctggagctcatctacattctacctgtttctcagatccctgaagcctgaactgagttctccccctcaccagtctttcttctgttgttacatcatcagtgccattgggcagaaaacttcagcgttctcacctggttctcataggagtcgattctgccccgcacgtgaggagtgggtaggtgctagagccaggactgaaaccggggctgtttgactcagagccttgtcct

SEQ ID NO: 20473 - DNA, 1887 bp, Homo sapiens
ttcctatttcatggaggagagaaataagaacaaggggcaggagttttaagaaagagagagggttacttggaaaggaggcttaaagactcctgaagtattgcatggtgagagcgatgtgtgagtgagtgtatcagcaggagggcagaaggcattgttgaggaagggtttgaaatctggggagagagggcagttgctaagtgaggtaagtcttgtaggatgtaagggaagggggtcagggacaccagagggtgaggttagaaaggagaaggggaacactacagggccgatgtgcttttcactgtactgggctctgttcaaatgttacttaatccaggcagcagcctgtgaggttgacaatattcgctgcatctttcagatcaagaagctgtggcttatggaggtaaagaaacttaggtaaggtcacatagcagagtagtgatagagcagatttaaaccaaatctctactgtcccaggttccccagatggcccaacatgggcaagagacaagctagattacaattaaaggttagtgaaaacagggctgtgaaacagataaaccaagttagctcttgtgtccaaagagtgttgaaaaagcccaggcagacgcggtggcccacacctgtaatcccagcactttgggaggctgaggtgggcggatcacctgaggtcaggagtttgagaccagcctggccaacatggagaaaccccatctctactgaaaatacaaaaaaaaaaaaaaaaaaaatcagcttggcgttgtggcaggcgcctgtagtcccagctactcaggaggctgaggcaggagaatcacttgaacccgggaggcggaggttgcactgacctgaggtcgcaccactgcactccggcctgggcgacaagaaagaaactgtgtctcaaaaagggaaaagaaaaagcccagctaaagtcgaggtgctattctaagccaattctttatattctggcactttgcaaccagttgaaaaactttacagtggctgcttccttctgaaattatttagtggggaggagacttactacataattactctcttggattacttaatggttactctcttggaatatagattggaatacaaataagatgtgtacttgcatacatacatcctacaaagcgcagtgagttcctgttctaaatttatctttggttgatacatatggactcttctctctgcaaccaaaaataaataaatcaccggtctcgagaattttaaataaaagaaacttgaaactgccctcgtttacttgaaacagccctgattttcttgcatctcttatcttgtaggcctttgcccagtttgatgctgagggtgatgggacagttgatgccgagaacatgttggaggccctcaagaattccagtggagctaatcttcagggggagctgagccacatcatcagacaactacaggcctgctctctggttccaggtgaggcttccatctaggtgctgtcttagaaccaaagtgaactttgctatactactgattgaaattaggcaaaattgtggccacatgcagtaaactcccccaacagtgttcattaggctcccgatctgaattagcatttcctttagtcatctctttcatccccagtacggtggtggctaagcagttctaccgttttataacatgaacccttgtcacgtggccgctttccttattggatctcttcatttcactacagaagccctccttggccttcactgttcattctcttagcatcctgcattcttttttgcaacatattaccattgtaattgatcaattcattattcaattattagtaaagtgtttgtcttcactcatgtactatagttccacgagggcagggaccttctgtcttatttctgctctgtcctcacattt

SEQ ID NO: 20474 - DNA, 1044 bp, Homo sapiens
cagacttaggaagccccccgaccacgcggacgctcgctgggctgcactcagcaggctgcttgagtgggagctgactccaacatgccctgccctggctgggactaggcatgcttccagcccttcccgtgctctccctgctgtcaacacttgcgtacaaacctgcctagctgttgtaagttttcatcagtagcttaagtactagtagcaaaaacttaaattcattcagaaagttgccacttctgaatgagtagagcaggaaaagtaaactttactgaaacataatttgctgcaacagtcaacattgttatgctgaatgtgctctcaactgccctttgctcatcgccagatttattatccagtgtattcctaacagtcttttgttgtcgttgtttttaaaacaaaggtacggaccatgtgctatatataaatcgaatggcttaaactaatttgctatgatcctctaacaccgaaatttcccataaacttaagtgcctacacttaggacttttgaactttcagtcatctttttcgtggtgtctcactgaacgatgtgttagaacatgtgttccatttggagttttgggcctgtgcacggtcaaccccaattaccaatttagttgaggctggattcgattgctcagttcacctgccacgttctctccaaggagtggggtctacgtgacctttagtcctctacctcagagccccgagtcatttctgaccaccccgttctgtgtcctcactcttgtccctgaatgggtccctgtgtggatctcagtgtgtgtgtggtttctccactcctccccgctcatgtcccacacctgccatattgaaccgtttctgcactaatcttctccacgggcacggagtggagggaacgtcttgggaaaggggagagcttgacctccatctaggtttcttttatctggagaaaaagaacacttttgaactatgtaatgcttcaccctgaaaggcaagctaacgctaacttcccaggtgacagtagcaggaacaaggaagggtaatgtttccatgacagacact

SEQ ID NO: 20475 - DNA, 1047 bp, Homo sapiens
aaaaccatttccccttccagtagcttggtgtccatcccagagcattcatgaagtcttcccgcctgggctgactgatgaggcagagcctctcagcgtaggaagctggctgcttaatgagctggctttactctagggtaagtggctgtggacttttctgcacagtgttttcataaagataataggatcctcttgccctgaagtctttttttctttttacgctaagctgtatttttagtgagctaccccttttaaaaaggtgaaatctttcttaacagggttcaaagatgagagctgaaaaatcgtggccttaacaactgaaagctttacagtgttcatgctactgaggtgtcaggagtgcagctgggccgcttgacacctcgtagcagccgtctcattctctcgtcttgctgcgtcctgtctgtggagtcctcagtcactctgctgttggagagtgctggaggaaatgcacttttactgtgctgcactttttatagagctgcattgtcggtgattccaatttaaaaatccatattcaaaaataccctcacacatccctgcatcagtgattctaatgatcagctttgactggacctcagctcacacgaatctccaaggaaaaactctacagagcatcttttagagcaagagattcatacaggccaagtgatgagagggggagtcaccaaggcttcagccccaagggcatctccagcctcaggccggcaggtcctatgtccttgacacaaatgcttcttgctgaaatcctccctagtgatgctgcgagtgctgttggtcccagttctgtgtagcttgccctgccccatgaagggccaccagccaagggccctggccacgtgtgcgccaccttactttggaagtctctggcttgtgtgctggatgaggctgccagaacttgttgggcgttcatcgctgttagtacatatattaaccgtgaggtgttaaacttttcttttgaaggtttggccagtttctaaaaaatgcacatttaaagagaagcatctaccacggctttaaaacaaaacaact

SEQ ID NO: 20476 - DNA, 1031 bp, Homo sapiens
atcacagtgtcttctgaccagtctgtgaaccccttcgaagatgtccccgtggtaaatgggacttcatttgatgagaacagctttgcagccagactcatccagcgcggcagccacacagacgcacctgacacggcgacaggtaaagcacgtgcctcccgaaggggcgacgctggggtctgcaggcgccaggaaatggcatgtaaatgccttcaccccaaatttagaaactgaacggcatactatgaggataattattttgtacttaattttatatacagtaaaagcctgggttgtcatttttaaaaatcctgtgcttcaaacaattgagcagacatcaagtccctgaaactgaaacttccatttatttaatgcggcgactcgcagactctttggactcaagaattcctttgaccgtcttaaaaattgtaccccagagagcttttctttaggtgggttataacttcagtatttaccatattagactacactttgagaacactgttttaatgtatttccttgatctgactaaataaaataacagggatattttaaggagagggatttggtgtaattcagtattgagtactggcaatgcataaaacatgggtaggtgtcactcacacaggaagacttgaccaaaaaaaaaaaaaaaaaaaaagatggatattaaaacagccctttccctaaagaagttaataattaaaggttggccaggcgtggtggctcacacctgtaatcccagcattttgggaggccgaggtgggtggatcacctgaggtcaggagtttgagaccagggtggcccctttagagactgaaacctgtcgctactgaaaaaacaaattatcagctgggcatggtggcgggctcctgtcatcccagctactcaggaaaggccggagaatcgcttgaaactgggaggcagaggttgcagtgagccaagatcgtgccatcgcactccagcctgggtgaggagactgaaactccgtctcaaaaaaaaaaaaaaaaaaaaaatatatatatatatatatg

SEQ ID NO: 20477 - DNA, 1032 bp, Homo sapiens
tagttaggtacaagctgtggtcaggaaataagaaagaaagagaaagagagagagaaattgtgtagggagggatcctggaaacccttctgagagatgaccgaaggaggcctttgaagagtagaagcctagtgttcttttttttttttttaagacggagttttgctcttaatccccaggctggagtgcaatgatgtggtctcagctcaccgcaacctccaccccctgggttcaagcgaatctcgtgcctcagcctcccaagtagctgggattacaggcgtgcaccaccacgcccggctagttttgtatttgtagtagagacggggtttttccctgttggtcaggctggtctccaactcccgaccccaggtgatccgcccacctcggcctcccaaagtgttgggacgacaggcatgagccactgcgcctggcccagcctagtattcttaaacagtgaaaggatactgaggtgaggaggcaggacaagtggtaacaggtaaccaaaaattgagcagagccttttgaattcgtctgtaactccatgatctcaatgagtttccacttacagatgccccaagaggttccttcagacacatctagttatcgctctcctttgtctgcagtcattttctgctccctcttgaagaagcactggccagaatactttgccctgacactgtttcttctattatttcttttcaaggagatctctttgctgccactttcctcattaagaatggggcctttgtcaacgctgctacactgggtgcccaggagacaccactgcaccttgtggccttgtacagttcaaagaaacactcagcagatgtgatgtctgagatggcgcagattgcagaggcccttctgcaggctggtgccaaccccaacatgcaggacagcaaggggaggtaagctggggagcagacactgtgcccttagcactgttctcagaagatatcttacagtagcatgtaattggcatacggggagttcatgttctttagtttggcattattcagtcttattttcattaaa

SEQ ID NO: 20478 - DNA, 1062 bp, Homo sapiens
tcactgcccactgcgaaagtttagtcagatgttgcccagactgctgagtcaccttttttttgagacggagtctccctctgtcacccaggctggagtgcagtggctcaatctctgctcactgcaacctccgtctcccgggttcaagcgattctcctgcctcagcccgagtagctgggattacaggtgcacgccaccaggcccggctaattttttttgtatttttagtagacatggggtttcagcatgttggtcaggctggtctcgaactcctgacttcgtgatctgcccgcctcagcctcccaaagtgctgggattacaggcgtgagccactgcacccggccgagtccccatttttaatgactgtgtaatattcctttaagttgggtatactgtcatttactttattagcctcaaattttagggatcccttgagaaagtctaagcatgtcattctatgctttttcagttgttctctctttctttaaccagatgctaatcctgaggtgacgatgacaatgcttcgctggatctatacagatgagctggagttcagagaggatgatgtgttcctgactgaactgatgaaactagcaaatcggtttcagctacagctcctcagggagaggcaagtcacagcagatatattcaagcacctcagatggtggtggctgagctttaattatgccgagctctgggaaaacagcttcttctgctaatgtaaataacttggcaaggtgttcctttaaaggcgatgctggggacagatgttacctcccttgctttgtgttatcttgtagctaaattttgctaaagcttttgctattctcttttctttcactggtctgttacctgaaattacataatcgtataaactgaaaaattaaatatgaaataatataatccaatgtccaaactttcagctttccttccctttctgtttcccttgacattttactctattttctgatatatcaagttgaatgaaatccttagtcatagtctctttgttggaaacaatgagtgcctaaatgaatatgtgaaaatattgtccaaataagtgtc

SEQ ID NO: 20479 - DNA, 1086 bp, Homo sapiens
tggtggtggtgttttgagtgctttattatgtattaactccacacagttagcaaggattggagccgggatttgaaccctaggtagtttggctgcagaattcgtgccattaaccacagtgccgtgctgcctgtcagtttggtttctttttcctccaaattgaggtgtaatggaagtacagtaaactgcccacattaaaagtgtgcaattggataagttttgacatacgaatacacctgtgaagccactgccacaatcaacataaacatttctatccttgctgggtgtggtggctcacgcctgtaattccagcactttgggaggccaagttgggtggatcacttgaggtcaggagtttgagaccagcctagctaacatggcgaaaccccatctctactaaaaatacaaaaaattagccgagcatggtggcacatgcctataatctcagctacttgggaggctgaggtaggagattgcttgaacctgggaggcagaggttgcagtgagccgagatcgcgtcattgcactcccgtctggacgacagagtgagactctgtctcaagaaaaaaaaaaaaaactaacaaaaaacatttccatccttaaagctttcctcatgtctctttgcaatccatcccttttgccatccacttctgcagctaaatgctgatctgctttcagtcattatagattagtttgcagtttctaggcttttatagaagtgcaatcatagagcatagagtcccttttgtctggcttctttcacttcttttagcatatagattttgacattcaccccacaccttagtatgttgctttgtgttttaattattcattccttgttattgaatagtattccattgtatgaaaataccacactttttttttgcatttacctgttgatggacatttgtgttctttctgggttttattagcaagaaaattacctgtattcagttgtgtaaggcctttgtgtagacatgtttttatatctcttgagtaaatatctaggagggactgtttaatgttaagaaactaccaaactgtcttgcaaaatggatgtaccattttacattcccattagccgtggat

SEQ ID NO: 20480 - DNA, 1032 bp, Homo sapiens
attgagtggtaagcgcttttcaaggtgttagggatacaaagtgtacaaaattaaattcttgcttgcataaacttacatcttagaatgtaagaaaaactccacatttttctttttgatgttcttgtctaattgatatttctttctttcttttttttttttttttaaacaggatttcactctgtcacccaggctagagtgccatggtgcaatcacggctcactgcagccttgacctcctggcctcaggtgatcctcccacctcagcctcctgagtatctgggaccacaggtgtgtgctaccatgcctgtctcattttttatagacatgagattttgccatgttgcccaggctggtcttgaactcctggactcaaggaatcctcctgccttggtctcccaaaggcctgttgggattacaggtgtgaggcactgcacacagccttgattatgagaattttagcatatgttgatgaaatacaacaggcattatatacactttaaaggtgtttggatatatgaatcataccttgttcaaaaaagtgaaatgtttgtacctgatatgatccactgatgaaggcacaatcacttctgtaggattctttttttgtttttgagatagggtctcactgtgtcgcccaggctggaatgcagtgacactatcgcggctcactgaagccttgaactcctgggctcaagagatcctcccacctcagcctctcaagtagctgggagtacaggtgttcaccaccatccctggctaattgtttaatagagatgggctcttgctgtgttgccaaggctggtctcaaactcctgggctcagatgatcctcctgccttggctacccaaagtgttggaatttcaggcatgagccactctgcctggctcttgtataggatttttgccattaatgcataacctcaatctactcatgagaaaacatcagacccaaattgagggacatttctcaaaataatcagccagagtgtttctcaaacatgtcaaggttatgaaaaacaagaatggtttaggaa

SEQ ID NO: 20481 - DNA, 1026 bp, Homo sapiens
atttaattcctggattaattaatgactaatcttggtgttctgatactggagctgaaatctggcatcatggtgttaatgggatgcgttctggcttaagaccacaaatcttgagtctgtcttctgctaattgtgtgattttaggcaactcacttaagtgagtttcactgttagtatattactttttcaatatagttagaatctgagatgatgaatgtgaagaacttaactgccataggagacataaaaaatattaattcccactttctgtcttattgcaaaatattacaggaaagtgtacatttccttttactccatagaatgatgttgacactaatctagcaaaaagttactagggcattaaaatcttttactatacagaattttttgtttgtaagtataggtgttttagtttcatgtggctgctgtaacagatttccacaagctagatggcttaaaacaacagaaacgtgttcttatgattctggatgacagaagtctgattgaaatcagtatcactgggctcaaatcaaggtctcagtagggccctattccctctggaggctctaggagaaaatctttttcctgattcttccacctgcaagaggctgctgacattccttggctattggctgcatcattccagtcttcaaggacagcatcttcaaatttctctctgttctgtgttcacaagacctactctgagtgggtcagactccctctgtgccttccttttttttttttttttttttttttttttttgagatggagtctcactctgtggtccaggctggagtgcagtggtgcgatcttggctcattgcaacctccgcctcccaggttcaggcgattctcctgcctcagcctcccgagtagctgggactacaggcgcctgccaccacacctggctaatttttgtatttttagtagagatggggtttcaccgtgttagccgggatggtcttgatctcctgacctcgtgatctgcctaccttggcttctcaaagtgctgggattacaggcgtgagcc

SEQ ID NO: 20482 - DNA, 1046 bp, Homo sapiens
acacactcccctttgcttttatctcttacctgccagaatgttctcaaatgatttagttcaaatactgaaatacttaatgagcaattacttgatttttaatgatgacttcgaaggagtcatcactaggtgctttgtcctttttgtattctagttgcacccacctcttggattggatatagcaataacatttattggccgttgtgagctcttgatcccagtcattacccctgagaactaaaaatagatggttcttaattcaacttactgaaaatttccccaaacaatagcaaatctgacttttccctcttcagttgcctggtattaaggttggataaatgaagcatgcacagctacaggctttctacttaacttctgggtttgctattacaaatcctatttactctcatacccttctccttagtccttcatatttctctgcctctattcttctatactgcagatttttctcacctattgtacaaagaaattgcgatgtatattttcatgtaatttgattttggaattctgtcaccttatgtagtgagttcttccaaaatataattttttttcaataattgtcaagttgttggcttttattgtattgaatgaaggctataatactgagtgccagagaagtggtttaggaaaatctcaggttgattccttatgcaaatgaacttttaatacttgaaaatcacatggccatggcagtatatgtatttggttctatctagattcttctgtgaatctaaaagcattacaggggtaaatgctttgctatttgacgtatagatcccgtcactaacaatagtacacttggatgtgattaatgtttgagcttcaatatatttcatatcatacagttttctaaaacaacttcagcaaatggtaaaatgaacatgtgcagtgttaaaggcaggccttaggctccttcatgtttgttgtgaggttgtgtgtgggaagtagtctttggcttataagggatagaacttgagacagtagcagatgggacatggtgtttgattgtgagaatcagtgagaattcg

SEQ ID NO: 20483 - DNA, 1033 bp, Homo sapiens
acatgcctgtaatcccaacactttgggaggccgaggtggcagcgttgcttgagcctgtagttcaagaccagcctgggtgacgtggtgaggaccctgtttctacaaaaaaaaattaaaaattatctgggcatggtggtgtgtgcctgtggtcccagctgcttgggaggctgaggtgtgaagatcacttgagcccagaggctgcagtgagccatgttcatgccactacactccagcatgagggacagagtgggaccctgtctcaaataaataacaaacaaaaacttcaacctagtgtttttctaactttttgaacaggaaactcagccatttattggctatgtgaacttgtctcagctttagaggggagactccttcataatgatgattgtgagcattcaggaaatgagtttgtaaagcgcttagcatgctgcttggcacatcagaactcgatgaggcggtgctgctttttatgtagatgtgttcttgacttacagtctaactggatgatacgaggccaacagatttgaaacacttagaaactgtggttgggatggagggtcatttgtggcaggctttgtggagaaaatgggtttgaagggagctatagtgagttagatagaatttagcaagttgggaagtgtggcaatcttaagttgtttctctgaacatcctcaaatgtttgtaaatttccaaatcacttggcttttaaatcttctcttatggattctagatttaatataagttgaaagacatttgaagtattgaaaaatctaaattagcgctgtccagtagaacgttctgtgatgataaggatacagctgtgctgttcagcttgccagtcactagccacatgtgactactgagcacgtgaaatgtgcttagcatgactcaggaactaaattgtaaattgtacttaatggcaattaatttacatttaaaattaaatatacccacgtggctgtgagctaccataatagatagaaacaaagtgagctcagaatgaaattaaggatttgttgtcaaataaatctaa

SEQ ID NO: 20484 - DNA, 1044 bp, Homo sapiens
cacctaatttttaaatgtcattgccattacacaatttttttgtattaaggctttataccatggaaacctgtttccttaggccgggcgcggtggcgcatgcatgtaagcccagcactttgggaggccaagatgggtggatcacttgaggtcaggagttcaagaccagcctggccaacatggtgaaaccccgtctccactaaaaatacaaaaagtagctgggcgtagtggtaggcgcctgtaattccagctacttgggaggctgacgcaggagaatcacttgaatcccggaggcagaggctgcaggaggcagaggcagtgagccaagagagtgagactccatctcaaacaaaaaaaaaaaaatgtaaaagatacctgtttccccaaggccggctttgtagactgaatagtcagcagcctcacctgtctcttcttgaaggctggcttttctcacggctttatcaccatgcactttctgagtattttttgtgttttcagtcatgtgataggacatagacgtgaacgaaaactcactataaacacttgaaaaatgtattgtctgtctgggctgaactgaaagtgaaatcaatttaagattatttgaaaatacatatttatctacattcaagtccatgacccacacatattttctcaaaatgcacggattactgtgggtgccacttggcccaggctttatctcacattttgttagtgtttataccttgtcctatatagagattattagtacccttatgttctaattcagctgtggggtaggaagaatagagaggaaaaggaaacaaattctccccttgccacagatgagaaccatggctactttgtgtaccactggacaggaggactccgttctgcaccaaggctagagggactgtattggttctttattgctacgtaacaaattactaaaacttagtggcttgaaacaacatttattatctcatgatttccatggccatgggatctgggtgtggcttggttgactccgggtctctcataaggctgtggtcaaggtgttgactcaactgg

SEQ ID NO: 20485 - DNA, 1050 bp, Homo sapiens
aattgttggagtccagacaccaggtttaattctttgtctttaaaccagctgacagcatatgtcctgggcaactgctgagcactccccaccaatccaaacacaagtctttcaaattccatcagccaaaaaacattaaatattccacccagaacaaaacaacctgtccagtgcaaataaaacagctaaaagtaattgtgccccatcatattccaaatactcggtcttttaaaaagccaccaaagaaacacaaaactacattgggccaagaataccaggcatatagcagcatgaatttcatggtgttcacctgcctgttccgtttatcctgagtctgaagggcagcaggattattatagcaaaaatagctgctgaagccaaggaaacacatcaataacagcatcaaaagtcatagccaggtgactggaggccacagaagggccagcagcacccatgctttctcatccttctcctccattgcgcccgtgggaggctgagaggcaaaaggggtgacaactccaggacctggcagaaaagcagtgcccacggagcacagccaagtcagtgatcacatgactatgtgattctgactatcatagaataatagtgaactgtggcggatagaatgaatggacaagagacagctacaacaggactatagattaatagaacaatgttgagcaaattgcagacggcagcatacagcacattatttacataaaataaatatggcagtatggtaggatttgatccttgtaagatttttataatttaactcaaaaacagtaatggaggcctcatggaaaaaaattgaactaggcctgggtttttaaacactttcaaatgtgaaactgctggttacatatctctctctctcttttttttttgtttgaaaacagagtctgactctgttgctcactgcaacctccgccgcctgggttcaagtgattctcctacctcagcttcctgagtagctgggattatgggcacctgtcaccatgcctggctaatttttgtagtttttagtagagatgggatttcaccatctcggcc

SEQ ID NO: 20486 - DNA, 1035 bp, Homo sapiens
gtgaagatagctttgaatttggagtggcgtatggaaaagtgcctgggagaaacttggcggcagttgatttagaaacaattaggctttggcttgtgttaaaaatctgtggatcatttagattttcgattgttgctgtccccatgtctcctgttgccccatactatagatggtgttaaattgttagacacttccatgaatgtacttcatacatgtaaaacttcgtagatgcatgactcatggctctgggtggtctagctaaactagtcttttacgtcatacgtgtaaaactttgtagatgcaataactcatggctctgggtagtctagctaagctagtctttccactcaaagagcacgatacttaagctttctcctggtgagtcatgaattgtcatcagggaatttctcactgtttggcttaattcgattaggaactgctactggtgatagtttagtccttatttagttttagtctaagagaaccttactgacgttactataaatctaaaaaaaaaaagcatacctttaaaaaagcctaatggcaatggactagtcaggatagtaagaaaaagttatactggaaagagagagatggtttatgaattggttacaaaaaatacatcagtattattttgaagacaaccctgatttcagtcatggttgaaatccttaaccaaccacaaaaatgtcttacattttaaatatattaaagtccttaaattatggaaatagtgtcttctaagaagttgtttaatagtggaaagaagagtctcagtctcttttttttttttgagacagagtctcattcacccaggctggagtgcagtggtgccatctcagctcactgcaacctctacctcctgggatcaagcgatcctcctgcctcagcctccccagtagttgagaccacagacacatgccaccatgcccggctaattttttttttgagacagaatctcgctctgtcacccaggctggagtgcaatggtgcgatctctgctcactgcaacctccgcctcccaggttcaagcagttc

SEQ ID NO: 20487 - DNA, 1081 bp, Homo sapiens
ccgtaagtttttttcttctcttcttttaaaatgatggctgagatacacacattctttacattacttttgatgtgaacgaaggtcatttcagtagacttgcacatttagagtatgccagcaacttactcaatattgcgataggtggaatttacggtctggcgtctgaattgtagcttatcctcaaccatcaaaattcctacccaaatttcttgtgttccaaacttaagaattgttgtgtttcattgccaataacatggctttttcctaaagtgatacatatttttaagtaattcatttcttgggcaaatatttactgccagagactgtcacaggtcctggggctatatcagtaaataaacaaaaacccttgttcttatagagcttgctttgtagttagggtaggggagagaagaattaatagaaagtgtagagtgctgtgtggaaactagaacagggaaagaggataaaataaggagtgtgtaagggggtggggtttcattaaaaatagggtgacagtggaccgaggaactcaggtgaatgagtgaatcatgcagaggttaggtgaggcaagcacaagggccctgaaatggggctgacctgaacgctggagggaggtggcagagcggttagctgaaggttggagagagatgctggttaaagcccctgaacgctggagggaggtggcacagcacttagctgaaggttggagagagatgctggttaaagcccctgcggtggcagagcggttagctgaaggttggagagagatgctggttaattctgaaggaccctataggccatcacacaggccattgctctgagtgagaatgggaagctgttggtatagtgacatgatgtgactcacatttttccaggattacttctgcctgctgggttgagagtagatacaatagggaaggtattttccatagtaccccagcacatgcatttttattaaacatttgtggctgaaatgaaagcttcaccaacaataaccctattttattttttgtttctgttaggaaaaatgagtgctggttatgttccactagatctatttcatgactgtgtgacttacggt

SEQ ID NO: 20488 - DNA, 1028 bp, Homo sapiens
ctgtctcattttgtaagttatatactgtatttcgttatgtctaagataccgttggtggttgtgtgcttcgttattttgtataccattaatacagttaaatgctgtcaaagaaactatgacgtaccattgattgaaatatgcatgctgatttcagatagacaaaaatgtgaaaaaggtacatcttagaatagattaaacatggtagtttgtagttctatgggtattataaagctatagctttaatatatttaaatctattatgtttatcaaatagttttttcaggagtggttgtttgagtgctcttatgttcaaaaatgtctgttagtggctttcacaagcaacgtgatgttttggctggttacagaatttttgggttacgtttccctttctcttaatacccagcagacactattccattatcttctggcatctagggttactctagagaagtctggggccagcctgactgtttttttccctttgtaggtgacctacttctgcctgagtattgctagaattctttctttatccttgaagttcagtaacttcatcaggatataactcggtcttggtgtgattctcttacattttcctgttaaatggtaagccattcaaactgcagattcaggaatattttcttatacaccttttaatatgcattcatttttatttttctttactcaagaaacatcagttttatgattgtttatcttcatttcctgtcttccatttcattacttttctaaatgcttcctttgttcttttctgctgtgctcgatgtgattttcttgagattttgtttgatatcatgtttgttttcatcagtatcaggttgactacttcctatatatgatggggttttcattttgccagtggcttcagtacttcattcaattttatatatttatgtctgtgagttgctctttcaacttgtctcatttatttcctcttttaaaaaaaacttttacttaacagtaaaaacaggtaaaaccacctgtaatcccagcactttgggatgctgaggcgg

SEQ ID NO: 20489 - DNA, 1026 bp, Homo sapiens
tgtatagatgagactgcagtaactcatctactgtgaaggaccatacaaaacaagtgtattagctatctaatacatatttaggattatttcggtataagtctggataaggagcaacaaagggtgtggaggggagtctgtgtggtttttacaggtaaggatttaggcttttagtctgagtgaggcattcatggttattgttggttagtactaacatttgatgtttatttaattagtgtaaaaggctttcagaaggtagaaagtatgagttaaaattggtcttcagattactggttgtaaatcagactgtattttaaggttagtcatttttataaagaggaagttgtttagcaattctgaatcctatattgttgcaatatcaatagcagatgctagaatcctattagtaatcccaaggtaaaatgaattctaaaagtgcaatcttgaattattcaacacttggtatccaaattatatgaaatataatcatccattttatgattttgaatagaactgtaggttgttttcttaaataagagttgttcttcctccgccttctcattttgagtccctggaatctgttctatttttacttggggatctacatactaaagctgtctctgatttcatgctctgaagatcaacaagagaccttcccttgtaagatgagaattgtgtagtaggtgactattagaagagtaaacaagtcttaagtctgtaaacattttttcagtaaatgcaatggagtaccagatatctctcgttactatgactaaagaaagttcaatggtaaattcagtagctgtttatttgccttgataagtaattgctagaagtaatagtaattgtttttatagtgttaccgaaggtttatttactgtatgtgtgatttttaaagttttaaagggatcaatgaaagttatgtatagggaatatttgtaagttactggaaataagccaggaattgaatttttaaaagtgcctttcagagtaaattatattttcattttctttatagaatgaaagtgg

SEQ ID NO: 20490 - DNA, 1049 bp, Homo sapiens
ggaaaactatctggaaaggttgacgtttgtggaagaccttaaaaatgctggggtaggccaggtgcagtgactcacacctgtaatcccagcactttgggaggccaaggcaggagaatctcttgaacccagaaggcagaggttgcagtgagctgagatcacgccactgcattccagcctgggtgactgagtgagactctgtctcaaaaaaaaaaaaaaaaaaaaaaatttgaccgggcacggtggctcacgcctgtattcccagcactttgggaggccgaggcaggtggatcacgaggtcaggagatcgagaccatcctggccaacacagtgaaacccgtctctactaaaaatacaaaaattagccgggtgtggtggcacgtgcctgtagtgccagctactcgggaggctgaggcaagagaatcgcttgaacccaggtgttcaagaacctcttgaaccgaggttgcagtgagccaagatcgccactacactccagcctggtgacagaacaagactctgtctaaaaaaaaaaaaatgctggggtgtgacattatatgtgtgtgtgtgtgtgtgtgtgtatatatatatatatcaacgaaactctatatatatatggggtttcgttgatcgacactagtttatattagttggtaatacaatatagctacttcaccacaatattatacacattcttcccccttcttacatatttttcttttccatttacttgtttaagcaagtgacacttgttgagacaccttcagtgtctcatcaaggtccttatttttctttcaaagtttttgttgttgttgttgttgttttcgagatggagtctcactctgtcgcccaggctggagtgcagtggcgtgatctcggctcaccgcagcctccgcctcctgggttcaagcaattctcctgcctcaacctcctgggtacgtgggactacaggcgcccgccaccacacctggctaattttttgtatttttagtagagacggggtttcactgtgttggccaggatggtctcgatctcctgacctcgtgatccgtccg

SEQ ID NO: 20491 - DNA, 1010 bp, Homo sapiens
agtagtaaatgaattttttttttcttttttttttttgagatggagtttcactcttgttgcccaggctggagtgtagtggcacgatctcagcccaccgcaacctcggcctcccaggttcaagcgattctcccgcctcagcctcagaagtagctgggactacaggcgtgtgccaccacaaccggctaatttttgtatttttagtagaaatgttgtttcaccatgctggccatggctagtcttaaactcctgacctcaggtgatacacccgcctcggcctcccaaagtgctgggattataggcttgagccatcgctcccagccagtaaatgaatttctaaggaaatagtctggcaggccgggcttagtgactcatgcctgtaatcccagagtgactcacgcctgtaatcccagaactttgggaggccgaggcaggtggatcacctgaggtcaggagtttgagataagccatggccaacatggtgaaaccccatttctactaagaatacaaaaattagctggtcgtggttgcacatgcctgtagtcccagttgcttgtgaggcaaatcacatcaaatctttgttttgttttgagacagggtcttgctctgttgtccggactagagtgcagtggcaacatcaaggcccgctgcaccctccacttcctcggctcaagcaatcctcctccctccctccctatagctgggactataggcatgcaccaccacacctggctaatttttccttttgataaagtcttgctctgtcacccaggctggagtgcagggatgtgatgatggcctactgcagcctcaatctcccagacccaagtgaacctcccaccttatctgcctccgtagctgggactacaggcacgcgccaccatgctcagcaaattaaaaaaaatttttttttggtagagacagggttttgccacgttgcccaggctggtcttgaactactgggttcaagcaatcctcccaccttgaaccatgtgtcaaatctttgccccagc

SEQ ID NO: 20492 - DNA, 1029 bp, Homo sapiens
cttatctgcatgggataaatactttccaagacctccaggggatgcctgaaaccactgatagtcctgaaccttgtgctttctcctatatatgcatacctatgataggatttaatttatgttagtctaacaacaataataacacagagcaatgataacaatatgccggcattactactcttgcactctggggccattattaagtaaaataagggttacttgaaaccaggcactgctaagtgataggcaggagggacagtgtgagatttcatcatgctacttagaacaacacaaaatttacaacttaggaattgtttattttttctgttattttccatttaatattttcagactgggcttgaccacaagtaattgaaaatgccgatggggcaggggtggggggactataaagtatatggattgcaccactgtcgatttcttgggtttgatattgtgctagagttatacagggtgttagcatttgggagaaactgggtaaaggttacaggaaacctttctgtacagttcccccttgtcctatgggactgtatttcagaataagaagtttttaaaaaaagtcacctgtaaccatgcattattatcaatcctttttcaaataaagaacttaatatttgtagttataaatacaactacatggttgctctattaacatgttcaaggaacaggaagttgaaatagagaaacctgtagtttaagacagaaattccgtcttaattttatttttttgttattatttttgagacaaagtcttgctgtgttgctcaggctggtcttgaactcctggactcaagcaatcctcttggcttggcctcccagagtgctgggattacaggcatgagccaccacgcacagctaccatcctaattttaaatagcagtcttcatttaaacttgtgtggttgcttggaaaatggaataaaggatcagcataaaagtttatttattgagcccttatatgccgttgtattgagatgctgcgggaacgcaaaggtaattgatgtgatatccctac

SEQ ID NO: 20493 - DNA, 1097 bp, Homo sapiens
aggtgatccacccacctcggcctcccaaagtgctggaattacaagtgtgagccaccaccacctttcacccagactggagcgcagtgacataatctcagttcactgcaacctccgcctcccaggttcaagcgattctgctgccccctgcggcccccagtagctgagattacaggcatgtactaccacgccaggctaatttttgtataaaatttccaaaaacttaaaacaacaatggctacatttattgaacctctagtctgtcaatccttaaggatttaaattaattacttggtagaatatatcgggtatgttttgttgataacataatgaagaatctggttactttcagaattgaacaaaatggttccttgggttgtggagtgtctcagtcttggcgctactgacgttttgggttgagtattgttgtagggcctattctgtgcattatagatagaatgttcagcagcattcgtggccttcacccactagatgccagtagcatactcccttagttgtgacaaccataaatgtctccattgccaaatgtctcctgagggacaaaatcatcccagattgaagattactgagttaaaatgtttcagagaagaccattatggctaattgttaagcaaataaagacacctaacagattcatgaaatcagataggttgtgtatttctctgtggatattattagactatgacttactcctttgcaaattgagcggtggcaattcaagttttgcagtgccttatgttaaacactaaaaaatccctcagcacaggagatacttttaaaacattttatcttttgaaaaggtattataagcattggttaaaaatgcaaagagtacaaaaaaacatagtcttttcaccctggccataagttctttttgtggaagcaacccatcattgacaaatatgtcttttttttttttttttttttttgagacagtcttgctctgtcgcccaggctggattgcagtggcccaggctggaatgcagtggcacgatctccgctaagtgcaacctccgcctcgcgggttcaagcgtttcttgtgcctcagcctcccaagtagctgggattacaggtgtgtg

SEQ ID NO: 20494 - DNA, 1050 bp, Homo sapiens
tcaagcgatcttccccctacccactctaaaaccagtagcctctagccctcagcagaagccaaagactggagtgatgaaatctgtttttgaaatacatttactaagagtttgaggtgttcgttaaatcacctttatggcttcttaaggaaaaggttgtcaggggttcttacagattgtataattgggtttattattagaccatgagcaagcaggtttggacaagtattaaagttctagatgctcagggggagttagcttgcagtaaatggagaagttctaatgatactacaggatactcataaaaattatgtgctggaaaagcactgaggccgggcgcgctggctcacgcctgtaatcccagcacttcgggaggccgaggctggcggatcaccttaggacaggagttcagggccagcctggccaaagtggtgaaacccccgtcactactaaaaatacaaaaaattattcgggcgtggcggagggcgcctgtaatcccagctactcaggaggctgaggcgggagaattgcttgaacgcgggaggcatcgttgcagtgagctgagatcgcgccattgctttccagcctgggcaacagagcgagactctgttcaaaaaaaagaagggccgggcgcggtggctcacacctgtaatcccagcactttgggaggccgaggcgggcggatcacgaggtcaggagatcgagaccatcctggctaacacggggaaaccctttctctactaaaaatccaaaaattagccgggcgtggtggcgggcgcctgtagtcccagctaatcgggaggctgaggcaggagaatggcgtgaacccgggaggcggatgtgcagtgagccgagatggcgccactgcactccagcctgggcgacagagcgagactgtgtctcaaaaaaaaaaaaaaagaactttattgcatttttttttttttttttgaggcagagtctcactctattgcccaggctggagtggagttgcgcgatctcggctcactgcaacctctgcctcctgggttcaagtgattctcctgcctcagcctc

SEQ ID NO: 20495 - DNA, 1019 bp, Homo sapiens
catctgctcccacctgaccccgcgtgccctgcagctaattctggatgtgagttgggacctttgggagtggaatgtgggctggggctcactgagcagcgagctgcaccaggggtgccgcttcagcctccagcctccctgccgggagcctgcggccggtgggaggggtctcaacgaggccttggcctggcctggccgcctctcctaggctccgttttcttctgggaaatggaggtctttggtcaaggctgagtggggcctggagaggagggcgggggctgcaaatgggtcagtggctggcacccctccccaggtgctgaaccccgagaccagtgaggatgagaatgaccgtgtggtggtgacggacgattctgatgagcggcggctgaagggtgcagaggtgttgccagcatgggccgggcgggggcggtggggagtgggacgatcggggaggtgtgtgacgcgcctgcctctaccacacaggacaagagcgaggaaggtgaggacaacagaagctcagagagtgaagaggagagcgagggggaggagagcgaggaggaggagcgcgacggggacgtggatcagggcttccgggaacagctgatgaccgtgctgcaggctgggaaggcgctggtgagtgggggaggtggaggggggggcggccggggagggctcgggtgtccccatgttgtgtgcctgcccgaggcctggctgaccgctgggcctctgtccctcagggtggagaggacagtgagaacgaggaggagctgggggatgaggccatgatggccctggaccagagcctcgccagcctctttgccgagcagaagctgcgtatccaggcccggcgagacgagaagaacaagctgcagaaggagaaggctctgcggcgcgacttccagatccgggtgagcctgggggcgggccgcacccacccccgcctccctgtgcgcccacccccgcctccctgtgcgcccacccccgtgttgctgacctgccctcctggctgcaggtgctggacc

SEQ ID NO: 20496 - DNA, 1048 bp, Homo sapiens
cctcactcgagtctggggttatccccagtcagatgagttcaatgtaattaaattagttaaaactaatgactttcaattctgtctctcatgccaagccaagcatggagggaataatctagaattatgaattgggggctggggcttgctggcttctctgggaccctgaccatccttgtcaggttctgcctttcttgagtgtccaagggggagttggactccttgtccccttcaggcttttggatcctgtaactgcgtattaggtgtgaaaaagccgtcagctagctgggcgcgggggctcacacctgcaatcccagcactttgggaggccaaggggggcaagggggtggatcacgaggtcaggagttcaagaccagcctggccaacatggtgaaaccccgtctctactcaaaatacaaaaattagccgggcatggtggtacacgcctgcaatcccagctacttgggaggctgaggcaggagaatggcttgaacctgggaggcagaagttgtggtgagccgagatcagaccactgtactccagcctgggcaatagagcgagactccatctcaaaagccctcagctcttggggtgtccagctggggtcttctgttctggattgtgggggtgactggccagggcgggccagtggctgggtgttggaggcttcttgatgccactgctgccatttggccagccccttgcctggtttagaagggctggggacagggcctggccccagtgtgtgtcctaccctgcccgcagtcccctgcagagagctgtgacctgctgggtgacatccagacctgcatcaggaaaagtctgggagagaagccccgccggagccgcaccaagaccatcggtgggtccttggtcacgagagggactagagtggtggggtggggccagcggtcccctatccgggctcaacccctccctcttgcagacccccaggaacccccgtgggtagaggtgctggtggagatcttgctggccctgttggcccagcccagccacctcatgcgccaggtggcccggagcgtgtttggcc

SEQ ID NO: 20497 - DNA, 1108 bp, Homo sapiens
ttgacctcccaaagtgcctggattacaggcgtgagctactgcacccagcctgtgcttttttattgacatgttaagtaataagatctagaagcaggtcttacaacgactataattgcaaattagtgatgcatgtgaatgatatttcaggatgtgttacaattataatgtgacatgaaaatgattctattagtgacagtcacaggtactgctgatactactgtggctatttgtctgcatttataagtgaaggaaacactacattttacaaataggctagtgggagtaatttttttccccatccatgatcacaggccccctatgattgtatatccaactaaattgtggttctcaggttaaacactcctgccctagcaccttcacacagcaggcagagaaagtgccgaatgacagattgctactccgagacttgctgccttacttctgctctagcagccttcttttttgaccttgtcctgccctcatacctctggttagtgtcttaacttccagcttggaccctcgtttttgtgtgtgagctggtagagagttggagtgtggagactgttttttagtactatgtccttttggcttgagggaaaaattttgcaaaaactgtcaaggaggaagcccagctgtctctgggacagggccaggcccttttcgctcccaagcaggaagccgaggaccagagctggcgttgaggagtcttttaccatgaaagcatgtccgtgcccggtgttgatgccccatagagggctttgcttcttgtgtctacaggaaaaagagacctgggcttagagtctgctgctgggaacggatgggatgtacatctctggctctcagagctggctcactggcctcttccttttttcctccacatccagggcaagctggcctcattttttctgtctagggtggatgccttgagccctcagctccaacaggtaaagggcagggagggagagggagagcccggggatctgagcctggattgtctcttgctgctcctcctctagcttttctgtcctgccttcatatgcccatctgtgtccttcggcctcattgtcccatctcaggtttccctcagagctctctctgatctccatct

SEQ ID NO: 20498 - DNA, 1029 bp, Homo sapiens
gccaacatggtgaaaccccatctctactaaaaatacaaaaattaactgggcatggtggcatgtgcctgtaatcccagctaggagggaggctgaggcaggagaatcgcttgaaccaggacctgggaggcggaggttgcagtgagccaagatcacaccactgcactccagcctgggctacagaaggaaactccatctcaaaataaataaataaaataaaaaagacaagatttttttaagatgggagagacttgagctgtataaatgtcagtgggaagagtcatgtggtggggactggttagaaattcaagggagataaagcgagtgacagtgtaaggttctgagaggaagggaggaagatagtattgaaagcacagcggagggactgtctttgggtaggaagagggcaggagagggtgggtaggatgaagatgaaatttcgaagtttgggagtgggaagcgaaggctgttttattaggttggtgcaaaagtaattgctgtttttatagttacttgtaattatctctgggcttcagttttttctgtgaagttatgggcaaggttaaacagaggtgacagtggtgggagaagtagcgatttggaaattggaggagaaaactttagtagcagcgttaaccagagaaatgtggtaggattactggacagggatgagggcctgtgtcgttggtaggcctgcctgtttttgcttcataagtattttctttttttgacacatggcctcgtctcgtctagcaggagatatatgctggatgtttttccttagatacatattaattttctaaggaagtccttttaaattcaaattgttttttctccatgggttccagggtgggtttgagccagttagcaacaacctcgaagagatggcacagtcttgttatggttgaggcttatttttcagtctgaaaagtgctcttctccctttctagcagggaacattagtatgatatcatcggaaaatctttccagggctgcggtgagccaagattgcgctactgcactccagcctgg

SEQ ID NO: 20499 - DNA, 1072 bp, Homo sapiens
ggaaaggccgagaaacagcctttcccacaggaaaaaaggggaaaagctcaaggcttctagtgggatggccttttggcctcagaggagatgtgacttcagaaaggcttcataggtgctgggacagagaagggcttgaagaatcttctgcatttttaacatcccgtttgtgactcgcttccctgttttctttcctccagaacctttcagctcttggggcattggtgagtctcagtaatgcacgtctcagttccatcaaaactcggtaagtctttggcccttttttttctccaggggcgtgttcccttaggaagtgggcatatgtacatctttgctttcattgtcaccgtccccaggattcaagacctctctctattcccaagagtgtggagagttacattccttttgtgagctcacttgatttgaaccctaccttttccagctcccagatgtcctattccaccctgggattacctctgctcccttctttctttgcttcttccacctcattccaagtatttcaggagttggaaaccacagtggatctggggatgaagtcttgctgtagcctagtgagaataaaagagcagtcactttctctgaagtctagcctccgcccacttaacatgactctcttctttctttgaaggtttgagggcctgtgtctgctgtccctgctggtaggggagagccccacagagctattccagcagcactgtgtgtcttggcttcggagcattcagcaggtgttacaggtgaggtttcagctgctgccctacttcctcctcctcccccatcttattccccatcttggatgtggcatgttcttttcaacttggacatgtagttctggggacagaataattggaaacaattccctgatagcagagaggataagcttcaaatagaaactttttttttgagatggagtctcactttgtcactcaggctggagggcagtggcatgatcttggctcactgcatcctctgcctcttgggttcgaatgattctcctgcctcagcctcctgagtagctgggattacaggcctctgccaccacgcctggctaattttt

SEQ ID NO: 20500 - DNA, 1022 bp, Homo sapiens
ttcccattgcccaccaagccctccctggctgcctccagctttaggcaaacagtaatctactttttttctttagagatttgcctattctggccatttgatagaaatgaattgtataatatgtagcctttgggtttggcttctttcacttagcagtcagttttcaaggttcatccatgtgtcaagactttattactcttttctgttttgctgtgttgggtcttgtgttgcctaggctggattcaaactctcaggattagtcaagtgattcttatgcctcagcctcccaagtagctgggactacaggcgggtgccattgtgcccggctaaaacttcattcctatttatggccttttatgcaatagtcccctcttatctgtgctttccctttccatggttttacttacctgtggtcaaccgtggtctgaaaatattaggtggaaaattccagaaataagtaattcataagttttaaattacgtgccattctgagcagcgtgatggactctcgaggagttctgcttcatcctacctgggacgtgaatcggacatgaatcatccttttgtccagtgtatccatgttgcacatgctccctgcctgagggtcatcttgtaaccatctcggtgatcagatccactgtggcggtattgcagtgctcgtgttcaagtcacctttattttacttcataatggcccaaagcgtaagagtagagatgctggcatattattatagttgctgtactgtattattagtggttgttaatctcttactgtgcctaactgataaaatctttcataggcttgtatgtataggaaaaaaacagtttatgtagggtttggtagtatccgaagtttctgaggtttcaggcacctgcctggggttttggaagcaccccctgcagataagggggcgctgctgcactatatttgatctgttcaccagtgggtggacgtttgggttgttttcccattttggttattatgaatgatgctgctgtgaacgtccatgtacaagttgttgtgag

SEQ ID NO: 20501 - DNA, 1088 bp, Homo sapiens
tgccaaataagcatgtttagagatagggaggtaaatgccaaaataaacatctaaaggtggtgaaagtaggccaggtgtagcctgagcaacgtgaggatactccatctctacaaaaaataaaaaaactggccgggcgcggtggctcacgcctgtcatcccaacactttgggaagccacggtgggtggatcacctgaggtcaggagttcaagaccaacctggccaacatggtgaaaccccgtctctactaaaaatataaaaactagctgggcatggtggtggacacctgtaatcccagctactcgggaggctgaggcaggagaattgcttgaacctagcagacggaggttgcagtgagccgacacagtgccactgcactccagccttggcgacagagtgagactctgtctcaaaaaaacaaattaataaaataatcaaaaaagttaaaaaaactagctgggcatggtggcttgcacctgtagtcccagttacttgggaggctgaggtgggaggatctcttcagcctggggcatcgaggaggctgcagtaagctgtgatcatgccaagggtgacagagcaagaccctgtctcaaaaaaaaggtggtgaaagtagttgcctctgaggaggaggaaattagagtgggaagggtctgctttttattgtaataggtcttgtagtactatctgattctttatatgtatatataactttgaaaacaaaaagtaaagaaagaatgaagagtgagagagggctgggtgcagtagctcatgcctgtaatcccagcactttgggagtccgaggcgggcggatcatgaggtcaagagttcgagaccagcctggccaacatggtgaaaccctgtatctactaaaaatacaaaaattagctgggtatggtggtgggtgcctgtaatccaagctactcaggaggctgaagctggagaatcacttgaacccaggaggcggaggttacagtgagctgagatctcaccattgcactccagcctgggtgacaagagcgaaaatctgtctcaaaaaacaaaacaaaacaaaaccaaagaagagaggaaataaaaaagagacgtaagtgta

SEQ ID NO: 20502 - DNA, 1032 bp, Homo sapiens
aaaaaataccaaaaaaattagctgggcgtggtggcgggcgcctgtagtcccagctacttgggaggctgaggcaggagaatggcatgaacccaggaggcagagcttgcagtgagccgagatcgtgccactgcactccagcctgggcgacagagcaagactccgtctcaaaaaaaaaaaaaaaaaaccatctggatgtggtgccacttcggagataggtttttgtgtttttttgtgtgcttggtttggtgtgatttgagacagggtctcactttgtcacccaggtggaatacagtggtgccatcatggctcactgcagcctcaacctcccaggctcaagcgatcttcccacctcagtctcctgagtagctgggacctcaggcatgtgccactatgcccagctattgttttaaattttttgtagagacagggtctcactatgttacccaggctggtcttgaacttctgggctcaagcagtcctcctctctccacctcccagccactcaaaaggctgaggtaggaggactgtttgagcccgggaggtcgaggctgcagaaagccatgattgcagcactgcactccggcctgggtgacagggtgagaccctgtctcaaaataaaataaataaataaataagttccttccctaatattcttcctgttattgaagccacctttgcaaaattatgactgagacagtgaaagagatctaacctaagcaactccatcttgcttctaagctttaagctgtgcttgttccttcctgagcataggctgaactaactttgagaggaacttagtttattgtttatagttacaggcgtgagccatcacacccggcctagagtttatagtttaaaacaaagacggtaatagccctttcccaaaacaaacctacttcttgcctgagaactagactgcctttgtagtactaacaaactagccaagagattaccaattatggtttaggagtccgggcgcagtggctcacgcctgtaatcccagcactttgggaggccgaggtgggcaggtca

SEQ ID NO: 20503 - DNA, 1052 bp, Homo sapiens
ctatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctcgtcctgatcctgtgatttctctgtccttggctattcttgcagggagctggaaaacttctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagccccaaatctggagagtctggggggtggctaggagaggggaggagactggacaaagaagctggagaataggaactggagtttttaagaaaaattgttaaagaaaaagcagccgctggttttttgcaaatgctgtataaatctgtcatgccacagcagctgacagggccagaaaaactcaaatcccaggcccggtgtgtttcctccagccactcgcccaagaatgccaccgatgcccagatcatctcacataatccccaggaaaagcccctcggtctgatgactgcttctgcagcctaaagagggaggaaataaagagacttagagaggaagtcagaccactgtgggctggaggcagtgcaggtggaaggccagggcttaagtgggtgggcactggaagcttgaggaaaggggaatgctggccagagacctgatctgggtccttggctggggagagtgagaaccttgtccatttctttagaagatgtgtggttcccaggccagccttcaaggagccttaaaacctcttgggg

SEQ ID NO: 20504 - DNA, 1049 bp, Homo sapiens
ccccaggaaagttgaagggacaagtcagatatgccattatgtgggtcatgaggtggtgagacttctctcccttcagggccggcggctgaaggagcagcaggaggtagcagcagctgtaatccagcgctgttaccggaagtacaagcaggtgagacccttctccctcaaaagtgtaaccagcaacccaccaacccacacccacgcctaaccattccagaatgttgccagagccctaactccccttctctctccacaagctgacctggattgcacttaaggtattaggcatgagctctgagtgtgaggtctgtgatgattcagtctttccttgagtgtgtgggttacagagagtcttgcatcagcctaacttgggtgagcctcagggctttgggtctccgtccctctatttcagcccctgtccctcctccccacccctgcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaagtagggcccagccccagccctctgtgcccacccactgcatccacgccattcccccttactcatcctcttgatcatcatgcctcactgccattccctgcctagggttcctgggggggccgaaggcatgcgatgccttctgtgaggtccatcttttgtttctttcaccagaggctcctttctcaccaagaagcaggaccaggcagcccggaagatcatgagattcctgcggcgctgccgacacaggtactcatcccttctccccctgggcttttgcgttgccacccgtcgtgatccgccagtctcctctgactcctatctttctctctgcaggatgagggaactgaagcagaaccaggagctggaagggcttccccagccgggactggccacatgacctggccaccgcctttctcaccaccct

SEQ ID NO: 20505 - DNA, 1034 bp, Homo sapiens
tgtgaaaaagccttcaggcggcgttcactccttattcaacgtcggagaattcatagtggtgagaaaccctatgaatgtaaggaatgtgggaaactcttcatgtggcacacagctttcctcaaacatcagagactgcatgctggagagaaacttgaagaacgtgagaaaaccttcagcaaggatgaggagcttaggggagagcagaaaattcaccaagaagagaaagcttattggtgtaatcagtgtggtagggctttccagggcagctcagacctcatcggacatcaggtaactcatacaggagagaaaccatatgaatgtaaagaatgtgggaaaactttcaatcagagctcagaccttctgagacatcatagaattcacagtggagaaaaaccttatgtatgcaacaaatgtgggaaatcttttaggggcagctcagatcttattagacaccatcgtgttcatactggagagaaaccctatgaatgccctgaatgttggaaggccttcagtcagaactcacaccttgtcagtcatcaaagaattcataccagagagaaaccctttgaatgtagcaactgtggtaaggccttcagtgggtggacagcttttcttaagcaccagaaacttcacattggaaaggaatttgaagactgtaagagtctacaaacaggacctattctaataggtagcagaaacctaatgaatgcagtaaaactaggaaaagtctgatggagaccacatcttattgcactacaaatgagttttattagaaaaaaaccatgggaaggtgggaaagcagagaaaatacctactggatttttcaaacgtaagtataatcaagtggaaaagccaaaagctcttggacataatcaccttttttttttctgtctcagaactgacactagaatatggtcccaacgatacaattttttaaattatttattttttaacatacaaagagatgaggtctcactatgttgcccaggctggacttgaactcttgggctcaagcactcctccctcctcagcct

SEQ ID NO: 20506 - DNA, 1053 bp, Homo sapiens
caggcactgaggcagagaggtgtgaggcaggagagctctggctgggctaaggatatggacttgatcctgtaaaataaagggaactacgggagggctttccactagactgggacgcgaacaagtttctaatgtttaaatatcaccttgatttcaatatggagatgatttagggacaaattttggaggcagggaaagttaggctgttacaataagccaggtgagagtgaagtctgaactcaaagagtggcagctagaatggaaaggatgagatgttatttcgagcgctggtaatttctgctggtgcaatatcagtagcaaagtggaggcaggaggcagactgcagcaggtggagggatgcctgggaagtcaggcagtgatgatgatcaagactgtggcaacagagggaggaagaaagagtggtagctcgggagaggagtgcaatccaaagacagactttttccttctgaatatgagacacctgagcctgttcatgcataatggaaaagatcagtcaagaggcagaagttcaaggcccggcactgcgcggggacatctggaaaagtcggagatactcagtcaaagcacctatgcaatgacactgtggtcagaagcaggtcatgatattctctgaagaaaaagaaaagactgggaataaaaggaaaacctgtaattgaggagcccagtagctgaaggtggccctgcctgatgcctgaggagtgaggccagcatctgctgagagtgagggggctgaggtgaggtgactctgaaactgccactgtgaggaatggaagagacgcaacttaggacacatgaaaggctgcatgaggaacactggaggcccatctggcagcttgagcatgcagtgtcaccaagtctcgtggcatcagcagctggggacagcaagactagtccaaggttgggcagtggtcaggtgagggcagcagcaggacaaggagtcaaagaccatagggacaggtgtggtgggagatgaagggaagaggcaggccagtaagatgcaacctaggggaaagaaagcaagccatgaagctgctg

SEQ ID NO: 20507 - DNA, 1035 bp, Homo sapiens
cagcttgggccacagagtgagacttcatctcaaataaataaacaaataaaatttaaataaataatttaaattattaaaataaataaattatttatttattttgagacagagtctggctctgtagcccaagctggagtgcagtggcgtgatctcagctcactgcaacctcctcagcccgggctggagtgcagtggcacaagctcagctcactgcagcctccacctcctgggttccagcgattcttctgcctcagcctcacgggtaacgggttacaggcatgtgccaccacacttgcctaattcttgtatttttagtggagacggggttttaccatgttggccaggctggtctcaaactcctgacctcaggtgatccacctgccttggcctcccaaagtgctaagataggcgtgagccattgcgcccagccagtgtgctataatttagaagatatttttatttcaattctttgatattgattgaatagatgccttgaatgtcctctcagcatgatttcagggaaataaatctgaaggaaagagaatcaaagagtgttaaaatagaaatttcttcagggcctggcgtggtggctcatgcctgtaatcccagcactttgcgaggccgaggtgggcagatcacctgaggtcgggagtttgagaccagcctgaccaacatggagaaaccccctctctactgaaaatacaaagttcgctgggcgaggtggcaggtgcctgtaatcccagctacttgaaagactgaggcaggagaatcacttgaacctgggaggcggaggttgcagtgagccgagattgtgccgttacactccagcctgggcaacaagagagaaactccatctgcaaaaaaaagaagttcctttagaagattttcatccaagttgtacaaaatgttttggaaaattattatctttattttagtaccactccagttgcggagagatttttcaccagttccacctctctgactctaaagcatgctgcatggtatccaagtgaaatcctggatccccacgtagtgc

SEQ ID NO: 20508 - DNA, 1275 bp, Homo sapiens
gctttcctttttatgtatctggatttcttttctaggagacaaagcttttgttgatttcctgagtgatgaaattaaggaggaaagaaaaattcagaagcataaaaccctccctaagatgtctggaggttgggagctggaactgaatgggacagaagcgaaattagtgcggaaagttgccggggaaaagtaagtactggtctggggatcccagggcagcaactcccttaaccttgcaggacccatcctgggtcatccccagaagagccttgagttcaggtgtggatactttgataaatgggtttcaagagagtgaaggattcatttggacaacttcgtaagccccaggcagtccattcaccgaacacaaatttgctgtgggctggttactaaggagacaaaaatgtagtgcaaaaaagtactggcagaatcagtttgatctctgatttacagccctgataaaataggacactgctctctaatgtttagtatgggtgaaaatgaaaaatatgtaacttctatgtaacaggatggggttacactgtagtaagggctgccatcagaggtggggagtttgtgacctaagtcagctcccccatcatctcctaaactgttaaagtgtttacacttttctgcattatagtcatccataatctcattacacagataaacatttggcatcttccaggtttttaaattgagcctgggcgcggtggctcacacccataatcccagcactttgggacgggcagatcatgaggtcaggagaaaatcctggctaacactaaaaccctggctctagtaaaaattaaccgggtatggtggcacgtgcctgtagtcccagctactcgggaggctgaggcaggggaatcgcttgaacctgggaggtggaggttgcagtgagtcgagatcgcgccaccgcgctccagcctgggcaacagagcaagacgccatctcaataataaataaataaattgaatttccttcataattgaccttatgatgtgtatgtaatttttttaaatcacagcttttatgagatttaattgagatggcatacgatttacccatttattgaagtttattaaattaagtggttcttagtcctcgcagaattatgcatcagttatcactacctaattctagaacactgttgtcatccccaaacaatacctattagcagtcactcattattcctccctgtagccaccccaggtaatcactaagctactttctctatgggattgcctcttttggacatttcatataaatggagtc

SEQ ID NO: 20509 - DNA, 1107 bp, Homo sapiens
aaagaagagtggtgaggccgggcgcggtggctcacgcctgtaatcccagcactttgggaggccaaggcgggcagatcacttgaggtcaggagttcaagaccagcctgaccaaaatggtgaaaccccgtttctactaaaaatacaaaaattagccaggcgtggtggcaggcgcctgtaatcccagctacttgggaggctagggcaggagaatagcttgaacctgggaggtggaggttgcaatgagctgagattgcgccattgcactccagcctgggtgacagagggagactcagcctcaaaaaaaaaaaaagaaagaaagaaaaagagcggtgagaggaaagacaggcgagcagctcagggtggctccttcgtggcttcaccacgggaagtttgcattgttttgcaaggagcagtagagacattgttgaaggtatttgagtggatgaagagtgattcgagttgtgctttaggtagattagcttggcagcagcaggtgggtgaatcggagtgaggagatggtgagatggtcaaagcgagagggaagggcctttcctttccgggccgtcctgatggaatttaggtgaggggtgggtcacccaacctgcctgtggtctggtggctaatgtgagcacctccctcccagccctaccttcacaggcggtagtttccctgtttctggtccgtgctcctccagctgggccttcttcccctgaccttgctgatccttggtgaccacctccgaatgtcagaatccacatcgttaggctcacaatgtgggctgcttttgccccagtgggtccagttgccccaacacgctgtgtagtgctgaccagtgtttacgtgtggggtcggctccattcctcgctttctcccgaaacagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcggga

SEQ ID NO: 20510 - DNA, 1009 bp, Homo sapiens
gcccaggctggagtggagtggcaagcagctggaactataggcatgtgtcaccacccctgaccaatttaaaaaaaagtgttttgtagagatgggatcttgctgcgttgcccaggctggtcacaaactcctggctgcaaacgatcctcccgcctcagcctcccaaagtgctgggtttacaggcgtgagccatcacacccagcctgttaccatttacacactgctggtaagggttctctccaagctagacatcaacttttaggctcatttacatttctatagttaagagaaataactctgggaaacatcatcaatcaccattgtctttttctgtgcaagctgcaattctatcaatgcctagtaaacccactctactttttttacaggaagccccttcttcacaggacatcctggtgttcctcactgggcaggaggagatcgaagccatgagcaagacgtgccgagacattgcaaagcacctcccagacggctgccctgcgatgctggtccttcctctgtacgcctccctgccctatgcacagcagctccgagtcttccaaggggccccaaaggtgagtgcaccacctcttctgtccagccctattctgggcacccagacggatccaccagcgaggtctgtacctgttaccaggctccagataaggtgtatgggatgggatacccaggtgccagatcagcgcactgaggaggtgcaggaataaaatgcgcggtgacacacgcagcgctcctgtgacaggagcagggagacagttgttgggatgagggagagtataaaccaaagctgcaaggtaaacgagtgacttctaaggaccagcataaattgcatttgtccatagtgccatttcttgtgtgcctttgccgtgccaggcactgtgctagcatttatatccactgtctgtcatcctcgtgggaaccggcaaggcaggttatgatcccatggggatcctgaggccccaagaagggaagtaacaattgctcaagggggcgcata

SEQ ID NO: 20511 - DNA, 1069 bp, Homo sapiens
agttttactcttgtcgcccaggctggagtgcaatggtgcagtcttggttcactgcaacctctgcctcctgggttcaagcaattctcctgcctcaacctcctcagtagcttggattacaggtgcctaccatccatgccctgctaatttttttaatttttttttttattgttagtagaggtggagtttcaccatgttggctaggctggtcttgaactcctgacctcaggtgattcgcccgctgcctcagcctcccagagtgctgggattacaggcacgagccaccatgctcggcctcaagactcttggtttctaaaactagtgctcacttttcctgctctgggcttggggtttaccatccttcaaatgaagggaccagcagaacagcctctcgagagggcagtttggcgatgagttatttagggaggcggaatgtggaattccctatggcccgacaattccaacgctgtgtgagagccccagagaggttctcacatgggaacacaagaagtgcacgggctgtttgctgcagcaccgtttgtaacagcgaggaactatgagacctaattggtcctttagaggagattagaaaaataaaatgaggtatatcacacaaccaaatagtatgcagcagtcaaaaggaacaagccaaatctacaaatactaatgtggattcatctcaaaaaacaatactaaaggggaaagtaagaagcagaatatgctgtccccatggtgacattccgtaatgtttgaaatacatacatacgagtatgtaacactcatgcatacatacagatggggaaaagctttagaaagcagattgggaggccaggtgtggtggctcacgcctgtaatcccaaaactgtgggaggccaaggcgggcagatcacctgaggtcaggagttcgagaccggcctggtcaacatggtgaaacacatctctactaaaaatagaaaaattagctgggcgtggtggccagcgcctataatcccaggtactcgggaggctgaagcaggagaatcacttgaacctgggaggcggaggttacagtgagccgagatctcgctactgt

SEQ ID NO: 20512 - DNA, 1075 bp, Homo sapiens
tccttcttttgtgggggtgaggaagggattgtcacttagctgcgaataggggtggagtgtgtcagtccaacagcttgttctgcaaattttcagccagtctcctcattttctaccccatactgcactctgccttcatgattctcagcactcttaacttcctgagccttcacgatgttttataggacaaatcagcttgtttttgcctggcatccctcccacccccacttacagactcttaggtttcagctccctctatgctgctaaatcagttatgattcttctgtgtgcgtttatcttctgaaaatcttgggcatttctcactcacgtgtgtctctttttgtagatttatgtatttatttatttccttgtattcaagtgggattttgggtgggatcagggataatcacttgtgtttaggccctcaggttgaccctgaagtcctgagacttttctttggtatatatgatagtacccttcaaagtatataagatgctttgttctggtagagacacaaatttgtcttcacatgtattctgaaggattatctgggagaagagaagaagtaaacgcgacttgcttccttttgttaacacgcgctcctgtagcatatgtactcattttcttgtaacctgtctggcttgcttaggctaaccaggatattgggaaacccaaaagcaagccaaggaagatagactgttccttgtgtgttcttaccacctgatcaaatgacacattttgttcacagttgttaggtggatgtagggaaaatctctcagcctataaagaataacaggttaaaatgtagaggacagagctattaaaatatgcctggatttttacaatattttcctctgctgttctttgaccccaagtgacagtgcatatgaacagtctagctctgtttcatttttatctcttctttttttattattttattttattttattttagatggagtctcactctgtcacctaggctggagtgcagtggtacaatctcggctcactgcaacctccgcctcctgggttcaagtgattctcctgcctcagcctcctgagtagctaggattacaggt

SEQ ID NO: 20513 - DNA, 1071 bp, Homo sapiens
cctatttatccctctatccatccatcagttcatcttatgttcgcatttcaaagttgcacatatcagcacactttacccctaaatattcagcatgcttattatcaactagagtttaatatttacttatggctctttttttcaagataaaatttacagataataaaatgcacagatcctaactgtgctatttggtggtttttgacaactggatacatgtctgttatgcaaacccctatcaagacatagaacatatcacctcagaaagttccctcatgccccgccacgtaggcaaccactgtgctttctgagttagctttgattgtctagagtttcatataaatgcagtcatacggtgtgtactcttttgcctagacttctttcattcaccatagtgttttataaatactatatttatgtcataaatacattaaatctgtgttgcttatttcctcttgctgttattaacaaatttaagtttgtaacaagtttaagccacatatttggtggcttaaagcacaaatttattctcctatagttctgggggggggggtcagaatctgaagtgagtggtaaaggactgaaatcagggtgttggcaagttcattctggaggctccagggaaggatctattccttgtttctttcagctcctaaattttgggctattaggaataaatctgctatgaatatattcatgtgtataatctgtgtgtatatcttaagtttttctcttggataaatacctaatagcaaacttgccagatcattagattagtttgtgtttaacttcataaaaaattgacaaatctttatcaaagcggccttgctcctatttcctacatccttgccaacatttggtgtcatcagtcttttttgtggtaaccatcctggtgaaggtgaataatgatatttagaaccttttcaagtgattttttttattttttgagtcacagtttcactctgttccccaggctggagtgcagtggtgcagtctcggctcaccacaacctctacctcccgagttcaagcgattcttgttgcctcagcctcccaagtagctgggactacaggt

SEQ ID NO: 20514 - DNA, 1003 bp, Homo sapiens
ttttttgtctgtgcctattggtgtttctgggttgccggcttctccagtacctactctgggaaatataaggcaaagagaaatcccaaagaactcactgctctgtcattcttttggtcccagtgtccctaggtgatgtgccttctctacttctctccgagtcctcttatgtttgcatatatttaatgtccaggattcttagttgtaattaacaggaagaagagtggaaagtacatttttcagcctcttcagaagcaaaaatctgagcatttctgctcattggcttgtttccaatgagaaatcagaattgctttttatccttctctagaggctcacagactctgctttctccccagggtatctcagattcataatgataggacttattgtgggtgtgttttcattcatcagtagaccttttaagcctggcaatttatttcctttaattctgagaagttttcgtgctttattttgtactttttttttcttgtctctgttttctctattctctgtttctgaaactcctgttctttgatgttggacttccttgattggtcctctgattttcttatctgttttttcctattttcttttttccctcttctacctctacccctaccctcccccagtaggagatttcctccaactttaacatttaacctattgagtttgtcatttctgccagtgtttaaattttaaaatttaaaaatgttgagagctctattatattctccaaatatctcttacttagtggtcgcctgtccttctttcatggattcagtgctgttttctttctgaatatattaacacatttcctctgccttttgacctacataatcttttttttccttcctcagatacctagtaatcttggctatcttctcatgtttaaacgtagggggagtgattgccgatcaaaaactcagagtatgtgggttggaattagtattttagttttctaaataattgtttctatcgtggtataatttacatatagtaaaatgca

SEQ ID NO: 20515 - DNA, 1022 bp, Homo sapiens
ctttaggggtacggagagattatgttacctactgagtagcttaatagagcctggattggtgctctgctctgcagtggtcctgatttctggtctgtttctgtgatgatgacaccctgcagtgtcgaggcagaattggtttgactcttttgactgtctgctaggctcgcttggcttgatgctgaaacttccaaaagattgaaggaactagaagagttaaaagccaaggaaattgacagcatgcaaaaacagaggtaaatatttgcttctgagttaggaaaaggtaagcaggcctattctacatctctatacattaatgataaatagagattatttaggtctagctacacttctgcctccttaaaagactgaagtcacttaagaagccaaggggggagccaagactggagctcaagggagccctgactctgccttgaggagagttggggtgactcttgatactgttctctaggcttgattggcttgatgctgaaacttctagaagaacaaaggaactgaatgagctcaaagctgaagaaatgtatagactccaacaattgaggtatgtgtttgcttcttaggaagaatagtggatgtttgcctgttctaattgatctagatagttctagcaaccaacctggactgttaaggcctaacttcattacatgaatgaatgaatagctgcatgtctacctgtatattataccatatttttttgctaggaaatgcttcttttgtgtggagtttgaaggagaactgaaaaaaatctgtaattgtagagaagttctgtctgaaagatcagagtcttatgtgtatttgtttggactaccctcaaaggtacttttctctagccagatgtcagtccttctaagggcagaagatgagtatgatgcacatacatgttctgctcatgtgaatcaacatatagctactttagtttcgtatgttagcttgagtgcaggctatggttttcaaatgcggttccctttttctattcactccataagtgttttttaaactatagg

SEQ ID NO: 20516 - DNA, 1114 bp, Homo sapiens
ggcatgaaaagaccattcattggattttggaaaatgcaacaatgataaataaaagctgtagggatatagaaacatgtttatgtttaagtgcaaaacgaaacaaaacttgtatttattatgaggaaaactgacaaaaacttgagcctgtgtaagaaagcataagcggactgtttcaagtgagatacacttaggggcagggtaaaagatggatccagccaccaaatgaagtctcaggaagacctgaagaagtactatcagatggcttggatctatccgtggagcaaattttaagaaagcttcaatgggttatattggtcacttgctggggcctgacattttgaaataggacagaagtccataactgggaaattgaaggacttagtggttgctgcttgaagctttctgggtttacttttagagatggttcccagtatgacattagtaaacagaaggataatagtatgggactggatgattataggatagaaccaggggtatgtgatgaacccaagggtgtaggagcgtggctgtgtctatcagtaaaacagaaaaatgcctcttagcactaatgatctggtggcaaaattttagaaatttgattatagacatataccaactgtgcaatatgaaatttttctgatgtctgcttacttttatttgctttttaaagaaccagctgcagtttaataggaatgttcctacacattcaagcaacttggcgatccgatattcttgcccacatgccattagaattgaaaaactgaagcactcatacaatgaatcataccattgtaaagatgcagattgtagagttggtcctgacctgggcagttctgtttcattttccgtcatatcccaagagagacttagctatgctgtccacctagccagaagagatgtgaaacgaagacaatttgaaaaacatataaaagaacatcatctcagaagtcagcctcaaagctctcagaagtgtggacatactaagtataaaatacccgaccacagggtggaaaggaaggaatcaaagagtcaagcagcctgtcagtgtagccaccagccatccaaagtagaaatctccagctctggtgccaaagtatacctttactcatctcat

SEQ ID NO: 20517 - DNA, 1013 bp, Homo sapiens
ctgttatagaaatggtaggctacaagatcgtttttaagagaataactgaattataccttggcattatttacctaaattatgttgttcattcacttacaaacttaaacccaggtaccctcagtgtttacacatgttagagctgctccaatatgaacacttccgaaaggagctggtgaatgctcagtgtgcgaaatttattgatgaacagcagattctacattggcagcactattcccggaagcggatgcgccttcagcaagccttggcagagcagcaacagcaaaataacacatcgggaaaatgaaaaactggatacaaacgaggcacttaatacatgtatataatgtatttcttttgtacagtgaagacaaaaaaaatgaaaactcttcctatctacctttattatggtagcccctagaacctttagtgtgctttttcatccaactttttattgttaatagactatttctgttaaacctgaattgttctttgatttccctgtggatttgtaaggtgtttttcttttttacgcatttagcataatcagctgattaagaatggaaaagttaggtgctttagaccaaataaggcactggggcatggggtaggggtgggccaccaagtatactgaattctaaggctagctgttcctgacatatagtagggcaagaccatctcctggaaccttactgtctcagatcaactactctaccactctactctaagatgtagtgagagtagcggagtcactgacctctttaaatcataggacaggaactgcataaaggttcttgaattctgcaggacaggaaataactgtattacctgctttgcaaggtggctttaagaatcactgaatcactgtggcctcacttgacctagtcatggcaggacaactagtggttagttactaactggactcttgactttagaacaaacatgaggagcctcaaatacttgtgttcatttgggaaagctaccattgatttgggaggtaccacaaaccaggtgct

SEQ ID NO: 20518 - DNA, 1050 bp, Homo sapiens
cttaggggcatcttctctagagctttaagatctttactaattattcaaacttcttataggacctagagatgcctccctagggtttgagagtaccaaaattaatgaagacctacagttaaatctcaaaacacctaggggctatcacagatggagaaatcagagaaaagctttcagattctatttccacagccttctcaactaaaatcaactcatcaaagacttaagagtaccgacaacaaagagatgaattagtctctgtctatgaataccacttagaaaacaactggaaagattacccaggtttaactctaaacggcatctgctttagttaccagttttgttaatgagctccatactaaactcagagagtttactcatactaattaacatcgtattaattatatgctcctctccacctgtcctaattcaagttatacctatttgtggacctagaaggtaagagtaaagcagagggctgatctgctttttacacaatttccctttgtctctttgaatttcatgctttcatacatcatctgtgaaggaagccaagagagaatgaaattccacttaagtaactggccaaaggtaccactgccaaaatgcccctctctttaagatccatgttttagcagaaacccaaaagatgtacaggcatctaaataatctgaaaaatgcaaactcatggatctccaactgaaacaactcatggggaatcaccccaaggccttgaagtcacctcgacatccctacgatcatgagtagtctggagcacctgtaattatctcaaggtccaaaaagaaaaacgtcagcatcccagtgactcccctttgaggaatctgctcttgtgcaccccctgatacccttgaacacacagggagaaataataatcccagtcagtgagcaccctatgacctttctaatagatactagaaccacctactctacccttaaccctcacaattccttaccataatgcctcagtagtgggggtggatgatttgcctctttctaagccccttttggtgtctcttggactccatcatgccc

SEQ ID NO: 20519 - DNA, 1033 bp, Homo sapiens
aaccatcaggagagaatatgagcccagcagggactgtgcagacccctcccagctgtggatatggcctggggggccccaggatatggcagttcaggggcatctgtgactggggtgtagtgggactaggggttgatggccagggtctctgaggaggacagtccttgggtctctagaattgtcctgagtcggaggaggtgggaatgggatacacatgctttcccgtgtggagggaggaagggaggcgtgatgagaggctggggtcctgtccccagaagggcagggctgggaaggcgccctggcagagtctcccaggagcttcttctgtctctagaatggatcttacctcggtcctgggcctggcacagccccacctccgtgatctcccgacaccaggcctgcagctcagggtcccccttcactatgtcatccctttggtagaagaggtggacgatcccctccacatacctgcccagggggaaaaggcacttgagggcagaaagcccccgcctctgacctctattcctctttctgtggcatctgcccaatgcttccacagtatctgggaagacacctcgcctttgggacatcctcagccctctaaacacactagcatctcatggaagatgtgggtccttagttctaggaattcgcatggttgctgtcatacatcgtcagaaaatcctgatttttccagacacctcccccagtctccccccacagctcccctcacctcctctctctgcctcatcccagtctcctcattttcagagccacccactgtgtcctcacttttcctcatctctccccaggattgagttctctgcttctcctttctggaccttcttgcttttgccccatgctggcctcaggccagagccccccccccccccggccccaccatttctcagctcctccttactcacctggcaatgatctcccagagccgtaaagcatcatgggcatagagagcacctgggagtcccagcaggccccggtcagccaggtcgtcaggaggacagagggagcagtaggt

SEQ ID NO: 20520 - DNA, 1063 bp, Homo sapiens
cgagaccagccaggtcaacatggcgaaaccctgtctctactaaaaattacaaaaattagctggatgtggtggcatgagcttgtgatcccagccactcgggatggtgaggcgggataatcccttgaacccgggaggcgaaggttgcagtgagctgagatggcgccactgcattcccgcctgggcgatagagactacttctaaaaaaaaaaaaaaaaagaaaagaaaagaagtagggatgtttgaagaacacagttttgcagtgagcaagttgtacccactctagtgaggacagtgacctcagaataattgagagggatcatttgaccttgagaccccaggacctaacaaataaacactatcattggctagaataactttgtagttcttgtccatttattttgtgcatgttgttcttaaaaggcttgtgaaagataacttggaatgtgggaaacacatagatcccagagtattaaaggggctggaaaagtagccttaagacatgaattatgtgcctttcatctgggactgtttggagaaagaagccattttggggcagtggtttgtattctgccccaaaaacatgattcttattcagggacttttggggtacatgggtgaataggagaaatatgggtggaaggaatttgccaaagaactgagtcaggaatttgtacattggccaccaggcatgaaggttagttcctgggaatggagagttagctgaggtaagctgatttttctaagaaatccccctgctccatgatcttggatgttttggaagtagggtcagggcctcaggctagtgcagggttcaagggccaaatccagtctgtagcctggctgtgcatgtctcaaacaaagcacatttgtttgtggattttttttgcattttaaatggttgaataaaccaaaagaagactactttgtgatgtaacattcatatctcagtgtccataaagttttattggaacatagtcacactcatttccatgttgtctgtggctgccttcatgctgcagcaggagagctgagtagttgagacagtgactatgcggtctgcaaa

SEQ ID NO: 20521 - DNA, 1050 bp, Homo sapiens
cagggggacctctcccatcctcctcgaaagaaggaccgaaagaaccgaaagttggggccaggagctggggctggctttggggtgcttcggaggcctcggccaactcctggggatggggaaaagagatctcgaatcaagaagagcaagaagcggaagttaaaaaaggcagaacggggggatagactcccacctcctgggcctccccaggcaccccccagtgatacagactctgaagaggaggaggaagaggaggaagaggaagaagaagaagagatggcaacagtggtagggggtgaagccccagtccctgtgctgccaacaccccctgaggctcctaggccccctgccacagtgcaccctgaaggagtccctcctgctgacagtgaaagcaaggaggtgggcagcactgaaacaagccaagatggagatgccagctccagtgaaggcgagatgcgggtcatggacgaggacatcatggtagaatcaggtgagaggttcgggctggggcgaggggtttgagggtgttgtggatccaacagctcaggcagaataccaaacaaacctttttttccccaggtgatgactcatgggatctgatcacatgttactgtcgaaagccctttgcagggcggcccatgattgagtgcagcctgtgtgggacgtggatccacctctcctgtgctaagattaagaagaccaacgtccccgacttcttttattgccagaaatgcaaggaactgaggccagaggcccggcggttaggggggcctcccaaatctggagagccctgatggcaccaactttagcctggaacttccaaatgacaacatgatttgggaactgagcctcagggtcctcagcctatcccctggagcttggatactgtctgcacttcaaggcaggaattctcaagggagacttgtttgaaaatgagtgtctcactttcccaccctatccttcctccccactctgtggacttgaaattgaatccattacggttggggatgggaggctgtctgtgtcccgacacataatctctgtctcttggac

SEQ ID NO: 20522 - DNA, 1029 bp, Homo sapiens
gagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctcatg

SEQ ID NO: 20523 - DNA, 1132 bp, Homo sapiens
atacagccatgatctagacaaaatcatattctcatggagttttcattttaattagggagagaaacaacttaagataattcctagctgtgtggcctcagtttctttaaccttaaaacaggtataacagtaatattatggttgttttgaggattaaatgaaaaaggccagcgtagtggctcattcctgtaatcccagcactttgggaggcaaaggcaggaggatcacaaggtcaggagtttgagaccagccaggccaatatagttaaaccccgcctctactagaaatacaaaaatgagccgagcgtggtggtgcacgcctgtagtcccagctattagggaggctgaggcaggagaattgcttgaacctgggaggcggaggttgcagtgagccgagatcatgccgctgcactccagcctgggcaacagagcgagactccatctcaaaaaaaaaaaaaaaagaagaagaaataagcctaaattacatacatagtacctgtggtaaatgttcattatgtgctccctgttactgttactggggaaggcttccttatcaagggtttcaatcctcttttgtgctatttgtaggtaattcagtaccaaactgttcgatatgatatcctccccttatctcctgtgtcccggaatcggctaggtaagtatgtggtgggaagcctcctttagggtgaagtaggggctagctctgggtcagaggtcggtcaatattattcctccccactctggttcagcccaggtgaagaggaagatcctggtgctggatctggatgagacacttattcactcccaccatgatggggtcctgaggcccacagtccggcctggtacgcctcctgacttcatcctcaaggtgtgtggtggtggggagtgatgaaatggttccatctgttcctctgcccaaacctggactccctttcccagtcccagagcatctgtctccatccgctggcaccagtgtcagcctggaggagggaagcagatgggtggggcgttttctaggcctgggttgtggtggtcatgacatcccccagcccatcttgttcctctgtaggtggtaatagacaaacatcctgtccggttttttgtacataagaggccccatgtggatttcttcctgg

SEQ ID NO: 20524 - DNA, 1034 bp, Homo sapiens
tgggggttttgatggggctagatgggacaggatttggcaactcttgggggctaaggtggtgggtggggcgctctttaagaaagctggagttgttgctaaagaaaccaagaggcggggaacacctgtttgatgacagccggatctgtggatgtgggcttgggaaagaccctatttggaacctcggtgtgtgtttggtcctataacaaggaagagacagacttgtgtgtcaagggtggaggtgggtgggagggcatacgttacaaacaaggacgggaacttgggaaagccctgggtgtgaaggagaaacgcctgcggttcccattaagagaattcctccaaaaaggctgtgaaaatttatttcatagtgtgagtgtaggtatctggatttattgaagactaaagcagatgcttttacgatgggcctctttaattgtgggagggagttcaaggtgggtgctgtgcccaccattgaagtttgggtgtccctgtcagaggacagcgctgggcagttgtagggcttgaaaatgaggacgtttgcttctccaggagagcctagcattctgagggaaactgtccggatggacccaagcatctctgggtcccctctcccttagcttttctccaaggtcagaggtccttcagctaacagcactttaaatgaatgtgctcttgtggtctcaccaccaccagggagaatcctcggaaggagtctggggagaatttagtaagcggagacacaggttctgggtctgtactgtggtctgtaccccttagcatacctcaatacaatttgaaagaataaacccaggttggggtgacctggggtccagagaatttccagaaagccctcagtggtagtggtggttgatttaactgatttgggagaatgggtctggccttgggttcattctgtcctttaccagtctgcttccacttcctgatttagggcgcgaacagtacaggatggttgtggctgtaggcagcagcgctattcccccgagacaagagctaggagccaagaaaaatttagggtc

SEQ ID NO: 20525 - DNA, 1027 bp, Homo sapiens
agatgatggaacagaagatgaaggaagaacaggagagaaggaagaaaaaggagatggaagagagaatgtcattagaggagaccaaggaacaagtaagcagtcccttgaactttcccagctttgatttcttcgtttgactctccctgccttcatcttcttttcccaccccatcccagattctgaagttggaggagaagcttttggctctacaggaagagaagcaccagcttttcctgcagctcaagaaagttttacatgaggaagaaaaacggaggcgaaaggaacagaggtgggatcagagtgctaaaaactgaaatgggggccaagtggaactgggatcaggtagtaaaagaaccagtgtttaatggcaaaagagaaggcatctgtccttgactttgacctgtcttcctttcactccagtgacctgaccaccctaacatcagctgcataccagcagagcctgactgttcacacaggaactcatctcctcagcatgcagggtgaggactaaagaaaccaccagatggaaccggccttcttggaggtcacagcctcccatttcagcatcatgaagcccttctccctttctagggagccctggaggacacaatcgcccaggcaccctcatggcagctgacagagccaaacaaatgtttggaccccaagtgcttacggtgagagtaggattggatgcctagcccctagtacttccatccatgcatccttgccaccagtattcaagtcacaaacatatcaagcacttaagtttagggggaaacggggcatacagatacacacaagtcactgggtttcagctttcaaggagtttgtaggcgagttctcattctccttccttagacccggcactacgtgggctcagcagctgcttttgcagggacaccagagcatggacaattccaaggcagtcctggtggtgcctatgggactgctcagcccccacctcactatgggcccacacagccagcttatagtcctagtcagcagctcagaggtgagtaataggagg

SEQ ID NO: 20526 - DNA, 1035 bp, Homo sapiens
tgtttgtaggagcctgtctgggctgctgagctgggaggcaaactggtcagaaaacacatgtggggagggaggtggcgtgacaagggcagtgtgggcctcagacccaagaggccagccgcaagcaggctgtgtgtgcgtgcctgccgtctgtgtgcttaagtggcggtggggctgcggaggggatttggtatgaggaaggcgggagataaatgcagggtagcgcatggaggccggcgggaggcatgggtgttgtcagatggcccagctaatctttgcagggtctgtatgtttgcccctcatgagcctgcccagcgtgtcagggtcacccggaggagaggctgggcggccacaagggaagtaagcttagacagagaggctccttggccatgtttatgtaaaggctgggtgtgactcttgtcactaaaatggaaaaaagaaacgtgaagttttcagcctcctcctgcttcaccctctccctctctctgccccccttgtgggtatctctgacgcacactgggccccactcctgcgacggtggaagggcctcagaacagaattcgctcactaggcagattcctcagaacaggttttcctcacctttggggactgggcccttctaggggtgtgtgtgcaagtgcattccaagcctgcacaccactgtctactgtgcccggccccactggaaggatgtgtgtacgtgggggaagggagggtgctgcggacaggccctccggcatggggggctgggaaggggtggctgccgtgggagcctgctcaacaggtgcacagtgacggtctggtgaagagaaaggagccatggtccagggctgaggagctctggcgtctttaccattccctcactggcacttgatctgaaggaagctcagttcctcatctgcagaatggggctgattgtctgccctgcgtatcttccaaaagcacatgggaaacggacccggaaagtggctatagtctgggggctgtgcctatgccagcccctgtcagccctcccccaggactgggaattcccttctt

SEQ ID NO: 20527 - DNA, 1064 bp, Homo sapiens
ggtgggattacaggtgcatgccaccatacctggctattttttttttttttttggagacagtttccctctgtcacccaggctggagtgcaatggcacaatctccgctccctgcaacctctcgctcctgggttcaagcgattcttgtgcctcggcctcccaggtagctgggataataggcacgcgcccccacgtctggataatttttgcttttttagtgtttcaccatgttgcccaggctggttttgaactcccgaccgcaggtgatccacctgccttggcctcccaaagtactgggattacaggcatgagccactatacctggccctaatttcagtatttttagtagagacggagtttcaccatgttggctaggctggtcgcgaacccctggcctcaagggatccacttgccttggcctcccaaagtgctgggattatagacatgacccattgcacccggcctaatttttgttgttgttttttaattttttgagacggagtctcattctgtcgtccaggctggagtgcagtagtgcgatctcagctcactgcagcttgtgtagttagcgcagagtgagcaaagggagaccgatacaaaattcggtcagagagtagatcatgtaagacatgtacggtaggctgaggaggggggattttattgtgcgtatactgagaagccattgagttaacagtgccttctggttttttgttttgttttgttttgttttgtttttgagacggagtctcgctctgtcacccaggctggagtgcattggcgtgatctcggctcactgcaagctccacctcccaagttcacgccattctcctgcctcagcctcacgagaagctgggactacaggcgcctgccaccacgcccggctgatttttttgtatttttttttagtagagatggggtttcaccgtgttagccaggatggtcttgatctcctgacctcgtgatccacccacctcggcctcccaaagtgctgggattacaggcgagagccactgtgcccggccgaaagtgccttctgttttaaactcctgtttcaatgacagatggaa

SEQ ID NO: 20528 - DNA, 1095 bp, Homo sapiens
tcacatcttccccacgatccaagcacatggagaattgtctttcttccacacggtccctttgggaaggccctctgtcccgtaaaagatcctttcatcttcctcagagaggcctctgcctactggctctggaacactcaccccactttcatcttatattccggttcccaagccaaggagaaatggtcagatccatttacgacgtttggcatctttgacctcaggaaccctgggttggatcagtcaagttgcttcccagccagccataaggtggcatctttcgcaagtctctctccccaccacaccttgatctcaagacccactgctctaccattctactcaggaatggatttgaggtctcacttagacctcagataccttcaggtcattcatatagtttcttcgtcttgaggcatgtaagcttcatagtcataatctctaaaaggatctctgaaaggaagcttatgaggttcccttctgtttatcttaagatttccacttcttgaagactcttggccaactatcccagttcgggaatctgacaaccttttttggaagacgggatcatctttcaaagacccttccttatttcacctccccctttgcccaggatttggttccttagaactccttataataccaccttccttatctgctctgaatctattttctaggacatttttttcccatttagattaagccagagagagccctttcttgcctcccaagagtttttctttgtgtgactgttggtattctgaacctcttggatttgatgcctggaattgtcctagagactctcctgatttctgtctcattctttgatttcaccctggggagctggggaagagataccttcccatggcatcacttgttaagagtggatcccccttccccctttccttcagttcccctcaggcctttttcccccactgtagtcctctctagtttctcatgcccttggaaatgtctttctttgactccttctctaagtcatatttttctataactgcagagggtcttgtaatttctcttgggtggtttctgcctgtacttcagttgctaagtgcattgtagtcatttttttttttttttttt

SEQ ID NO: 20529 - DNA, 1050 bp, Homo sapiens
ataaaacatttaaaaaatgcaaatgcccccaagaggtaacacttcatgctactcaagagctgcaggaaacagctttcagagctgagggtcttaaggcttacccagggtctgggcgggtgagtgagcctgaggctaaagcaggttatcactgcatatgtcaatttaaaaagcactgcgggggagcctttgaaccgcggggtatctcgacccaggttgggacacccacacaaccgcaaggaagccgcttcactccaaccttgaactctacccaggagcccagtcacaagatccagctgtcgggggtggggcttgggggggacgcggccgtgcctgttctccaagctgattggctgacagttgtgccccctgctgcgacagaattcgagggggtggggctatgcccggacagaggatcgcctcgctggcctactctctcctcccgtacggcgccggaatcccagctccacttaccaggccgcggctaccccgccgtcccccccgactcccgccaccccgctctctcaggctcttcaggatccaagtccgtaggccctttaaggggtctagttgccgtttgcgaggccctgggactttggtcccagacagcggggatccggatggcttccgtgcggatccgagaggccaaggagggagactgtggagatatcctgaggctgattcgggtgaagactgcaggccggtaacccgggggtcagagtggcgcggccagagcggggtcgtaggaggcgggggcagggggaggggctcgccttgggaacctgctcggggagcagcggggcccttctgctctaatctagcttccgtacccacgccttaggagctagccgaattcgaaaaactctcggatcaggtgaagatcagtgaagaaggtgggggctcagcgcccaggttctggcggaggctggggaggaaatgagggatgggttccccaggcgacagctccaggctgggcatacacccacgtcctctttctctatctctttgtcacaactccaatctcggcagccctgagagcagatggctttggag

SEQ ID NO: 20530 - DNA, 1002 bp, Homo sapiens
attgcttgaaaccagaaggcagaggttgcagtgagcctagactgcaccactgcactccagcctgggcgaaaagagccaaactccatctcaaaaaacaaacaaaaaaacaaaacaaaagaaaacatggcaaagcctttgaaagcttgtctgggagaaggtgcgatgatagttgcataacttcgtgcaagatgctggtccacacaggggctgccccttgctctttctcgctctcttaacctctcatataacaggcttgtgtgttattcacatttattgagcccaagcaggtgcaaggcattgtgatctaatactttggtcagcaagacaacaagatagatcactgccctgcccttaggaagtgtatatgctattagaggaaacagataaaataaacaaggaaaagtatcagacaatgtaagtgctatgagaatgcaaatgaggtgatgtgaattaaaataggatgacttaaagtctgcacgggaaggagcctacccccatgttcctggctagccaaggaaccaccagttgattagcagagaagggcagccagtctagctagagcttttggggaagagggagtggttgttaagagatgagattaaagaagccgagacgggccattcgtgaggggtttgtaatgcagggctgaggagtgtccgaagagaatgggcaggtgagcggtgagacagttgttcttccagaagctttgcagtgaaaggaatcaaagaaatggagccgtgtatcaggtggggaagggtgggggccaagggggtgtccttccccatacagagattgcaggctgagaatgactatatccttgttaacaggaggtgggagcagggcacggtagctcacacctgtaatcttggcactttaggaggctgaggcgggccgatcacctgaagtaaggagttcgagaccagcctggccaacatgcaaagccctgtctctactaaaaatacaaaaattagctgggtgtggtggtactcgcctgtaatccca

SEQ ID NO: 20531 - DNA, 1064 bp, Homo sapiens
gtatctcacaggggccaccttctcctgtgctgggccctggtgtcccctgccagaagacacactaaactcttcctgatttgttttttgcttgctgctgccaggaagttcaactgtctgtcattctcaaatctcccctccttaagttaaaggagaccaaatctagccattacccccaatagtggttctcttttggtcaccaggagagttttctgacttagttagcatctctgtttacattacccctgtcgagctccctcttttggagtcaccgtcttgcaaccctgtcttcctcatcttctccaagtggcaaactgcctcctttttctccctcgccaaagtgtcactaatttgccggccttttccccactctagttttccttcaagttagtaaatacccacctctttgccccaaaaggtcaggagagaaatctggggtatgggattaacaaagaagtagccccaatagctattgcttaactgacacttagccttccttgcctcctcttcgccacaggagaactctgcaaactcccttccagagacaataactgcaaactatacaataggaccacaatttcctattgtgcagggatcctaggacaaagccacatcccaaatacttgctgagagcagtggctacaaatgttaacatgagattagacattgagatggtccctttatattgagagaacatggactttggagttgggcagacttgaatttgcattctggctctagtggttactacctagtgtggctttgagctattaaactttccaaagtttcgaaggacttatctgtaacatagtaatggtaatccaccttatggggtagttgtcttgaagaggctatttgggaggctgaggcaagaggatcacttgaggccaggaggttgaaaccagcctgggcaacacagcgagaccctgtgtctacaaaaaattaaaaaattaggcattgtggcgtgcacctgaagtcccagctactcaaggcagagatgggaggatcacttgtgcccaggagctccaggctgcagtgagccatgattttgccactgcactccagac

SEQ ID NO: 20532 - DNA, 1090 bp, Homo sapiens
aataaataaattttaaaatagaagtaactcaacttctgagctatggaatagttctctgtacctccagtacctaataaagaacccaaatactgcaatatatcttttcgattaaaagattttttgttttttaattgattaaaagattttatctggtctgctcatccttctattgctgccttttagctaaatccatttccttgctctcactgagtaaggaatatcatcttaatcagaaggaggaagatgtaagcctaaaattgttgtaattgttgtctttgccttctgcaagttttttagatctgcttttaaaaatttattttattttattttatttttaagacagagtcttcctctgtcacccaggctggagtgcagtggcatgatctcagctcactgcagtaactgcctcccaggctcaagcaatcctcccacctcagcttctggagtagctggggttacaagcacaggggccaccatgcccagctgtagatcttcttcgattgaccactgtgatggaaactgaataatcctatacaaaatggcaaaaaccaaactttttcccatttgacattgctttttaacaatttcttaatagttttctgttggctggccagctagaagtatcttgcttttcatctgttttcaagccccagttgttccagcagaattgcacacttttcccagctgattaactatcctttaggttataaatttgtcatgggaaatgctaacccacactggcttcctcttaccccttcacttgctcttgggccctttcaccatctagcactccagtctgtaaaggaaaatatttttttttcttttcttttttttggagacggagtcttgctctgtcacccgggctggaatgcagtggtgtgatctcggctcactgcaacctctgcctcccgggttgaagcgattctcctgccttagccttccaagtagctgggattacaggcatccaccaccacacccagctaattttttatatttttagtagagacagggtttcaccatgttggccaggctggtcttgaactcctgacctgaagtgatccacccgcctcggcctccgaaagtgctggga

SEQ ID NO: 20533 - DNA, 1456 bp, Homo sapiens
atttttgtatttttagtagagatggggtttcaccatgttggccaggctggtctcaaactcctgacctcaagtgatccacccaccttggcctcccaaagtgctgggattacaggtgtgagccactgcacctggctaattctttatctctactgttgcctccagattccctcatcttgtgtaagaagcccctatttctttaaggctgcagcagtcttgctgtgtgctccttaccttctcttcctcagtgttttctacttatctcctgacatttccttcattcattgaagactgacatctggcttagtcctgccatcatcttgggtgaccttaggatccacatgaatgatctattcatcacccagactttttggtcccttgatccccttatttccagagacctttctagccatcccacttctggccccatctctggacttccttttgaagtattaaattcaaacccccaacttgggccacaactttctatccttctagccccctcatttacttctactctgttcttggacccaccatgagacaatgtagtcccttagctcctcattttctcctaatcagctataccatcttcacctcttttcctatccagcttaagttccatggtctatcattttaaccatgctcctgccactgtcttggtgccctcttcttattttccttcctgcaaacccctggccttgtatcactttggttgcttgtttacacccaggatgcaaagggctgctgaagaaaacaccatgaccattcagaccagtgtttctgttcaggaatcctttttcctagtcagctttcttttagttctccacagtgacttcctcaaaaccttctccttacactagttcattttaaagaaaaggatacctatgttcattttaatatcataatggatagaaaatcttatctacttccaggagatagattatcatatgagaactcccttgaaattccaatactcaactacatgtttaactctatccatatttgtccttttatcctgtcctcctgtcctgtctgaagctaatgcctatacttgggctcttagtctcacccctgccaccttctcagggactaatggttagcagcgatcctctaactcagtcctttatttccgattccacttgctctttcccagtcacattaaaatgtgctcaaatctccttatctttgaaagaaatactctggacccctttagctgccaccttaccgcactgtgtccattcacagccaagcctcttgaaagcattaactgccctcagtgtctacttccctactcattttccagccctctgcccccaccacagctgctttcaccaaattaccaacaacctcctggttgctgaaaatcagaggatgttcttagttcttcacttgaccaccccctttttgaaaaaaagaatttgcttgacgtctgtagtttcgcattcctggtttttccctt

SEQ ID NO: 20534 - DNA, 1045 bp, Homo sapiens
tggagaaggcatgaaagcaccggtagtactaaaaagtaccctataaatataggcactgttaataagtaacagtaagctgagcttacatgcacacagagtaggtagaggactgccctgctttctcacttagtctatatgaattctgtaaggtcatgtgaatccagatcctttaggttgtcgacctaggcctaagaagtttgtcttcctcctagtctaaaaagctttctcctgattaaagccttctggctccactcacatgccaccttagagacattttataactctttgaaggagacaaagacacaacctctaaccaggtctctttgaaaaagatgataataaaacttctacacacaatgcactgttctttcatttctgcttttttactgcctgttttcctgagtttaactgtttcagcctctatctttgtgtctctccactctttccctctttccctctcttacttctcttttcttggttctttcttcttatctgtctgtcttgatctctattctagcctctttttctgattggccctctcccctctcttctgtctgattggcctgtatccttccatcaccccatctgtctgctggattctccctgtctgcctgcagtaatgtatgtgatagcactttataaattataaagcactatgttgtataaaacaccattatcactttgtcttccttcttaccttattttttcttcctttatctgtcttcccttcttctctctttctctctctctctgtttgcctgtctgcatcccttttggtgattttgcctgccttctctgtcagtcaatctccattccctccctgccagcctatttttctgccatccctcttctctgtctgctcagttcttgcatctctccttctgtgtttccaggtttctctatatttcttttgcctgtgtagtctctctgtcgttaggccttttatctatgcctgtgtgtctcactgtctagctgcttgtctccctgcctgtcactttcattgtggggcatcagtctctgccttcttctgtctttcagtacttca

SEQ ID NO: 20535 - DNA, 1618 bp, Homo sapiens
ttcgagcgttgggagtgcactacgtattggtacatttttgtcttctgcaggtgtggtagcatccaatatttggggatgagggaggaaggttggccctaaacctgaaggtttttcccctacccagccctttcctccatgtgtgagataccagatccactcaacatcctgtaggcttttaaagtttcatcccctaccccccatgccacctgccctacactttcagaggtggggtctctggtttggagatttgggtatttatactgaaagggtttctgaatctaccacttgccttggtagtgcccttccagctgtcactgaaatggctttattcgtcaccgtctttgggctgaaaaagaaacccttctgattaccttcatgacgggaacctaaggacgaagcctacaggggcaagggccgcttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttccc

SEQ ID NO: 20536 - DNA, 1070 bp, Homo sapiens
ttttagtagagacgggggtttcatcatgttggccaagctgatctcgaactcctgacctcaggtgatcccccgaccttggcctcccaaagtgcagggattacaggcgggagcaaccacgcctggcctaaaatagtattcttaattcagtgcccacccaatcaaaaaagttgtaacttccccatctcagtcaatagcactatcatttagcacccagttacttgggtcaaaaacctagaaatcattcctggtttctctcttttttcttcctcacctccccagatcttccaactcttcctattgccaaccaaatccatggagaggcccacctttattacacacacaccccatcactctcatgctggttcaagtcaccatcctttctggcttgggtgataacaacctcctaactattctctctgcttcttctgttcctgcctcctagagtccattcccccaacagtcaaagtcagagcatatcattcctctgttcaaaaccctcctttggtttttcggtgtatttacaataaaatcaaaactccttatcatggctggcaaggtcctatcttcaggggttatcaacaatggctgcacattagaaacatctgaaggacttaaaaagaaaataggagaccgggcgcggtggcttacgcctgtaatcccagcactttgggaggctgaggcgggcggatcacgaggtcaggagatcaagaccatcctggctaacacggtgaaaccctgtctctaccaaaaatacaaaaaaaaattacctgggcgtggtggtgggtgcctgtagtcccagctactcaggaggctggggcaggagagtggcatgaacccaggaggcggagcttgcagtgagctgagatcgtgccactgcactctagcctgggcgacagagcgagattccgtctcaaaaaaaaaaaaaccaaaaaacaaaaaactcccaggccttgccctaacaaattcagatttcattgatctgggttgaggctggagcatccatgtcgcttttaactccccaggtggttctgaggggttcagaagcccttccctaagagttctggtccttc

SEQ ID NO: 20537 - DNA, 2584 bp, Homo sapiens
gtctagctctgttgcccaggctggagtgcaatggtacgatctcggctcactgcaacctgtgcctcccaggttcaagcgattctcctgcctcagcctcctgagtagctgggattacaggagcgtgccaccacggccagctaatttttgtatttttagtagagatggggtttcactgtgttggccaggctggtctcaaactcctgaccttgtgatccgcctgcctcggccttccaaagtgctgggattacaagcatgagccaccacgcccagccgcacccagctaattttttatatttttagtagagatggcgtttcaccatgttggccaggctggtcttgaactcctgactgcgggagccactgcgcccagccctaggttgtttattaataacccattttaatatgggactatgagcagaggctgggaagcaaaactgtcacatcagtgtttctctttgaattgggggtaggtgggtgggtggctctttagcaaggggctgaaatactgcttgcagcacattccaccccggtcatcagacaaaggcaccctcagagctaccccctgctccttctcaggctccatctggcctgagcaccctgccccagcgagtcctccggaaagagcctgtcaccccatctgcacttgtcctcatgagccgctccaatgtccagcccacaggtaactggcgcaagggggagaggactgagctggggagatgaccgtctgtgggagggtttagggatgagaaggtcatccctgttcgcattcaacctacctgttctctccttagctgcccctggccagaaggtgatggagaatagcagtgggacacccgacatcttaacgtaagtgccccaagcctgggggtggacgggggtgaggggacaatgaacaggcaggaagtcggggagataaaacctaagcacgggaggagtagggatgaagacaagtggggcggaggacaggatgggatgaggaagcagagagaaagcaaacctcttaataaccaaaaccggttctgagttgccttcctccactttctaagcaggcggcacttcacaattgatgactttgagattgggcgtcctctgggcaaaggcaagtttggaaacgtgtacttggctcgggagaagaaaagccatttcatcgtggcgctcaaggtcctcttcaagtcccagatagagaaggagggcgtggagcatcagctgcgcagagagatcgaaatccaggcccacctgcagtatgggttgatgccccctgagccgaagcccctctgctccctcacccccagctcctcattcagccccacttcatccagattgctttctctgtagctatggctagtgagccccatttagctcttagtcctggcaagccttgaatccagaaatctgcctccagtttccccttaccactcccagccctggtgtccccggcctgggccacgtctgaccccagtttgctcctatcatcttttccagctcttttatgcctttggcctgaggcctcctctgtctcttcccccagccatcccaacatcctgcgtctctacaactatttttatgaccggaggaggatctacttgattctagagtatgccccccgcggggagctctacaaggagctgcagaagagctgcacatttgacgagcagcgaacagccacggtccgggcgggtgggcacctggggcgccagtagggggctcgaggctgagggtgtgctgcttgtagctggaggtccatccttgtctgattgcctgtcgttgcccctcccagatcatggaggagttggcagatgctctaatgtactgccatgggaagaaggtgattcacagagacataaagccagaaaatctgctcttagggctcaagggagagctgaagattgctgacttcggctggtctgtgcatgcgccctccctgaggtatggtggcctgggaggccagacctgggtgtgaggctgggccattaaaacctctccaggggccgtgcaccgtggctcacacctgtaatcccagcactttgggaggccgaggagggcggatcacctgaggtcaggagttcgagactagatttgccaacatgatgaaaccttgtctctactaaatatacaaaaattagccggccatggtggcggacgccagtaatcccagctactggggaggctgaggcaggagaattgtttgaacctgggaggcggaggttgcagtgagccgagattacgccattgcactccagcctgtgtgacagatcgagactctgtctcaaaaaaaaaaaaaaaaaatggttagagtgtggtgctaataaccccaaggtcgcaggtttgatccctgtaggggccaatggtaaaactttggccaggcgcggtggctcacgcctaccagtcccagcactttgggaggccaaggcgggtggatcacttgaggccaggagttcaagaccagcggaccagcctggccaacatgatgaaaccccatctttactaaaaacacaaaatttattaagcagacatggtggtgcacacttgtaatcccagctgttcgggaggctgagacatgagaatcacttgaacccgggaggca

SEQ ID NO: 20538 - DNA, 1013 bp, Homo sapiens
tttaaacactggagagttcatataaaaatctggatgtctagcacctcttgagaactcggcatatgtggccacagtgggtccacaatttctgcacagcagcaaatgaggagacgcagtgcatgtggcactctccaggtggccaccctcagccactcacatgcatattcgtttctgtggcccactgctgaagaaaggccactgcggggcatggtgccatgtacctgtaatcccagctacttgggaggctgaagtgggaggatcacttgaacctgggaggccaaagttaaagtgagccatgatcgtatcaccacactgcagcctgggtgacagagaccctgtttccagaaaaaaagaaaaaagaaaaagaaaaatggccagcaacagacctgtgtatctctaggaacttatgatagaagtggcatttcaatcagtgggaagggttgtattattcagttaatggggctggatcaattggctgtccatttgacaaaaatgaagtctgacccctaaacattaaacatttaaaaataatgataaaaatattggggggctgggtgcggtggctcacgcctgtaatccaagcactttggaaggccaaggtgggtggatcacctgaggtcaggagttcgagaccagcctggccaacctggcaaaaccctgtctctactaaaaatacaaaaattagctgggtgtggtggcaggcgcctgtaatcccagctactcaggaggctgaggcaggagaatcacttgaactcgggaggcagaggttgcagtgaaccaagatcgcactactgcactccagcctgggcaacagagcaagaatctgtctaaaaaataaataaataaataaataaatatatatatatatatatatatatatatatatgtatgatatatatatgtatgatatatatatgtatgatatatatgtatgacatatatatgtatgatatatatatgtatgtatgaaaaaagatgtttgtgatcttggagaaaaatattaatacatctgg

SEQ ID NO: 20539 - DNA, 1114 bp, Homo sapiens
gacatctttttccattctatatgttctagtctgctcgcctcctagcaacttggtagaattataaattctaagagcccaggcctactgaggcaaaattagggcttatgacccaggtgtatgttttaataagccctccagttgattcttactcaagtttgagaaacacatctatgaaacttgataatctcctgcctttgaacctttcaacttgctgttctcttccagatacctgtgcatagatagattgctcaccactttaggtctctgttcaaatgtagggctttgcttgatcactctagaaagcccctcggcctcctcacacttgccttcttactctatcaaagtgatgtagattcacttgtaaatgttttcgggctccctatactagaatatgagttcagtgactgtggagatttttgtttggtctgcatgctgtatttccagcacctcttttcaccctttcctcgcattcataagactaaaatttatcataatttggatgtcttttaggattggaactgttggagtaagatcgtattgtcatcttctcactaaagattttgcaggtggaattatgtgtggatgctacctttaatttctagcattaaaattctgaagttactttattatttttctgtttgggggtggggttttttttgttttggacagagttttgctcttgtcgcccagcctggaagtgcaatggtgcgatctcagctcactgcaacctctgcttcctgggttcaagcgattctcccgcagtagcctcctgagtaggcattcaccacaccctgctgttttgttacttgtttgttttttgagatggagtctcgattgatcgcccaggctggagtgcaataatagcaccatctcagctcactgcagcctccgcccccccagggttccagagattctcctgcctcagcctcccaggtagctgggattacaggcatgtgccaccatacccagctaatttttgtatttttagtagagaaggggtttcaccgtgttggccagactggtctcaaactcctgacctcaggtgatccgcctgcctctgcctcccaaagtgctgggattgggggcatgaaccaccgcacccagcctgaagtta

SEQ ID NO: 20540 - DNA, 1013 bp, Homo sapiens
tttcagtttttaattgtattatttggtgaaaatcttttttttttttttttttgagatgaagtctcgctcttgtcccccccaggctggagtgcagtggtgccatctcagctcactgcaaccttcgcctcccgggttcaggcgattctcctgcctcagcctcccgagtagctgggattacaagcgcccgccaccacggctcggctaatttttgtgtttttagtagaggcggggtttcaccatgttgggcagggtggtctcgaactcatggcgtcaggtgatcagcccgcctcagcctcccaaagtgctgggattacaggcgtgagccaccgcgcccggctgagatggggtctcactcttacccagactggagtgcagttgcgtggtcatggctcttgtgggctcaagtgatgctcccatgtaggaccttttttttgtttctgtagagaggggtctcactttactgcccagattggtctccaactcctggggatcctgcccgaaaatcagtttcctcaaacgtcagatgatgtgaccataattaggtgacataatcagaacattgctttgggattaatccttttatcaatatattgtgactacccaacaggctcattttgcctgctgtccagatagagccgatttatctagacaggaattgcaatagagaaagagtttaattcatgcagagccagaacgagagaccagagttaactactcaaatcattctcccggaaaatttagggatgggagtttttttaaggataatttggcaggtagggggccagggagtggggcgtgttgacaggtcgtatcagagatgaaggcatagggagttgaagctgtcttcttgctctgagttggttcctggatgggggccacaagatcagatgagccagtttattgatctgggtggcaccagcggatccatcagtgcagggtctgaaaaaaaaaaatcacacaaatcttaggctttacagtgtgttatccctaggagcaattggggaagcctctag

SEQ ID NO: 20541 - DNA, 1114 bp, Homo sapiens
gccactgtgcccggccgggtttttatatactaatatttagatactatataaataataaagagaacctgttgatagcagagactctcctcactgtatccactgaactgcagaatgcctaacatagcataaggagtgagcaatggcaggtgccaggctaacttcatagagttagcaaaaaacttgacatctgccagaaacatgctacaactatcgaaagtgcaggaaacgaagtatatagatatactttgtgcagctttttcattgatctaaaccttgcttgcaaaattttcaagatagaaagttaaaaacaaagatatttcacttgcattatttcatcttaaggacttaaagctaacaaatccatgtaatcttatatgtaagccagcatgcctttgcctttgcagcccctgcccctcaatattttattcacactatgcatatggtaggctggaacttaaaatcaggatacatcaaaaaaagaagataacctattcaaaagaaccagattgtactgtggaaaaaggcagaatagtgcttacaatagtcaaaataataggtatctttacagaaatccatgaacttgagcttgaagcaccctggaggacattgggataaggataaaaagggggaaggagctaaagtgattttgaacacttttgaagtccactttccaaacactcggagataggttgatgtcacagctccctcatgaaaacctggaggacagtgcctgacacacaggtgtaatagaaatcagccgaccactgcggagaaggaaaccagctgcctcattccactaaacaaagtgcccggcatgtttctgactcatcatttgacagttttatctcccagagggccaaagaagcaactagggcagtagtttttaataagaagattgggtgaatttgtacagcattcctgaaggagattgcaagaattggaaggtggatgcttaatagattcaaaagtcatttttgaaacttttgtttttgtagtagaaactcttggaattaagacttggccaatcccggccaggcacggtggctcacacctgtaattccagcacttgtggaggccgaggcggggggatcacttgaggtcaggagttcaagac

SEQ ID NO: 20542 - DNA, 1162 bp, Homo sapiens
tcctcacttcccagacggggtggcggccgggcagaggctgcaatctcggcactttgggaggccaaggcaggcggctgggaggtggaggttgtagcgagccgagatcacgccactgcactccagcctgggcaccattgagcactgagtgaacgagactccgtctgcaatcccggcacctcgggaggccgaggctggcggatcacttgcggttaggggctggagaccggcctggccaacacagcgaaaccccgtctccaccaaaaccagtcaggcgtggcggcgcgagctttcaatcgcaggcactgggcaggctgagtcaggagaatcaggcagggaggctgcagcgagccgagatggcagcagcacagtccagcctcggctcagcatgagagggagaccgtggaaagagagggagagggagagggagagcgagtaaattctttaaaatgatcaaagtgttgaaagaaatagaaaaagaaagcagcaggcagtaccctgtagaagttaaatgtgatgtagacaagaataacgggacagggtgacctgcagaaattctctgcaggagagcaagagagccagtcacaaagaaagctgggagcatatttgcatatctgttataacgataaatagccctgctattttgagcactcctgagaaatattctttggctctcaagaatgcatttgtcaaaagagtaagttctctttaattcatgtctcctacggtacagtagtcagtgcgggtacctgttacaatagtctgctgcgccacatcacatcatcattctaaaggcaacttaaccaccaagcaagctggcttggagaaagtgtttcagggcctttgctgggctcgggacgtgcttggtccacatcactgtatctttagcttatgtccatggtagttttcatattcacttcatagtgtttgctgcaaactacttgctaagataggaatatagaatatgagtttaaaagctttccttcaaaaaagagggctaaaatatttaaatctgaaaacaatagagttttgtcatctggacaattgacatcatttcgcagataaccaatttcaaacagaatattgtacaaactgccatccccaaaactcctgttaaggtttttgcgttgttaacatcatcattttcctttgttggtacagataa

SEQ ID NO: 20543 - DNA, 1050 bp, Homo sapiens
acttaccctgttttcttattgggttgtttgtcctactattgaaatataagagttctttgtatattctggcaacaagccttttatcacatgtgtttcccaaatattatctcccagtttgtggcttctcttcattttctttgtggtatcttttgaagaataaaagttttaaattttgatgaaatccattttaccagtttttaattttatggttcatgctttttgcattctgtctaggaaatccttgtctaatttaaggtcatgaagattttctcctgtttgctttgagaagttttatagttttagcccatgtatttaggtatgtgatctgctttgagttaagttttatatgtagtgtaaggtaaaagtctaggttcctttaattttgttttgtttcattttgcatatttttcaagcaccatttattgaaaagactgtccttcctttccctattaaattaccttgacacatttgttgaaatgaattaacttacatacatgatcaattcctggactgtcttctgtttcactaatctgtatctctgtctttacaccaataccacactgtcctagtaaatttatagctttttgaaatcaagtagtgtgattcccccagccctggtcttctttctcagaattgttgtgattagtctaagtccttttcgatttcccaataaacttgagacagcttgtcagtttcctcaaaggaagccctccaatcccttgactgtttatatgatgaataatactggtatgtttactagtgtcagtccttcttagcagtcctagaataaaccattcttgatcattatgtttgttttgcaaaatgtttaacatgtttaatttttttttcttgtttctttttttttcttttttgagacagagtctcactctgtcaccaggctggagtgcagtggtgtgatctcggctcactgcaacctccgcctcccgggttcaagcgattctccttatatatatttttataagtaagatataaccataccatatttgcttttattttgctttgagatggagtctcgctctgtcacccagg

SEQ ID NO: 20544 - DNA, 1034 bp, Homo sapiens
agtgctacatcaatacagtggtaactgttaaattaactgccttaaagttttcaaataaggcagagttaaaataaacaagtattaatatgttcttaattgaagtgtcgtgctaaatttcatttcatgaaagccagtctgttttattttcaaaattctctgcctgatttacgtgccccatgcttaagttgatcttctctgttcagcgtgacatttttttctccttgtgaccactttatagatgctaattttttcctttagtggagtccattatcataaccaggattaagaagccaacaaaagttgctggatggcagacagaatgaaagaactgaggaaaagatgcagtttcttttttagaaatttttcccctgatgacttgagtaaagacattagattaacgtacatctgcttttatttgtgtgtgtgtaatgtcttttagggggaacttgaacggcagcttttgcaagcaaatccaattctggaatcatttggaaatgcgaagactgtgaaaaatgataactcatctcgttttgtaagtttcaaagcaccagaagcttttaattccttagatttctagttaaatgtttactgtgattaagcaaatgaattacttttcttcctagattttaagaagctaatagatgtagttctgtagacataatacaagctcacatgtaattttaaattttctagtagtcacatttgaaaagaaaaaaggtaatgtgtaagtaactttcatcattttatcatacagaaatgtataactctgtcttattttatggatatgtaatttaacctctctgagcttatttatctttgattgggcatgataataacacctgtcagtggaatcggagtagagaataaatggtgtgcacgctgagcacttagcccggcactatgcatagtaaacattcaacgcattagatgtggtaaactgaccttttcctaccttgctattttctgtgggatttggactttggaataatttgtcactactatgacttctctttaatttttttttttttttgaga

SEQ ID NO: 20545 - DNA, 1022 bp, Homo sapiens
gccacactggaagaagaaaaattgtcctgagctatgcataaaatacactaacgatagctgatgagctatttaagaaaaaaaggtttgtgcataattttcatgatatccaccatcacagataagcaaaaaatgtcctcacatttaaagagttggacacccgtggaacctctgattatacattcattcagcaaagcatttgccaagcatcattttgacctgatactgaccgagttaggcacaggggatacaaccaggttacttgaagccaacacaagaagaatagaatcagtggatctctctctctctctctctctctctctcactcacacacacacacacacacacacacacacagagaggaaaagaaaagaaccaatagaaaatttgactcaaataatccttttagccatatctaagtaatattaaagtaagatatgcattactggttttacctccaagttaggaaaactctttaaagatggactatcaaagtctttttcttatgatttggtaggatggtgtgtgattttaaggaatccaaagtctagcagtagatatttagtattaaggtaatgtcccacttactagaatgccagtgtttttccaagtttccacattctcatcacatagattgaattaggtttaaaaaaaaaaaggcttttagagacccaaacagttaatgcaaagtgagtataccaagggctttgcaagatattggtcataggaatgctgatggaactgactgctgaccccgggggggtggaggaaggcagtctatcaccgaataatgactgacatttttaatttttattttttattttttggagatgagtctctcgctctttctcccaggctggagtgcagtggtgcgatctctgctcattgcaacctctgcctcctcggttcaagcgattctcctgcctcaggcacccgccaccacacccggctaatttttctgtatttttagtagagacaggtttcactgtgttagccaggatggtctcgatctcctgacttcatga

SEQ ID NO: 20546 - DNA, 1046 bp, Homo sapiens
tcaaccgcagtattgtttgtctgattctaaaatacacttaaaagaaggcaacattggccaggtacggtggctcatgcctgtgatcccagcactttgggaggccgaggtgggtgaatcacaaggtcgggagatcgagaccatcctggctaacacggtgaaaccccgtctctactaaaaacacaaaaaattagccgggcgtggtggcgggcgcctgtagtcccagctactcaggagactgaggcaggagaatggcgtgaacccgggaggtggagcttgcagtgagccgagattgcgccactgcactccagcctgggcaatagagcaagactccatctcaaaaaaaaaaaaaaaaaggcgacattgagaaacctgagggagagtgtttgggaaggtattcctagaggaggtgaagctggatcgaggccaaagggacatgcaggagatatcccagtggttctgtgtctaggaagagtatgttggaagaaaggatatagtgtgatctctgtgtaagtaaatgaataaaggaggcagacattgactatgtactataaatgttggctgtggcagccagaaggaagaataacaccaggttatgagctattagaatgaaattagggccgggtgccatggctcacacctgtaatcccaacactgtgggaggccgaggcaggtggatcccttaagcctaggagttcaagaccagcctgggcaacatggcaaaaccctgtctctacaaagatacaaaaattagccgggcatggtggcacctgcctgtggtcccagctactcagtaggctgaggtgggaggattacttgagccgaggagacggaggttgcagtgagctgagatcacaccactgcactccagcctgggcaacagagcgagactctgtctgaaaaaaagaaaaagaaaaaagaaattagacttgagcaggacagtactgtgttctttgtaaatctcagtttatacatagagtatatgaatggatttgtttaataatattatgtaaaaaagaatacgacatagtgaacggagcacttatttc

SEQ ID NO: 20547 - DNA, 1056 bp, Homo sapiens
taatactctattttatttttattctagacttattctggactcttctgtgtagttataaacccttacaagaatcttccaatttactctgagaatattattgaaatgtacagagggaagaagcgtcatgagatgcctccacacatctatgctatatctgaatctgcttacagatgcatgcttcaaggtaattggaaatatttgaatactaaatgctcagaatttcttaaatgtaatttactgttttttaatgtctcaatgtattctacaaaagttaaattttatttttttaaaattaataaaaaagtaatgtttattgtagaaaaattgagtttttaagattaaaacagacaacacagccattttctgtaagtatgataagtatgtttgttgctctaaaacaatacctcataaatttgtatgttaaaaagcatctagttttcatatacatttgattcccaccacaaggcggtctaaccaaagctcattatattaggttttaaaaccaataggaagaataataggaaaggtagatgctgcactggggaaagaaaaattgtaaagtattatttgtgatttaaatgcatgtaaaagggtgacaataaaagttaaaaagcatgtgttaagttggttgattttgattgtattcctttggatcagaatgaatataaatttgaggagtcattcatttgaaccctggctttagacacagtgatttatggagggacatttttaaaagaccggaatgtagtggttttgaatgcaattaatattattgctctacaagacttcatttaaacatgggagttcctggtgctacgtgaaaacccaatcttctgtaataactctccctctctctcctttttaatgtattttttgttactaaattctataagttttaataaaaagcataaggttcttataaaatcgttccacaatcttcagaaaacgggctgtgctgcacccacttttcatcaaattgcaggtcatggcaagttctttttggtgatcaggtctgaaggatagtgtgaaggaattaataaagtacaatacccacgt

SEQ ID NO: 20548 - DNA, 1052 bp, Homo sapiens
cagcctggtttgtgcatgaggagtggcctcatctgccagtcacctaaaaattttaatagtgatgggcattgtgcagatccactgtggcactgggagctgcaaaatggtgagtccagtgccattattccttctgcgtttgttagcttagcgaattccttttaattcaatgtgtattcctccacacacacagttttctcaagttttttttttttacagagtgtttttgctattttctctcaaagaagcaatagcaactaatgttagttatccttcctctgccctctatgtattattattactgataagttttgcctttgtaacgtcattttcttttattattttaccattgttctatttttctttaagaaggatgctctcctataataaatgtctgctcttatcacttgatttcctgaggtatccattctgccctttattttctccactgtggattttaattttacgttttcagatgattccttacagtcttttctggccctggtcacctattttttttcttatgcatttctgtcctaatacgtagactctatgttatactatattctgttacagatataaatctgtctcctaaagttttcttttagttattttatagataatttccacaggtaatttatttctgaatcctctgaatgatgatcttattatttaggttttttttcaaaatttgcatgtgaattttaactaggtgcagtgtttgcaggtggtatgggtgaattattctttccttcctccctttccttctcgatggtggtctgatttcttctgagagctacagttgggatgtagggttacatgatattcccagttcaatccctgttcgtagtaggagactattgtatctctgctccattgcgttgacatttgcaccagcctacacttcctgtttctctaatcctttgaacctatgaaacaatgcatatacatagccctgctttcttaaacagaggccgggcacttccaggctgaaaaatttcccaatcggctgggcgcggtggctcatgcctgtaatcccagcactttgggaggcc

SEQ ID NO: 20549 - DNA, 1048 bp, Homo sapiens
gtagctgtttccttgtggtcatattaattctggtaccacttcatgaaccttttattacccatctttgttttctttttttttttcccttcttaactccctgtttaatttgtggtgagggtgaaagaggagataaagaaaaaaaagggtcaacttgtaactttgccttttcttttcttttcttttcttttttttgccctcagtaactgagggcaaacccatcagacaaccagagccataatttgtggtcaccgctgaaatttaccttggaaactcggttagtatggctgtgaagaggtataccccagctccttaacacagagttaatgcttaatctaaggttttaagtttcttagaaaagaaaaacgtgtacattcttttgtttcttaaacatctaattttgccctcctcctcttctcttagaggcaattgcttttggatcgttccatttacaatggcgcagagaactggactcgaggatccagagaggtatctctttgtggacagggctgtcatctacaaccctgccactcaagctgattggacagctaaaaagctagtgtggattccatcagaacgccatggttttgaggcagctagtatcaaagaagaacggggagatgaagttatggtggagttggcagagaatggaaagaaagcaatggtcaacaaagatgatattcagaagatgaacccacctaagttttccaaggtggaggatatggcagaattgacatgcttgaatgaagcttccgttttacataatctgaaggatcgctactattcaggactaatctatgtaagtatttcttccaaataatcatgtgaagtggtagctaggaattaatgtaaattatacatcttgtcataatcaaatgagaatgtggaatacccaaactctctgtttaacatttctatttctctttaagatagaaagatttgttgcttgcttacccatgtcttgcttttctttgaatcttaacacattaagtttaaataatacaggctgcaattacatataataaaatggcatttgaagacttttgtagtg

SEQ ID NO: 20550 - DNA, 1050 bp, Homo sapiens
gctgcctgacgctaggacgaggagtctgcagtcagagcgccagcctcctgccgcggcccacctgccccgcggcccgcacagccaatgtcagcgcagcgcgccggccgccgcggggcccgcacccgcagcctcgcgggatcgccgggcgttcagccagcctcagctgtccatctacgcacgagccagccaatcccgcgccactgccccggccgcacctcccggagcctatgacgggcgtaagagccagcccatgagattggggcctctgtggcctgggctgggagcgggagccaatgagcgtcattccaggtgggtggagggagccggactcgggaaggtagcttcgttcgggttgctaacgtcttcccttggagatgggcgcgcaaaccaaccagtgggtctgggggcggcggtgatgggcgtggagctggcccaatgagggtaggggtgggtggggcagccccgagcagcagtgctaaaggagcccggcggaggcagcggtgggtttgggactgaggcgctggatctgtggtcgcggctggggacgtgcgcccgcgccaccatcttcggctgaaggtgagaggtgcggctacccgggtccgagtgcacggcccagggctgggggacagtttgtggagggaggaatggctcctgggctgaggggtcccgggcggctctggaggacaggaacgggggaccgaagcgggagctggggaagacagaggggcttctgagctgtagggtttgtgctgcggggaccttaggttagtttgagcagggtcctgggctgggggcactgggacctcagtgggtggagatggagagactcccggaggagcggggaatgaagtccttgtgaaacccgcgggggtcagggcctgggtgtgcaggagggcgacccctggggggctgggggatggagatctgggggtggggacgtgaggaccaggttctcggtgggtgggatccctgggggcgcgaggtcgaggggctagtgtcccggcggaggtctcggcgtgccccgcgagccagtgtctgcctcccaggaag

SEQ ID NO: 20551 - DNA, 1024 bp, Homo sapiens
ttcatttatttctttggttgtttgctagtttgtcatttactctttattgattttcctggagagctcccttctacatgctatcttctgctccaatccgcactggctctgcacccctgttttgagaactgcttgtcattctggcatttctattcattgttatcctgtgtgattattctgtttctctgatctcattttttcccttttatcacagttttcacattttgttgaactatattctaaaccttctaaaacaggggggcaagagtggtatgccttatgaattctcacatgtggaaaaatgctttataccatcctcatgcttgatagttttactgggtatagaattctaaataatagtttatcttcggagctttaatgtctgatcatctccagtactgatgagaactctgacacgagtccaatttgtttgtgacctgtttttatttatcttgttactgccgtattgttcgtttttcactctggaagcttttagggcctttcttttgttgctgttctgaaatgtcaaaacatggttagggtgtgggtcatttactttccaagtgctctttcttattctagattattccttctccattggattctgtcattatttttatgggtacaatatttttttctagtttcttcaagaatactaacaagagtcttccacatgttgtattttgttttcaagttctcttctgttatcagaattacttctgtgtcctgggtggggaacatcacacactggggcctgttggtgggtggggggctgggggagggatagcattaggagaaatatctcatgtaaatgatgagttgatgggtgcagcaaaccaacatggcacataaatacctatgtaacatacctgcacgttgtgcacatggaccctagaacttgaagtatttaaaaaaaattatttctgtgtcctctagagtcagtttttctatttgcttattctgtgccttctatagcatgccatagactttgctcaagtgtgtgatgtatcttcagagcgagttcata

SEQ ID NO: 20552 - DNA, 1058 bp, Homo sapiens
gggattacaggcatgcaccatcacgcccggctaattttgtatttttagtagagatgaggtttctctgttggtcaggctggtcttgaactcccgacatcaggtgatctgcccgcctcagcctcccaaactgctgggattacaggcgtgagccaccatgcccagccattagatcttcatttttgaaggctcctgtgtcaagtaaaacactgattaaataaatctgttatgcctctgtcttcttaacccatccttgttataggaatgtcagccatgaccctgctaatgggtgaggaaagatattgtgcctttccacccatgcagtctcccatgtcccttctgtgttggaatgcataagcactagtgtcttatcaccagggacatgtggccgacaagttctgcctcaggacacaggacccattttctgcctctcagccaaaggatgatcagggtcgtaactccaccagagtccaactttatatcagaaaaagctcgtagctatgagcaacagaaaccatctctgaccacataagtgcaaaaggaatttatcgaaagaacactgagtaatttgaaaagcaaatcaccaagaagactagatgaacaggctagaaaacagggaaggaagctgggcacagtggctcacacctgtcatcctggcgctttgggaggctgaggcaagcagatcacttgagcccaggagtttgagaccagcctgggcaacacggtgaaaccctgtctctacaaaaattatccaggtatggtgacaggcacctgtagtcctagctactcggcaggctgaggtgggagaatcacctgagcccaggaggtcaaggctgcaatgagccatgatcgtgccactgcactctagcctggatgacagagtgagaccctgtctcaaaaagaaaaaaaaaaaaaggaaacagggaagaaccaaaggtggctaaaaccaagactgcaacctcatcacagacccatctagtggaggatctcattgacacactgctggatgcctcccgacccccaaccttttcccactagctagcatggctagcgctggacac

SEQ ID NO: 20553 - DNA, 1077 bp, Homo sapiens
agttcataagtcacattagaaggggtttgaaatgctaattcacagctgttgacaggtatgaattcccatcagcctggaatgtttcgcctattcaaagtaatagagcatccttgaatataatctcttttaaaacccagaaatgtgatacctggttgcttcaagctaagaaagagaaaacttccctgagatgcccagagcagttttgtctcaagaaatcaataaacacatagccatataaccccccagaaatgttcctatagagctttatgtatagctttaggtatttatgttcatgtgagtatatttacgtgagtgtgagtgtgtgtgtgtgtgtctacgtgtgtgtgtgtgtgagagagagagagcccaccttgaatgccatggttgtattagtgtaactataatttatttttcgaaattcttgaggtaaagatctagctcatatattatcttttttaaaaaaacttattgaaggttatttctgattttaaaaaataatcaatttactgtagaaaaatggtaccataaagaacaataaacaaaataaaaattcacttcctacaaatcatgactactaacagtttgggtgtatctttccagttttttttctatgaatgcatatagcgtgtctacatgtgctgtggtttgaatgtctctgccaaaactcacattgacatttgattgccattatgatggtcttaagaggtgagacctttaagaggtgattagatcatgagggccgtgccctcatcagtggattagtgctgttatcaccaagtgggttacttatgttagaaataaattttcagtgccgcaaaagaaatagcactcaaacataaatttaattttctcagcaaggcaattttacttctgtagaagagtgtgacttgcagatggagcaatggtgagagcacagctgaacaagagaggggaaggggtttttattcctgacgcaggtaacccctgctgctgtgttgttcccctattggctagggttggatcacacagtctaagctaattccgattggctattttaaagagagcaggggtatgagtcagagtggtggggtgaatagt

SEQ ID NO: 20554 - DNA, 1079 bp, Homo sapiens
tgcaaaattgaagacctttttttcccttctgtttagagacagggtctcgctcagttgcccaggctggagtgcagtggcatggtcatacctctgtgctaagctatcaggaggatcacttgagccctggagttcgtcccctgtagctgaaactacaggtgtgcaccaccatgcccagctaatttttttgtttgtttttttggtagagatgaagtctcgctttcttacctaggcttgtcttgaactcctggtttcaaacgatctaccttggcctcctgaagtgctgggatttacaggtgtgagccactgcacctaaaaattgaagactgaagcagccttctcccaacttggtttcagctccttattaaaagatgtttttgtgttcggtcatcttagcagcatgcaaaccagttttcttatttttgtagcagtcaaactttacagagagggctgttgtgcacttagctacttattctggaaactaatggaaatcctcttgaatttgggacttcacattagagaaactgtcatcttctagagatgtatgactttgtcaataaaacaattgaaatcagtttgtacttttgcaatcataaccatagatgaggcattgcgcccttcactctttctgaaaattaagacttctggagtatttaaaaattttaattttttatattttattttattttatttttttgagacagagtctcactctgttgtccagctggaatgaaatgacatgatcacagctccctgcagcctcaacctcctgggcacaagagatcctctggcttcagccccctaagtagctgggactacaggtgcacaccaccatactcagctactttttgtattttttgtagagatggagttttctacaaaaccacaggctaggctgttctcaaactcctgagctcaggtgatccaccttgccttggcctcccaaagtgctgggattacaggcgtgagccaccgtgcctggccagtctttttttcttcttattttttaaatccctcagagaggttccgtcagttgggagccaatcaggaaaaagaataaccatactaggtatttcactcag

SEQ ID NO: 20555 - DNA, 1024 bp, Homo sapiens
tgagtacctgggactacaggcactcgccgtcatgcctggctaatttttattttattttttatagacaggatttcaccatgttgcccaggctggtctcaaactcctggactcaagcgatctgcctgcctcagcctcccaaagtgctgggattacagatgtatgacactgtgcctgaccaacatgctttttatcatattagctcttttgaaccttataaaacataggtaagaaactgagttctaagtagtcttgtttatttaacagactttagagctacttttgtctctcagagaattatttttaatcttttaccacaagaataagcaattaatctggaacaaagaaggaactatgccagttcctttatttatcatgctgtttatcaagaatatttctatctggctattgtttttacttcttctttcccttatcatggttcattgaggtaagctagttaaatctcttggcccctttttctttacattcttgtgtgtctgtctctgtacccgctgtgtcatccttaattcagtatcaatggagaaatgccttgtccttcatcagtgcctatctgccttcaaaaccatcttgtcctcaagttttcccattcatctgttctcttcttcatccatgccagcacagatagtggatatcatctgtgtgccaggtactgggctaggaactggagctaaaaatgtagataggactgggcacagtggctcacgcctatagtcccagctacttgggaggctgggatgggaggatcccttgaacctaggagttcaacgttgcggtgagctatgattgtgccactgcacttcagcctgggcagtgatgagatcctgtttctttaaaaaaaaaaaaaaagggtaaaaggtagataggacttaagagtataggagagaggggacacatgctgtaaatcactaatgactgcaggtagtacagacgggtctgagtcagccaagggctcagaggtttccaagaggctgcaacacaggagcagaggtctgaagaattagtaaga

SEQ ID NO: 20556 - DNA, 1051 bp, Homo sapiens
attcctcccatagttaatttggcctgtgtccaggactgagcaaaggacagccagcctgagaggctagaagcaggatggagtcagccatgctacatttctctcgatgtcatcatctttgcaaggcagtttcaccctagtccaattaagttgggatctctgagaatgaagcctaggtaaggtatgacttaaaataacccacatgcttttaatgtgcaaccagggctgagaagcaggtgtaaggtaacaggaaaccttcacgtcagcacagctctggagacacttggagatagggaatgagaactcaagggaaatgactgcctggagtggcccaagtggggttcattataaagttgtaaataaatccaggagaactcattactgttacaagcaagagcagccagggcaaagacgtgagaaaactccaaaagaagaagggatgccagcatagaagctggaaatgggttagtatgttattttgggatttgtagatgagagtttcaaaggctgggtgaacagcctatttcaaaagccatgaagaagctggataagatgatacagaagaaaagccattgctttttgttgttgttgttgagacggagtcttgccctgtcagtcaggctggagtgcagtggcgcaatcttggctcactgcaagctccacctaccgggttcacgccattctcttgcctcagcctcctgagtagctgggactacaggcgcctgccaccacgcccggctaattttttgtatttttagtagagatggggtttcactgtgttaaccaggatgctcaatctcctgaccttgtgatcctcccgcctcggcctcccaaagtgctgggattacaggagtgagccaccgcacccgccgaaaagccattgcttttgtaacagtcatgtcccagggtcattgatgggttcactagagtatgtagagtagaagccaggttctaggaccttatttgaggctacagataccaggaacttgttaatgaaagaaaggtgcaaactaacacaggagaaaactagggagggcgtcaacatcaagtgaag

SEQ ID NO: 20557 - DNA, 1075 bp, Homo sapiens
gtaaatgttgggccttctcaagagccaaaaatgcctttcatcttggaagtagtacttatctcccagggcgattaatgaatttagtccactctttggaaacagtccaccatgttttccaaggcatcccacacagccaatacctattaggttttaatgtttcttccatctaatttacaagctttttacctttcctatgaatatcagggcatgagaaagaaggaaagaatactaaaatagctgggcgtgatggctcaagcctgtaatcccagcactttgggaggccaaggcaggcggatcacgaggtcaggagatcgagaccatcctggctaacagggtgaaaccccttctctattaaaaatacaaaaaaattagccgggtgtggtggcgtgcacctgtaatccctgctactcgggaggctgaggcaggagaatcacttgaacccaggaggcagaggttgcagtgagccgagattgcgccagtgcactccagcctgggcaacaagagcgagactccatctgaaaaaaaaaaagaatactaaaatagtatggtggttaaaaacaagggctttggaatcagagatacccacttcctccattttctaggtgtgcaaggaagagcaattcacttaatcttctcaaacctcatcccttgtatgtagaccagaggtgattgtacctaccttacagtttgtgaggattaaactaaatgggatcgcgtatatgcagggctcagtgcagtggctgccctggcttcagtcccggaagtcctccctaaaggcagctattgttgtcgtcgttgttcgagtgatccgataccgcatagcgctgttcagtttttcatactctgtgatgacaggcgtgctgcttgaagaaatgtttgaactcgccttttctcaagttcattttctccaggtgatcctgcacacctgtgatatggctgatctcagggtatacatttctccggcacacaaaatttccttttcaccacgcacaattcatccctgatattagtcactgaacttggaaccgtctggttttgattggctagtcagggttcactgaggcaaattccttcc

SEQ ID NO: 20558 - DNA, 1045 bp, Homo sapiens
attgacatttgagttgaaccttaggggaatgaatagaattttgccagatggacaaagggggtgggggtggggacactccagactcatgcaaaaacatgagagtgtgaaagttttgcctttgtctgagcggtggggagcagtctggagggccgaagtagggtgtggaagcggggatgttgaggagatgatgtcgtagagagatcgtagccatgttgtagcttctggggagtcagggaagtttttgaatagggaagtgatagggtgagatctctgttttaagaacaataattcttgcagcagagtgtaggatgatttgaatgagggtaactggggacaaggagaccgatcagaaggctgtaaccatgttgtacatgagaggtgatgggtgtctgagccaaggcagtaccaatggggagggcagtcagggcttggatgtgagaaccatctctgagggaggccttgtttgttgatgagatgtggttagaagggagaccaaaaaaaaaaaaatggcttggatgacttgggaatacagtgatgctgctcaccaaaatagagagcgtacgagaagaagcagcttatggggtgagagtcatgaatttgattttggatatgttgagtttggggaggaatacccagttggagatttttaaatgaaaagacacaaatgcagataaagaacctgtagggagatattatgggtagagacaaatttgtaagtctgtttagcaccgtgattttcaatcaggtaaggggtgggaggacgtgctttgcctgaatgtttttatatgtggggtttctttttaactatttgtgtgctactccccccaaaccctccagattctggtattgtcctgctaggaaggagagcacgtccctccccacccctagttcagaattcaccaccataatgactcaagggaatgtgtctgatttcatatgtgctgggcatagaatgaatgtctttaagcattgctagcatttattcttttttttttttttttgagacggagtctcgctctgccgcccaggctggagtgcagtggca

SEQ ID NO: 20559 - DNA, 1068 bp, Homo sapiens
ctccttccgtccctggtccttccctctgctggctggtgactcactcagctcttgtgcaacagcccaggctctcgctcagagaagagctgttttcctccatcccataagcccccgtcctaatttatgtcttttcatttgggttaatgctttccacatttaggtctggagattagcgtgtggctcattgatgcaaccaccaaaaccccagtgccagcttgggtctggcacagagaggcagccagccagccagccagacagacagacagacagaggacagcttggagcatgacccccagcctgttggtctgcagctggcccagccctgccagccacagaggcagagcgaggaggcagccctgactcctggcttgccagagaatcattctcatgccagtttcctgtgaaggacacgcatcttggaatggcgtgaagaggagattgccccaagcctgtgacttctcattgaggaaactgtgtgtcgggaagtgagaggcacaagttctagggtgtggaaaaatgcgatctctgtggctttcaaagctgtcacacaacacagtgtgtgtgtgtgtgtgtgtgtgtgtgtgtgtgtgtggtttttctcttctctttagaacaataatattacctttgttgctatggtgttgttatgggggtggctaattggacacagccctgatgctggctggtgtgtggtgtccatagtgattatcagacggcagccatgggacctgctttgattttcttccctggagtgagaagcaggcagaggatcactcggtggctgtgtataccctgcctttggtggtggcaccccagtcagaaacgggaccctgaagctgggatttaggtaaggggaggacctttccaaggcttgtttacagctcagatttgcagaggaccaggtatttgggaactcctcttctgaagaaccagattgcagggcagggcacaacgaggggcctgttgcatcttgggagcacagggctgtgtgctctggtaacctgggcccactcacctggcaggcactggcttccttcccagtgagactgtagcattgacggaaaagtg

SEQ ID NO: 20560 - DNA, 1249 bp, Homo sapiens
gcaacgtttttcagctgcaaatcttgggaaatcaaaagcaaggctgttttttttttcttttcttttttgagacagagtttcactcttgttgcccaggctggagtgcaatggcgcaatctcagctcactgcaacctccacctcccaggttcaagcaattctcctgcctcagcctcccaagtagctgggattacaagcatgtgccaccacacccggctaattttgtatttttagtagagactgggtttctctatgttggtcagactggtctcaaactcccgacctcaggtgatccgccgcctcggcctcccaaagtgctgggattacaggtgtgagccaccacgcccggcctcaaggctgtgtttcagtgaaatatcccttgcaaatctttacctgggtgggttacagtgttttcactagactcttcaatagaattaatattttaagaaatgccacttgtttatttgaaaagtataagaatcctatcaatgcagtaggcatgaatgtattcatgtgtctggctgttcatgaagcagctgatatcttaagtgtaagaggtgagatttactgactaccagtaaaatatgcgagttgggaggctaatgattttaaattgtaaatgcgtctgcataagatcctttaaaatagcttttattgttcttaaatttatgtttaaaagaaattgacattaatattttcaaatcatccataatctcccaaaccttttttggttttctgtttagtaccatttaaatctttgtgtatgtgtatatgagctacctttaaaagagcagtcacccatgcgagcatttgttacccaattagtttgtacttttttttggtttttattttgttgttgttatttgtttctttttgagatggagtctcgctcttctcacgcaggctggaatgcaataatggcataatcttggctcactgcaacctccgcctcccaggttcaagcgattctccagcctgagtctcccgagtagctgggattacaggcgcccaccagcacacccagctaaatttttgtatttttagtagagacgggtttctccatgttggtcaggctggtctcgaactctcaacctcaggtgatccgcccgccttggcctcccaaagtgctgggattacacgcgtgagccactgcgcccggcctagtttgtgctttttacttaccagttaggggttatattactgtgtaacaaaatggacggttatttctattcattaacaagattcaagtaa

SEQ ID NO: 20561 - DNA, 1028 bp, Homo sapiens
agatattcgggaggctgaggcaggagaattcgcgtgaacctggcaggcggaggtagcagtgagctgacatcacgccactgatcttcagcctgggcaacagagctagactctgtcttaaagataaataaaacatttactatgacaaagtaactgttgtttaattgacacataacagttgtacatatttatggggtacagagtccctatcctccccaaccctttccagcctctagtatccacaattcttctctctacttctgtgagatcaacttttttagtttccacgtatgaatatgcagtatttatctttctgtgcctgacttttttcatttaacatattaatagtatcctccaggctcatctccattgccacaaatgacaggatttcattctttaatatggctgggtagtattccatgacgtatgtatactgcattttctttatccattcacctgttgatgagtactgttggatttcatatcttggctattgtgattagtgctgtggtaaacataggaatgcagacgcctcttcaatatactgttttcatctcctttggatatatacccagtagtgagattcctggattgtattgcagttctgtttttacttttctgaggaacctccatactgctatccacaatggttatactaatttacatttccatcaatggtgtgtgtgaggtatctttgttctgaatcattgtcagcatttgttatttttttgtatttttggtgatagtcattcaaattgggatgagatacctaattgtggttttgatttgcatttcccttgtgattggtgatgttgagcattttttcatatacttgttggccatctgtatgccttctattgagaaatgtctatttagatcatttgccctttttaaaaatgttatttgtctttttggtgttgagatgattgagtacattctggatattaactccctagtctgatgaatagtttgcacatattttctcccattctccaggttgtctcttcattctgtttattgtttcctgtgct

SEQ ID NO: 20562 - DNA, 1072 bp, Homo sapiens
tccccagagaaaataagggtaatcatcctaggaaggggagctgctgaacaacccaaacaagaaatggccactgaagtttataattagtgctgtgacctctgtgttgtcctaaaacaaaaaggggcgatggggctgagggagtctgaatgtcttttctgaaagcagactatggcaaaacatacaaaaagatcattttttttttctgtgggctgtgattccgtggttaacaacatcagaacatctatttttaggtaatgttatttggaaaagtatctctgcaatacacatactcttttgtacggtgtgggctgttggcttggcgtcctacctcttgcatcgtacacaacagaacatcttacatgaggaagaaggcaggtgagcggtgacggttaccctgtggagggatagaactgtgggatagaactaaggaatcgtgtttgcaacacctcatctgtgcacaatgataactgaattcccccagtgtaccctgtggaggaggcaaggtattatcttctttataacctgatgaaactgaggaaataatggagccaggattcaaacccagccccatctatcaggcttcattatcactgctagtggcagtcactacatattacattatattactgtcaggccgttggactttggcccccttgtaactagcaacggtatgatacagtaatactcagtccgatctaatatggtgataactctgtcagcctcaaattcagttctggtttaagccagaatcttatctacaagtatgagcagccatctcagaggtcagtccttttttttttttttttgaaacggagtcttgctctgtcacccaggctggagtgcagtggcgcgatctctgctcactacaacttccgtctcccaggttcaagctattcttctgcctcagcctcctgagtagctgggattacaggtgcgtgccaccacggccagctaatttttgtatttttagtagatacagagttttatcacgttggtcagcctggtcttgaactcctgacctcgtgatccgccttccttggcctctcaaagtgctgggattacaggcatgagc

SEQ ID NO: 20563 - DNA, 1078 bp, Homo sapiens
ataatgacagtttttttgtgggggggtggggaacagggctttgaaggtgctccaaccccattttgccccttccagtggtttccaggctactggtttcactgtgattgtggtctgttggttttataggtaacctccaagctaggggttgggttgagatgggaatagacaagttaaaaggccatagactgttcttcctactgagattcagctgttttgcttgagtaaacacttcttggattgctgaaagcctttggttaatttccagaattctaagaaagttgattctgactcagtttttgtgaatgttctcattgttttatggaggagaggattttaggaggtcctgactcttccatttttgccgacatctttctgggataaaacctttgagaacaacagcttttggtgaagaagtattgattttggggaagtttttattattatttacaatgaggtatgaaaaatgggaggttgacaattgaaactgatatcattcccccacttccagtgtcactgactttccttctgagcttcttgcctactttccttttggtacttctctcattttggtggtttggaggattctattaatagctgtggcttgctctaggccaccttatacctaatgcaatccatatatgatctccactgacagaatcttgtgcaaatgttcaggtggagagagggaagtcaacttccttctcaagattcaggctttctaaacattaccctactttactgtcctttctgttggctcttgaattgctttcctagggctggcataataaaatgccacaaacttgatggcttgaaacaacatattatctcacagttctggaggccagaagtcctaagtcaaagtatgggcagagttggtcctcctggaggttctgaagcagaaaccatcccatacctttcctagcttctgatggttgctggtaatccctggaattcctcggcttgtagatacatcactccaattctgcctctgtcttcatagggaattctcttctgtgtctctacatggtcttctttgttttgtttttttgaggtaatttgtttaactgcaagcctatat

SEQ ID NO: 20564 - DNA, 1033 bp, Homo sapiens
ccagctcaacctcatccacccggacatcttccccctgctcaccagtttccgctgtaaggtagtgtctcagaccggccccttgtcggcccagctctcgtcccctctctttctctccatgaatgtgttttgtctctttcagaaggagggccccaccctcagtgtgcccatggttcagggtgaatgcctcctcaagtaccagctccgtcccaggagggagtggcagaggtctgtgccatcttgaactaatggaatcgtctcagtcgagttgggaaacatttctgtaaatagccacatagtaaatgttccaggaggctctccagaccatatggtctctgttgtaactattcaactccgctttgagcacaaaagaaacacggacaataagctaatgaatgggcttggctgtgtgccagcgtgaatttatttagaaaagcagcctactccaggctgggttgaggtgggcggattggggccagtagttctccttttccaaaattgccttgcatgggaatagcagtgatagagctcgtgtgtttcacagtatagaaaataggaaatgtgtgatgaacaaagtcacccataatcctgttgcccagagataatgattgataacattttgtgtttcttgatttgtgtatgtgggtttatattgtcagtcttttcctgtatcactaaacagtcttaagtaacaagatttttattggtattccaaatagggatgtttactcatttgggatgtttccaattttttgttgtttttaatgaatgaaacaataaatgtcttatatataaatctttgatgggaactctgttcccttcaagtcattcctaaatgtgggattactggcccagagtgtgagacttgttaaggtacttgataaatgtaagatgccatcttgaaagcctcttccagtacaatccaaccaggaaagtgaacagccttactgccccacatctttattttaattaattaatttatttattttatttatttatttatttttttgagacggagtttcactcttgttgccca

SEQ ID NO: 20565 - DNA, 1031 bp, Homo sapiens
gacatcactcagctaagtgataaaatggcctcttttatctgtgtttgtcccgcatgtcaacacggctgcattcgagcatttttgtagattgtccatttaggatctagtcaccgtcctccttaaagggtgcatgctttccttggtacttgagctcaggacagtgtctaacaacagaccccatatggatgggcctggggtttatggtccagaggaatgccacagtattctatgtcaagatatttcctctgacttctgaggacattaggaccagtggccacagactgaagaaaaccttaatgccaagcctcctttcctggccagtgtaggcctgaagtgcctcaacctgacagttacctgtttaggtatccacaaagagaccagaagggtgttgatggtgatgtgtaaagttggttttgtgctttgtttacctctcagctcactggataggatatgtcatgttagcagttgccttgaaggcagttcagtttggtggctgagctgtgacccccagtgggcgggcttatttggttttgcagattttggctgaagagctgtgtactcctccagatcctggtgctgcttttgtggtggtagaatgtccagatgaaagcttcattcaacccatctgtgagaatgccacctttcagaggtaatgaggggtctctagggtgggagaagtgagagctgaaacccagcccagcatcgacatgggcatcttgtggcaagagctgtgtttctgggaagaccactatctgggtttacagttcagaggccggcactcctgccttaagtcactgttggtagttggtgggctccggtgtacacagcctcaaagtgaaattagaaaagattgaaaactagaaacaactgaggactagaaattcaactagaactcttacagctcttataccagaagaaattctagaacttttttgaattctaactaatgccccagattatcatttggattattttgaactgaattaattttcttccattacctgcattgaaacaaatgaggtgggtcagag

SEQ ID NO: 20566 - DNA, 1061 bp, Homo sapiens
acaggcgcacgtcaccacacccggctaattttttgtatttttagtagtgacagggattcaccgtcttagccagggtggtcttgatctcctgacctcatgatctacccgcctcggcttcccaaagtgctgggattacaggcatgagccgctgtgcctggctattagagattttttattataatttatctccaagataaaagcagtgacattatattgccacataattgaaaaatacaagagaaataaaaatcatccatgcttttgttagcctatcactgtcattgaaatattatgttacatggcagtttgcttgctggttgctctgttaggcaacgctctggtgacattcctttagctattaattgaggaatgtagaatgacagaacagtgtttctcctcaatgatacttgaaggatatttattaactttcatattgaattacattttattaaatttataatgagttaatgctgggaaataaaacactgatttaagtcattttggcttttagtactaaagcatttgacaataaatgacttcttcagaatatggtataccttctgaaagcaataaacgcattttaatgaattgtaaggaaacaacatcattttattttttatttttttttttgagacagactttcgcttttgttgcctaggctggagtgcaatggcgcgatctcggctcactgcaacatccgcctctgggttcaagcgattctcctgcctcagcttcctgagttgctgggattacaggcacgtgccaccacgcctggccaattttgtatttttagtagagacggggtttctccacgttggtcaggctggtctcaaactcctgacctcaggtgatctgcccgcctcagcctccgaaagtactggaattacaggcgtgagccaccgtgcctggccaacattattatttttttttaatctagaaaaatacacttctaagaaaattgattaaaaccaaccttcttcattagcccctaagatcacatctatgttctctttgttgcagcttcacttaaagagaggaaacttcttggtgctcaaagcaaa

SEQ ID NO: 20567 - DNA, 1031 bp, Homo sapiens
ctcctctttctgtcctgaggtcttgtctagtgactgagaacaggctgacccctatgtgctgtccttgtttggatggcaccgggtaaagactgacaccagcattttctctgcaggcctttgaacttttgtgttatttcatatattatatgtgttataaagcacattacaatatatttttctctgtcttctccagtcctaggtgaaatgtgtcatttaaaaaaaatttcacttgccattctaaagtttttctggtgagagttttgtgtttttcatttacgcaaacacatctccacataagtagggaaaaaaagtcttcttgagtatattagtgtcttcagcctttgtattgggacagtagcgtccattaatttttatgtgaagtgaaattaggtatcgggtcataatcagtctgtgatgtcttcacagctttcacatttaccttgtgataatcaagtgtgtttttcctcaggtgttagccagagaagaggggtcagggactcttccctggtcgtagctttcatctgtaaggtaaggaagactttccggagggctgtacatgactggggtcttggtcagcgacctctggtttgcactttttcattaatttgagggtaggcactcctgttacctgagacaagaagagatagcagatcttcagaaaagctgatggaaggccgggtgcagtggctcacgcctgtaatcccagcactttgggagtccaaggcaggtggatcacgaggtcaggagtttgagaacagcctgaccaacgtggtgaaaccctgtctgtactaaaaatacaaaaattagctgggtgtggtggcgcatgcctgtaatcccagctacttgagaggccaaggcaagagaatcgcttgaacacaggaggcggaggttgcagtgagttgagattgcaccattgcactccagcctgggtgacagagcaagactctctcaaagaaaaaaaaaattcgatagaaatgacactggcaatgagcctgcaacaagtattactactgacctttcataattgtcat

SEQ ID NO: 20568 - DNA, 1078 bp, Homo sapiens
ggacccatcctgagatcgaccgcgaggtggtgcgcaggctgcgcgagttctaccggcctttcaacctcaagttctaccagatgaccgggcacgactttggctgggatggataaccatataatttaaaaagaaaaaaaaaatcaaaatataatatatttttttaccaatcggtagagaagagacagtttaatatttgtgctgaaaatatgtttcagtatttttttcaatgaatgttaagagattgttctcactcccgccccatcttaatgtataaccaacaccaaacacgtggatcaacagaaaaggaaaatttcactcgtctaaacactttcaattttcagtttttattttatgttctatatacccagtcataaagtataagcatcagttgtcattaaaagttttcagaaaatcttgaggttaaacatctctctctctttttttaaaatacaaggccctgataaaattgatatctatccttatatttttctccctttttcccgtgccactttttcttaaattatttcccagttagtattatcatatgtttgtacccgtcacagttttcatagtgctttcaaatacacctttttgatcattaaaataaaaaaataaatcttgctctgttgtataagatcacaataggtaaatattattatccccattttacagaaaggaaaactgagtctttgggaggtgaaataatgtatctaaaggtcaaatgttggatggaccctggacaaaattccatcttccacttgttccctatttcatgtcactttttccagggagaatggaaaagaagacatctgcacctttagaaatggttaggtagttttcagatgatatgaaaagggaaagagagccccttgttttctaaattcccaggctacccctcatggcacccagtctcattacatagttgtgtccaagaaaaccactgagacctggacacaacctctcttaagagccagtcttgcctcttggctatttaaagtacactgagatatggaaatcttgactgatgaatgcttgattgaattggagaggaattattggattcttgcatggaggacaa

SEQ ID NO: 20569 - DNA, 1015 bp, Homo sapiens
tttaagctcatgcaatacatggattctcttgagttcagatgacactgaatcgacctcaggaatagttgcttgacccaatcaaatggaaacactcaatagcatctgattctgtttatcaggatgtgaaagtcactgggttcatttctagccagagaagagggatcaggatcctcactggcccacctcaaagaggtctcaggggaagagaggaagggcttgagtcaatactgtaaaactactgggtggaagaaagaaaatgcctgcctcgtattcatttgtcacactgaaaaaatgaaaagccacatacagaaaactgagcgattgagttgcttatacttgtattgactgtgacttgtgctgactgtggccatggggaggataaagcagagaaaggccatgattcaggactatcagcttttggggtggtggcaggctcccccaagtcttacaaagggaggtaactttgagaagcatcaatctattttgtttcataaccaaacagattgttagattgtctatatatgatttttaaaagttagtgtgacccactgcctttgtaacaggaccgcctttgaaatctgcctgtcttgggttcaagtctctccacacctccttatcatctggctaacttggtacaagttactgaagctctctacacttcagtcatttggagagtgggaataataatgccaccttgcttggcgtttgtcaggattagagatgatgtatgtgaactaccttgttgatattgttgttgtgattgtcatttgacccataacttcttgtcaccatcttttctggatatcctttgtagacatcatttatacctcaaatgattagtgataatgatccttgcaatttcctcttaacttattcaaagctaaaaataagaactatattttaggtgggactgcatatgtctgagcaggagtgtcctttgggaactttgtattgcatctattcaaaggaatgaaaagggggcatttcttcttctgagatcaagcccctggtcttt

SEQ ID NO: 20570 - DNA, 1032 bp, Homo sapiens
tctcctgctttcgtgtcccctgattttaccccaaatcttgattgaaaagaaaagcaaaaccaaaacacctgggacttcctcattggtagatgctgcacagtcttcctttccttccaagcagatgatgtggttgggggatcttgcctgagtctcttaatgttctcacctttcaggagtggtcagaaatgtgggtcagagtattatgctggcattcggttttcatttcccattacagaagaagacatggacaggtggcccacaattactttctaaagaattcaataccccagggagaaggggttagtgataagcatcagaagtgaaaaattagacaattgttgggtaaccggggtaagcggaatgaatttctaagaatttctaagtgctactatgaaaatagcaacagacaaccttgatgacttgcaaaatggtcagatcacttctgtggctaatcgggatggcttggagtcagtcagtaattgagccatttcagtcaattctgaaataaatttgtctgcaaaaaaagtagaataaccatctgtaaacacaaagggtttatcccagtatccaatatcatggtgaatttcattctgcaaaatgcagttgctggatgtttaaccattaagtagtaagacacattatttctgttgtattaaaaaacactatagagatgatgtgtcatttaaaatacacaaatgtagccctgacagaccaaatagatgtttcttaatacaagcatcttttgaaaccctggcacagtaaagcaatcgctaaagaatgtttattgtattagttgaacaagtccgttaaatccaataatgttgtcacctaagaaaacaccaaagctgagtttttaaccttacagaaatattgatggcataaagtggaggctgatgaaataaagatttcttattacttttactaccttggaataaccttctacctgtgaactgtaggaaaatgctttgccagtgccaccacctgccctccagggtagccctaccctcagttgacaagtgttcgtagaaattt

SEQ ID NO: 20571 - DNA, 2040 bp, Homo sapiens
aaaagatttttggaaactgagatgaagagactttgggcaacttgcccaagataatgagctacttagtggtaacccttgatgagagggttttaaaatcctacttttaccacttaaaagtcatcatagagtcctggtagtccaacattctttgtgatgcttcggaatccagatcgatggttatttatgagatgggatcttacccacttttgttatgtagctcattctcattcttcttttgaaaagctttaacagttaaaaattccttttttatcattgagacaaattccttattttttaaaacatttccaaccagttctagatttccttctagattcacagagaacaaatctgattctgcatgtattaggttggtgcaaaagtaatcgcggtttttgtcattgaaagtaatagcaaaaactgcaattacttttgcaccaacctaaaagtagtcactgtcttcagatatttaaaaacagccataatgtcttctggaaacttctcttcttcagactgattccaaatgttgaagttgtggcactgtattagtctgcttgggctatgtcagagaaaaaaaaatattttttctctacttccacacatctctcgatataacacttctgacactacattctccagcacacatcatctgggtgtcttattcaattcagttccgacaccatcaacctgtagacagcatcagatatcataggttaagggctcagtctcacaagactgccccccactttaaatgcttgttgcgattagtatacctctgattgattatctggctataaattggggttttccatgaacgcttcattagatttgtttaatttgctagagtggctcacagaactcggggaaacacttatgttgacccacttattacaaaggatattacaaaggatacagaggagcagccagatagaagagatgcatagggcgaggtatgtaggaaggggtttggagctcccagatccctggttgcaccaacctccaggaactgctgtgtgtgcagctctctggaagctgtcagaacccagtcttgggttcttgtagaggtctcatcacataggcatgattgattaaaccactggccattggtgatgaactcaatcttcagctcctctttccaccccagaggtgtgtgtgtggtggtagtgggggagctgaaagtttcaaccctctaattacaacattcccctggcaaccatcccccatcctgaggctatccaggagcccccagccaccagtcatctcattaacattcacaaagaaatttattgctttagattccaagggttttgggaatgatgagccaggaaacaggaagaccaaatatcaaaatatggtagcctgtgatatttcgaaatatcacaggctaccataacaaagtgccacaggctgggggacctaaacaacagtttattgtctcacaattctggaggctggaagtctgagattgaggatgggtagggttgttctctcccgcgacctctctccttggcttgcacatggccaccttctctctgtgtcttcacacaacctttcctctgtgcagacatactcctggtatctcttcctcttcctttaagaacaccaattctgttggatcagggatctactcttccaacctcacttaaccattttttttttttttttttggaaacagagtctcgctctgttgcccaggctggagggcagtggcgcaatctctgctcactgcaacctccacctctcccgagttcaagtgattctcatgcctcagcctcccaagtagctgggactgcaggtgcacgccaccatgcccagctatttttgtattttttatagggatgcagttttgccatgctggccagactggtctcagactcctaacctcaagtgatccacctgccttggcctcctaaactgctgggattacaggcatgaaccactgtgcccgacccctcatttaactttaataacctcctttaatgccctttaatcttcaaatacagtcacattgagagttgaggcttcaacttaccaattttgagg

SEQ ID NO: 20572 - DNA, 1054 bp, Homo sapiens
aacttgctgcttgaaaaataaatattaattgtacaacctaagcaaaaaataaaataaaataaaataaaataaaaatgtgtatttacacattgcccctcagtctcctcagttgccttagggatagcctgtgcttccatcctgtacctggaatgtgaagaagaaagtgctgttcactgaatttggtaggaacatgttcatttccatttctagagttttctaaggggaaggatactttaaagataatcaattgcctaagaccttaataataaataaattagccaataataaattaaacatataatacaagatcaaacttttataatatataatataaataaaattatatcataaaatataagattatatctaatatgtaattaatgtaatatgttatataattaaattttatatagaacattaaaatatatgtatgtaattgaatatatattcacatgtaataaaaacattatattttcaaaaatatttttacttttaggtgtaagaagagtgtagaagtagagtttggacacataaatgtctgaatttctagatgcttgaagaggtgtgtccattaatacgaaattaccttttccagatttgccttgggtggtagcccccagctgaggtgctaagagactggagtaaaacaaagcatctccacccagtctctttttttgttgtcataataatactaacagttaatattagttgaatactcatatgtgccaggctccaggctgattggtattcattgttttacacaacagtgttccagatttgtattccttgttttacataattgttacaatttccccatgaggtaggtattattattagcctttgtacaagggcatagctgagattcagacaggcattgtaacttactgaaggccacatcactgctaagtggtagagtcagaatctgagcacagagcagtattattcctgagctcaagccttaaaccattgtaatctaccacctggccttttattattacttttcagtagcattgtggtttttttcttcaagggctattttttacactggcatttc

SEQ ID NO: 20573 - DNA, 1453 bp, Homo sapiens
cgcagcagtctccggtggagggctgggactggtgtgtgtatctgccatgtctcgcagcaatgcatgtggagcttggatgcctagcctctgttcacataatatggtgccaataaagcatcataattaaaatctttaattatcacagaaacatttccagcaataagagggactgagctgaagaaagaagtgatctacttctctcttctttccacccaaaataaacacaaaagaacgctgcataaaatgtaacagctaccacaacaaaaacaagtatatccagccaaagttcaaagtaaggaaatcctgccagggcagtaagtgggggctgaggctgctgtagcccacagacaataaacaggagaaaagacctgggttgaaagctgggattcaggaatttggccactgcctgcatttgcccctggagacaaaaccatgcctatacataaagccaagcatcttgacacgctccatgctccttgacctcatagattagaaaaccctgcctcccaggctcagcaaaagtgccaggaagcttgccctctctgtaggcttttggacaaaaaataaaaataaaaaaagtctctcataaggaattaaaaccacaggtctgagctctatgtttgcatgtggcctgagtttatgcttcccgtgaagtgtgagaaccacaagctgagaaatcaacagaagaactggtctcaggaccattgaaaaccttggtatctttggcaaaagaaaaactgaagctgttccgagtgattttttacaacttggttcccaggagactaccccagaatgaacgaccacaattgaggatgggaaacacagttagaaatttcagtcactcgaagaaagaaacctaccgtgtggaagaggcagtagaaccaacaaaccccaaactgacctcaaaatcataacactctgaaagatacttacatgcttgtttcaaattaaagaaacaaaagaaaatattaaaattattatgaaaaatctggacagcataaaaatatttgacaaagagccaaatagaatgtgaaatgaaaaattgtaaatgttgaagttaaaaactcaataggaaggataaactgcagattaaaatagcagaaaaacatagtccaggcatacctcagagatcttgcaggttctgctccagaccactgtaataaagcaaatatcacagtaaagcaaatattacaataaagtgagctgaacaagttatttgatttcccagtgtgtataaaagttatgtttatgctatactatagtctattaagcgtgctatgtaattatgtctaaaaaagtacataccttagtttaaaaatactttattgctaacaaagtactaatgatcagctgagtcttcagtgagttgtaatctttttgctgagaaagagtgttgcctcagtgtcgatggctgctgactaatcaggatagtggttgctgaagactggggtgg

SEQ ID NO: 20574 - DNA, 1093 bp, Homo sapiens
aagtaagtcttacttttgtctttcttttccccttagtcagacctaccaaagacttatctagtccattggtctttacaaggagcagatttcggttttgcagattagtgagaatattttcggggggctgttttctatatcattaattcttgctgctatccttataatttctgccttttactttctttgggttacttttattattttgttcatattttttcacatgggaagtaagacagaggcagaaaagcattatagaaactataatagaagtctatacttagcctgttgagaacacaaaagaacaatagatttattctataaatgggggttgggaaagagtgggtgtcttagtctgtttaggctacttcaacacaattccataaactggatgcttataaacaacagttctggagactagaaagtccaagatcaaggtaccagcaaactcagtgtctagtgatggcccattcttcaaagatggacatcttctcattatagccttacatggtggaaggaatgagaaatctctcttgagcctcttttataagggcactgatctcattcatgaaaactctgcacttatgacctaaacgccttccaaaaggcgtcacttcctgatattataactgtgatggttaggattttaacatatgaattttgtggggacacaatcaatcagaccaaggcagtgggggcttcatgattgaagatacaagtgaaggggataggtgctcagccacttatgcttttaaatggttaaaatatttctggaaacattcacactcatacacacacacacacacacacacacacaacttgttacagcaattgcatatgaggaaggtaagtgaaggtgtttagcatacactcttttaggctgtttttattttaccatgtgcaactactatttattcaataaatatatttcaaatgaagtaaaatcaagctcattctgttgaacacaaaaactccttgaactggaaggactctgagagataaactagtttcaacttcctgcttaatttaaaatatttttaatgctgggaaggagaggagacattagcactctcagaggcgagcaagtgcaggttgg

SEQ ID NO: 20575 - DNA, 1065 bp, Homo sapiens
gtgtgtgtggagggtatgtgtggaaggagaggagagatcgtccttgtgaatttaaactgcaattcctttcaacttccagaagcagctttttcaaggttggccaaacagcttcttgcttaccgttgggttgttagaaaaatgaaaagcagctctttaaataattaatataaaatttcacatgaagttcaactaatctgtgagaccacaatatattaaaagaggctatatattatatgttatgtaatatcataatatgtatactaatatataataatatattctttgcctagcataggaagtttaaagaaaatggaaattatatctgtggctttctataagcagaatctggttgcttaaaggggtaataaaaatactagcaaagggaaagctaattaataatagtgatggttaattttatctgtctacttgactgggttaagggatgcccagatagctggttaaacactatttctggatgtatctgtgcaggtgtttctagaagagattagaatttgaatcagtggcgtgagtaaagaagccccaccctcaccaatgtggggaggcatcatccaatctgttgaggaccccaagtagaacaaacatgctgagggagggcatactcactctctcttcttgaattgggatgtctatcttctcctgccctcagacattgaagctcctggttctccagccttcagagcctaagagttacaccagcagcccccctggttttcaggactttggactcagacttagttacaggactggcttctttattattaggtctttgaattcagattgaatgacaccgctggctttgctgattctccaacaacttacagttaagtatattgtgggaggttttggcttccataatcacatgaaaccagtttccacaacaaatctcttcttgtgtatgtctatatatcctactggttctgaagaaccattaataatataataaaggatgatttttataggaatttcatacttaggaatttatcttaatggaaataagaaaaacatctgtaaaatatatttatcgtaaaaaagatggaaaaaaat

SEQ ID NO: 20576 - DNA, 1049 bp, Homo sapiens
tttttatactttaataaaaggtttcaactttcatttaaatgaacaaagagaagacgaagtaaatctgaagaaattttcactgcactaaacatcagatctcaattttttttttttgaattttaggcaaaaagatttagaaaccataaagagagagaaataggaatagtttattttcttctcccacagtggcttaagagtggcatattattgagttttttacttgctcttatacttgagaatgaacttggctagatatattcttgttttatactttatttccctcgtaacttttaaagtatcactccacagtcaataactcatgctgaattttttgtggtaaaatcttaagccagcctgactttttctcctgcactgaactataatttttttttttttttgtcaggagggataaaaattctgtctttatccttgaagttaaatcatttaatgaggttatgtgttgatgccaataattttctgtcacttattatttcccatatatgttgtatgaatttaatctgtagattctgttttttccatttcatggaaatttttcaatgctgtatctctaaatatttttttcccagtttttggtccttaatgacaggagccccagttagctttcagttggatcttcttggtcttctacatgaatcatccactctgcgattgctttaatttgtctttctcattcattgagaatacctgaagcccttctctgtgtcattaatttaatatttaaaactatctactatatttcttgctctttctaaaatgtcattagggtcaggttctctattctgttccattggtctatgtgtctgttcttgtaccagtaccatgctgttttggttactgtagccctgtagtatagtttgaagttgggtagtgtgatgcttccagctttgttctttttgcttaggattgccttagctattcaggctcttttttggttccatatgaattttaaaatagtttttttctagttctgtgaagaatgttaattatagtttaataagaatagcattgaatctatacattgctttgag

SEQ ID NO: 20577 - DNA, 1019 bp, Homo sapiens
ttatatggcatctagtttctgtcttgacatctatttaacaaaagaagttacacggcatttccgatgcgcccccacaaaacgcagtccttctgctgatcactggagctgctccattgctcctgctccgttgctctgcggggcacatagagaacaatttccaccttcctcaccaccacccctttccaacttgttttgttcatgtacttttttctctgcctttggataaagtcccagaaagttcccaaagcttttctggttatttctttgggggtaataatgataatacaacccagaccagcctaacgtcaaaacgctgggctcttattcagtttaaaagttcttccctccctctgcctgagcctgccttgggcagctctaccccaagtcgtggaaggagacacagcctggcttctccctcatgtcctctggctacctactccttcattcactagctgggaaggtgacgatgagcttggaggagaacacagtctcatgtgggtggtgaggctttacctggcattggtatgctgtgactgtgtcacggtgaacattttgacatcttctcttgtgtatatttttgagttttttatagctccctcccatgcagtctcctccatgctaagctctgctaccccacagttccttgaggaggtgatccctcagttacccagctatttatgatgcctttgtctactggcttctgctgacccacttcttcactagggtcaccttgttcctgcagctttcttaggtggggtccatttcaaaacaactcatggccggggctctttcagaaggtcctcacatgacccaaagcaacacggatgcattgttacctcaacctctgagatttcaggccattctctttgctctcctgccctcctcctcctgccaaaagcccgttccattcatttttttcaggcgtgagacaggtaccagtccctgtgtctccaaattccatgggaaaaagtcaagtgtctgagttatactcctgatgaaaatagatgaaggggagggag

SEQ ID NO: 20578 - DNA, 1049 bp, Homo sapiens
ataacccaaacccttcccaccgggccccacctgcaacattggggatcaaatttcaacatgagatttgttttttcttttgagacagagtcacactgtgtcacccaggctgaagtacagtggcctgatcacagctcattgcagccttgacctcttgggctcaggtgatcctcccacttcagcctctggggtaactgggactacaggtgtgcacccccatgcctgactaactttttgtatgttttgtaaagatgaggttttgccatgttgctcagattggtcttgactttggctcaagtgatccacctgccttagcctcccaaagtgctggatcatacacatgagcctctgtaccgacctcaacatgaaattttgaggggagaatatccaaacgatgtcagtacgggttagagtcctaaaagaaggatccatggtagaagtggtttttagacagaaacttgagaattgagtagcattcagagggggagagatggtgactctctgggaaggcacgtgtggaaggggcgaaacttagtttacacaatcaagtgtgcaataaatgcaattttgtttttctataacctgatttatttcaatatctactacctggctattggaaagataatgcttgtcatttctggaaattttcttcctgtttcttggggttccattgatgttctagggacatcatgcccttgatgtcatcttgctacacagcatttgctgagattgtttctttctttcttttttttttttgagatggagtcttgctctgtcacctgagctggagcgcagtggcacgatcttggctcactgcaacctccgcctcccgggttcaagtgattctcttgccttagcctcctgagtagctggaattacaggtgcccgccactacgcccagctaattttttgtatttttagtagagacggggtttcaccatgttggcaaggctggtctcgaactcctgaccttatgattcgcctgccttggcctcccaaaatgttggcattacaggcgtgagccaccactcccggcctgagattgtttcctg

SEQ ID NO: 20579 - DNA, 1035 bp, Homo sapiens
gaccacaacaattttttttccccaatggggcatcatctgggactaattatccactgatcacacttagcaataatagttatcatcatcatcaaaacacacagtgggggtaaaaagatttatgggttacaaaatgcctccacatacatcatctcactcaattcttggggcagtttctgtagcctccagtctccttggcggagtgcctcttctgagctgtctcctaggactggcccccttggtggcttggcatgccatgagaggaggctaggtgtgcctctcatgatcacaaagtggtttggacgtctttggcggagaacacagctctggcaataatgtactgattttggagttttcttgagattagtccatctgtttatagctaagccatgggtgcctgtgcagaagtcacctaggagccatcccatgtttctctttaaatgccattggtcctttggcctttgacactataattttttcttagttggctattcattgtcactgtttctttatagagggctcctgaagattctgctcagtcctaatgagtttcaggacccttctaaggagttttagtggctcttccccaggaagaagtgaaattcatgcatacatgtatttttcccccattgtgtatttatggtgtccaatgtgtaccattaactatgacaaacattgcaggcgcaatgatgaacagacataatttctggtgccctggatccagggagattagacagatggaccaagtataggagtgtcgacaaggagtgagggtgggtgacacacaacactgcacatgcactccaaacctgtgggcaatgcacacgcacatacaagcacatgtatggtgagatccctgcattcatacagaaggctgcgcaggaagactggcttccttcaaatgcctgctggcagtcacctaatcaacaccttcattctttgattgaggaatgagaccccagatccagttaaccacagagaaaatcctgcagggcaaaagatggtccctgagacaaacatgctttttttttttttttt

SEQ ID NO: 20580 - DNA, 1024 bp, Homo sapiens
tcagacttttgcctcacaaagctgtgaggactctgaaggtcctgcccctgcctcacacagcctcgccaggagtctgctgagcacctttgaaacaagagcagggaaaagatgaaggtctgggaagccactgagctcacaatattcatctacactggtcacctttgtgttagagagtgtgtgtatctgtatgactgagtacatgtgtctatgtgcatagatatatctgcgcgtgcctgtctgtatgtgcacattatacgttgatgtgtacgtatgtcagttctatggctgtgtacctgggtggatatgtgcacactggaatgtgggtccctgtgtgaggttgtaacatttgcttgcatgtgaggatgcatatctatgtgtaaatgctctcatgtcttgcatgtttagtgtgtgtgtatctgggcacacatgagtgcatgtgtagagatacgtgtctgtgtgtatgcttgctctccatgcatctgtgtttttatatgtgtaactgagtatatttctacatgtgggggtgactgcgtgttcttctttgaggatctgcatgaatgtgtcctttttgcgagatttctcttcccattcatcttacatctctctcactagttaaatgttccccatctctgtgcctcctctattcattctctctcaccaaatgagcttctaagcaccagtctccctctgccatcaagattggctgttttcactgcacagttctcttctcaccccgtacttgctttcttcccctgcctttctctgcctgcttttgtcacagtctcattgcttgctgacttggaggctagggctggtcttcacttagcctctcccttcctaatttctagccccagtgggcaaccctgtcttagccctggctgacctccacagtgaatcatcatgttcctgctactttcctgacccctatactcagcctggaattattgtaggagatagcaagagcattcagaagagtcagttggttaccagtgccttggtgtttactcttttatgtcttagttcc

SEQ ID NO: 20581 - DNA, 1040 bp, Homo sapiens
gctgtgtatcattatatactttctctaaacatgtatgcaaccataaaaagctatacataggatttctctcctttttaaaaagtatataatcttataacatttatggggtctttttccagttattttgctattatgaaaaatgttgcaatgaatagtcttgaatatacatccttgtgcatttactctctggtaaacatctagaagccaaatttctgcttggtagattactcatattaacattttttttttagttattccaaaattgctcttcaaagtaattgtaccaatttgcagttctgccagcactgtataagttttccatttctcgctaactccatcaattctttgtatcattgagttcgctgatttttgctaatctgactgatgtgaggtggtatttcattattctcatttgcactcttctttgattgctagagaggtaagagcatcttttcatatgcttgttatctatttatgcttatttttttcttggattttcattttgtctgattttaaacgaattctatgacattctgctgaataaagtgagttacataggttgtaaacaccttcccatggtagctattgaccttctttttgttgtcatcttgatacatggaagtatttagtttaatgtagttacattctcaatactttcttttctcaatatggtttatgcttttagcattataagtaatatggcagtactcagatgtcatcaagatattcttctatatattctttttaaatttagcttttcacatttaggcaactttgagtatgctatgaagtagtacccaattttaccgtctttcatataaatacttgaatctatctttttctatatggtgatgtctcagcatcatttaatgaagactctcattctttgcccagtgatttgtgatgttatctctgtcatattccacatttacatatctaagtggttttattcgtacgctctctattccctgtggcaatatcacattgtttagtatagttttacatgataatgtagtatcaatattcaaaaggataaccac

SEQ ID NO: 20582 - DNA, 1033 bp, Homo sapiens
ttgaaggctgtcacatgcattccttggcttgcagccccttccctcttcaaagccagtaatggctgatcaaatccatctcctgctgcatcaccctgacactgactcatctttcgccttcttcttttacatttaaggacccttctgattacactgggcccagctggataatccaggataatctctctattttaaggtcggatgattagcagtattaattccatctgcaagcttaattcccctttgccatttagcctaacacattcactggttcctgggattaggatgtggacatctttgaggggccgttattctgcctaccacaaagcctatgtcactatgttatttaaatctccctatccctccatctgagctagaaagataagacttaatctttgaaggaacttattccaacactcccagtgtgataaacctagatcctcccccttttccctatgcaggcaagataggcaaacacaaaaaattcaatacttcaaaagaagaggaccaatctgaggaatcgacatattctttatttgtcacagaatttctaccataaatggaaggaaataagtgcagaggtatatcatttctatattcaaaagtgctcttctcatattagcaatagttacttagaactattgaaaaatttccctgtcacaataataactccacatttggaaataaactgaataagcaatttgcaacttttactaagggactactctatggtaacaaataagtccccaaatctcaatgtcttaacacaaacaaaaggtttatttcccactcacttcaagcctgatgcaggctgagtgacttcaagattgccatccttcaagtggaaactcaaagatccaagaggctttcactttgcagcttcaccattcttaatatgtggcctcggtggttaccaaccttggagaatagtgtgagggactcactcttgattccttctgaccataagtggcaaatgccttttatactcacagcccattggttagaactaatcacatagccccagtgtaactgcaat

SEQ ID NO: 20583 - DNA, 1045 bp, Homo sapiens
cagaatgggagaaaatttttgcaatctatccatctgacaaaggtctaatacccagaatctacaaggaacttaaacaaatttacaagagaaaacaagcaaccccattaaaaagtgggtgaaggatgtgaacagacacttctcaaaagaagacatttatgcagccaacaaactttttaatctttgttaacgtattcggtaaaacatttttaccaattttaatttgctgcttcttttcatttctttcacttgttctctctatgtgaattgcctgtttatgtgttttactcattaaaaaaatgagtccttggccttttacttgtggatcacagtcctgttttcatattaaaccctttatatattagtcctttgttcataatttgtctttcaaatatttcccccaccttttcatttgtattttgatatcactttagtatttttggtatatgtgaaattataaatatttatatagtcaaccttatcaatatttttatgtatggcttttgagttttgtcttgattagaaggactttctactctctcaggattatgtgaaaagattaccttatgtttatttctgatgcattgaaacttaaaaaaaattaaatattttttttacctgtaatttattttagtgtaaagacatgaaggaggatttagtgtgactttttttttcctctatgattggccaggttttccaacaatatttattgaatcatccatctttcctgcaatgaggtgaaatttgctttatgcattattttatattttccagtctcttttggggctttctgctttggctcattgatgcatctgtctatttatgcaccagaatcaaatattttcattaatgtagctttgaaatctcttttaatttctggtaagagtaagcacacaaggcctttctgaagtggtttttttttttttctgattgctactgagccttttggtaagaatgaaagcagttttagggggtacagttgccctcttttcttttaggtgcccagcatagtgcatggaatatatgcttcttgatcctattattaaca

SEQ ID NO: 20584 - DNA, 1045 bp, Homo sapiens; identical to SEQ ID NO: 20583

SEQ ID NO: 20585 - DNA, 1028 bp, Homo sapiens
aatattgtgtctgctcatttcttctttgaaatgatggtagtcgttggacttgctgctacatcttgctatttaatgcattagtaaagaaaacccaaagtatacttagcacacatctgtgtttaaaaaagctttgattatttagtttcaacaaaatgggtttgtttttattcttatgtattttattaaaaaaaatttcagaacccctgacataaggtcagttcctctgacttcaacacctatcaaatcttgcttctgttgcgtatctgaagtaaatggtggaaacttctctcccttgacatctaccccaaggagtaaccactgtctacagcttggcatatatcctttcagactcgtctttttcagtacaaatacacatatatatttaatgtatgtatacacataatacacacagttatttttaatgagatcactatacatatcttgcaacttgctttttccgcttaacatctctccctgttaatgtaaaattgcctcgattttttggattgcagagaaatgccagagctcatgtatccatttctctttctgatgggtattcaggctggttccactttttctccactccaaccattgctgaaatgagcttcctgaggcagctcatcccctcgtcttcccatgctgcttccttgagtgtctcagtggctttctggggctcattcctgaggaaattgaagcagtgggatgtatgggcacctcatatttgagcttcttttcctgtaggttctttagaaacctatgtgcatggtggtgggggagtcctggcttctagaatgcacaaacaggacgatcagagatcctggtgcttgagtgatctcaaaatataaatcatgtttcaaattatgaagcaaagcaggggtaatgactgcctcactctttttttcccacatcctccaggtctctgcatgtcttattacaggattccttgtacagttgcacatgctgagcactgcacaatttcagaatgatgggagtggagacacaatttcacatggaccataatgaaaatg

SEQ ID NO: 20586 - DNA, 1028 bp, Homo sapiens; identical to SEQ ID NO: 20585

SEQ ID NO: 20587 - DNA, 1100 bp, Homo sapiens
taaacaaggagcagttatcgagtttatcaacagcaagtgtaagagccactttggaatgagaccagagcagtatgaccagtcccttagtctttttttttttttttttttttaggacagggaaaacaagacgggcaccctgaggtagggattttgatccttgggtcctaaagggggtcttcagaggcagtggaggagtcacatggagcagcgcagctctcggtggtggaatcccaaccagggactgacgatgcatccaggaagatgagaatctaggagtaggaatgccggccctgcagcctcactccatgtggacagcggttgtgaaaagatggttaaagtgctttgcgagctgggtccaagcagatgtacacatctggacaatgtggctcttttcagccttgattgagtcattcattcttggaggctttttggaatccccacacttttagaccaaagggcacattttcagagcccacacattatcagtgccagataagagtagacagattgagaaaccaggggaggtagagccagggaaggggagtaaacacaacctgaggtttattgtgatctgatgttgtcagagcctgggctgaagctaagggctgggcttatgtttgtcaagcaatcaggaaaacctctgtcttcttctttcactacacatccccacatcaccttccctctgtctctcaccaggaacccaaggcttcagccagctactgtggtgcttgcaaaccccacaacagtgtcctagatctgtaaggcatggctaggctgggcctgtccccagctctgagcatgtgtgtgggaacatgggggcatgctgggcagggccagatggagatgaaggaatacctcatgttaggtggggcttgaagccaccccatattctctgccttgagcctgacaattatctgatttctttatggggcaggccagaatatacaggtgcccactcttgttagcacactgctcagggcagcagatggcatggaaaagaccttggacttggtgctgagaccttgtcttttctcccaggccctatattccagggccaatggaaattccaaccccatctatggcctttctaggaagcttct

SEQ ID NO: 20588 - DNA, 1100 bp, Homo sapiens; identical to SEQ ID NO: 20587

SEQ ID NO: 20589 - DNA, 1136 bp, Homo sapiens
ttaacaagctctccaggtggatgcagcctcaagtttgagaaccactacactatggtttccatcagatttcccccctgcatggttgcatagagcattagacttccatgtttcagcctgggcttggggccctggtagctgactcctggccactgcccatctctgctaccttctgtcattccaggctgagaagtgcaggttggatgtcgtgcttgtagtaatgtgaccactcttggactctggtagaggagatagaaaggttttgaaacggggacttttttttttcacttcccctctgtggaccagcctccacacagcccccagcctacccagcctctctcctttaaagttaggagactggaaagcagaacacccagagactatcatgacagtctacagctcttgagcaaggccatgcctgcaggcctttgcggggctcacttggcctgtctccagctccacaaaaaacatgtcctcttctcagggggtggagtcatcttagcctcatgcagtgaccatataggacttagaaccacccccacccagggtggctactaattgctttccagtttgaggaggctctggctaacaagtgtattttcccataggaatctgaacctgtgatgttaagaaatcagtaaatattaaaaagaagatggatgcaagaaggatgaagaaagaaggtagggttgggagtgttaccagtggaagctcctgcactggggccgtctagggttggaggattcgcagtgggaagaggccactgggcggccactcttttttttttttaatatatatttttattatacttaaagttctagggtacatgtgcacaacgtgcaggtttgttacatatgtatacatgtgacatgttggtgtgctgcacccattaactcatcatttacattaggtatatctcctaatgctatccctcccccctctccccaccacaaacaggccccagtgtgtgatgttccccttcctgtgtccaagtgttctcattgttcaattcccacctaggagtgagaacataacggtgtttggttttttgtccttgtgatagtttgctgaggatgatggtttccagcttcatccatgtccctacaaaggacatgaactcatcattttttatggctgca

SEQ ID NO: 20590 - DNA, 1025 bp, Homo sapiens
aaagaatggcaagtacctcttttgtgtcaggcacttttctaggtttgaggacacaacagtgtgcaaggaatacacagacatggatattacagagcttatattccaatagggttagcagagttcctatttcggtcggggaagccagtccaatactgtaaagacgcctgaccccatcatttttagtgagaagtcactaaagggtggagaagcgtggagacagccttgctttgatgttgcttatggggtgatggggctgggctctcagactggcatggggtaattctgattttctccatcaggaagcctccagcctgtgtacctccaaattaggggaagttgtggggtccagtcctgcgtgccctctacccggctgtgggtgtaaatgtcatccttctcatgccgaggcagtatttcctgtcaccattgtcatttccactcatcataaacaggggttgggggtctgccctggtgtgcctctttcttaccaggctttctttggatttcatttcacctagacactcttccaaaaggacacaaaacccagtgacaaggctgatttttagttttcttctttggttgctgtggttcctatactcttgatggtttaacctatttctagggctttctatgcctggaaccagcatagaccatgaatatttctgttcctttatgttcagcagcttctagctccatggctgaagaaaaaaattcagtcattaaatgtagtacagacatatttggaaatgtaatacatgcttcaaacatgggatgtttttgaagttttctagaaaaatctctttagctttcaggctgggtggaggttgattcctcagaagggagtgggctattaggaaaatagaaatgatgtgtgcctgttccaggaaatgcgagttgagagcggcttctcatccgtcattgagcaagtttattcgtggtgagagtggacagccccaggcgtctcaaaggctctgtctgggatgggggtgcagtaaggtgggaaaagactgtggttctagggaagacct

SEQ ID NO: 20591 - DNA, 1097 bp, Homo sapiens
acgtctgtaatcccagcattttgggaggctgaggcgggtggatcacgaggtcaagagatcgagatcaccctggccaacatggtgaaaccctgtctctactaaaaatacaaaaattagccgggcgtggtggcgggcacctgtagtcctagctactcaggaggctgaggcaggagaatggcgtgaacccgggaggcggagcttgcagtgagctgagattgcgcaactacacttcagcctggcgatagagcgagactccatctcaaaaaaaaaaaaaaaaaaaaagaaaaggaaaaagaaagacagttctctgcaaatagataccccaagggttattctttttaagttgatctttagtcttagagctgtgaaggatccctaaaattcttccactttagaattaaggaactagagttttggaagagttaggtgattgccctaaacctttataatgttagtgacattgttaaaactcaaatgtgagcttcctgactctcaatctaaggtgctttccactccccccaacccccacagcagatcgaccctcttcccacagagaaggcagtttttattttccaaacagctcctttgccaaccagtaagttaacagaagatgccagactcaatatgacaccatcatagccaggccaggttaattccagataccgggtcctctgatttaaacacagccttttggctggatgcagtggttcactcctgtaatgtcagtgctttgggagactgaggcaggaggatggcttgaggccaggattttgagaccaacgtgggcagcacagtgagaccccctcctctacaattttttttttctaattagctagagtgagctgtgattgtgccactgcactccagcctgggcaacagaacgagaccctgtctttaaaaaaaatacaaaaaaattagctgggcatggtggcgggcgcctgtagtcccagctacacgggaggctgaggcaggagaatggcgtgaacccaggaggcggagcttgcagtgagccaagattgtgccactgcactccagcctggatgacagagtgagactccgtctcaaaaaaaaataaaaatgaaaataaaaataaaaaa

SEQ ID NO: 20592 - DNA, 1030 bp, Homo sapiens
atgtgagtggggtgtgtgtataattttggggtaagctttaaaggatggctttaaaaatgatgggaattgtgtagttacgccctctcccccttgccaggagaaaaagacttgctttgactatagctatcacttgttgggattaacttgctgctttctgggaacttgcatctgtatggaaatttcaagatagaacttgtctgaaactgcttattttcttctattgaaaaggatccacaggcttctcagaactccagcttcttttaaccacctcctctttccagttcctgccttcaccctggtttctgtaaaggaacttctagtgcttctgaagaccccaacgctcaaatgatctgttccaaggaaacgttctaaattacagatgtttgttctcggtgctctccaaatgtctctgaggccaaagcacttcttgcatagtcattgagcacgtgcttgtatggtagttagaatgaaagccaaggcaaaaatagctgtcctcaggttttggtttttaatcgtctgatgttggtgactccagggtaagtatttacgcacttgagctttgtttgccccatctatagaataaaaatccacattttattttcagcctctacatttctgcacaaatttggtgtgtagggtgggtgggggttggctcccattttcaagccttgtaacttggctttgcaagaaaggaagctttgtttattataatcattatagtattactatcattgctagagactagagtctcaatcctgaggttcagtttcacttaataccagaaagcacagtcttaccaattgagaactcagtcacttcaagaattttctgtgtttctttcttaaatttaagtctagaattcttccacctcccagtgtccttcaggaaaggtatctgagttcggacacccattatctaacagtggggcaggggtggagtggggtagtggtgagagatgtcagtcatagggatgtaataggtctgcactggtacccagtgatgtgtccttatccctgtctggtcttgagtc

SEQ ID NO: 20593 - DNA, 1044 bp, Homo sapiens
cctgttctccagctgggtggcagctccctgaatcaggccagtttgtactttttcacctaactcacatgatttccacttcagtcgcactaccgctggctgccccattgtggacagcttcattaacctccgttgctcctaaaggcagtcttttgatggaaatgagtggcggaaaaggctgagagcaaccaggccaggctcagcccacttacttactatagttagcctctctgttatgcctcacttaccccaaggactctctgaggagtggccattagtcctacagctcctgagtgcatattgtggccagtcccacaaatgtgaagttctcttctttcctccgtgagtcgttgggtcaaatagaactcttgttaatagctcaccaagtcagttaaagattgggaaggtgggcattgtgaatttgggattaaataatgtccaggtggttagaatggacttaaagagaaatagagaggaaaaggatctagtggtcatagtgaatcccaagttgaaatgagtcaacaggaagggacagtgatgaacaggaagggacagtgggaaaaccctgacagaaatgctttagctacatcctgtaccttcccacttttattagaagatgcttgatttttgttctaagaagggaaatatgtattctaggttcaacaagttataaattccttaagggcagacatcttttgcatctctcaccaggtttaaaaattaataattgtggccaggcgcggtgattcccacctgtaatcccagcattttggggggccgaggtgggcagatcatgaggtcaggattccaagaccagcctggccaacatggcgaaaccccgtctactaaaaatacaaaaattagcctggtgtggtggcgcacgcgtgtaatcccagctactcaggaggctgaggcaggagaattgcttgaacctgggaggcggaggttgcagtgagctgagatcacgccattgcactccagctctgggcgacagagcaagactctgtctcagggaaaaaaaaaaaaaagagtttacaagacattttc

SEQ ID NO: 20594 - DNA, 1060 bp, Homo sapiens
ctggtctgaaagtcttgggctcaagagatcctcccgcttccgccttccaaagcgctgggataacaggcgtgagccgctgcccgggccatccctcgaggaagtttcatcaggtagacattaattctttcacgaggatcacggatcgagctctttactggaaacctgcgccccgccttagttctccacctcttcgtgcggctccaggcaactgccaacagatggcgcccgcccgcctatttctctccttgcggctttgggcctggaggggaggtggggagagtcccaatagcagaggaactggtgagcccgggccaaaatttcatctggcatccggaatgcattaaaaacaacccacaaatctgaagctcctcgcaggagagagagagagagagagagaggagagagaggagagaggagagagggagggaagagagtgacggagaaggagagaaagagacgggagagaggagagagaaagagagagagaggagagagagaaagaacgaacgaacagggaacttgtaaaactaaggggaaaagggcagaagagaggcagcagcgtggtccctgcaagcgtccgctttcctggccaagcagcccccagcacgcctgctttgtggggcagggccatgcggccccgaggaaggatgcggtgagccagagggttccagacaaaggaggggatccccaaggctctgggccagccagtccctgttttactggcaccacggtccctcctaggcgaggacgaagagggaaggggtggagacctccaccttctctgcgtgtggctgcgtccctttacagaatgacaggcccttacttccgagggcggggactaatgtgtaaggcttaacagatccaattccagaaattatctgtgtttttttcaatcaccctcttgtgcccccccaccccccattaaatttcatcttttatctttttttgggccttcgtaatgaaaagtggttttaaaggttgaccagttttactacttagtgcctaacaggctgagtgattataccgttgaaggaggtcacagcgggaaggacatggagag

SEQ ID NO: 20595 - DNA, 1047 bp, Homo sapiens
caatgtgacattgtctaagctccttgccatttgagtctgaccgtatattctgaagtctgccttggcttcctaaggactgttcctggccttctggagcccccaatactcccccactcaaatctgatgatggggcaagttcctcgcatagtacaaagagaaggggcccaggagtggcatgcaaaagaacagaaagttactgtgtttatggccgttagaaccaaaagtgcttctgagagaatgaaatctagcatcctagctttctagaagaagaaattaaagcccagggaggagaggggatttgcctaaggtcctacatagcccatatgtgaaatgtcctcagccttcccaagcagggggactccatggggatggatgggtcatctcccttttgatttgacatagtccttaatcagccatctttctttggtccaattaggtttggtcatggtagtaggattgacttgcttgaaatacaatggctgctttaggagttggtaacttaatatttcctgatctgaactatatatctgtaataaagatgtatcaatgatcttctatcggctatttaaaatttacatatatatatatgatgttcgtgaagccagcaatatgcaaagcagagagcatggcttctagtagtttggggattgtggcaacagagattgctttccacttggggactggatttcaccagatgggacaacagactctcctttcttatgaaccttcgaacattgcagggattgtttgagtgttgtcatagttactggtattggtgaattccccctgtagacttgtcccctttgtgtcttcttatggaaggtccttttgggatcccagggtgatatggagagagttagagcctggtcttgccagaaggactttagatctcatgatttcttgctcacgagataaagcctggattaaagaagaaaactctggtaaagattttacaaatgaaacctgtcatcctggcttacagtgtctttcccagtctcttcctaaccccatccacttcaacatcagagcaacccacatcccaagaaa

SEQ ID NO: 20596 - DNA, 1020 bp, Homo sapiens
aattaagacactccataggcatgttggaacttagcaagattctgtgtaaatcatagagcgaccaaacattcttgtctcttggcttacatgtgtgatatttgctccattacccattagatcactctgttccttcttcctcctagattaaaaatttcaatgtttacactcatttagaatttcccttgctttctgaaagcacttaatccagagtaaaaccatgattcatggagcccttcttgaaatcacccaacacaaccccaaatcctttaaaaagcccttcccagcaccctcatactgaggcaccccatggttccccatggtgtgtgatctctcttgtgtaaaagtgtgttgataaacccaactcgattcaaccgcagatctgttcctcatgatctctgacgggtggacgttgacaataattttttgagcttagattataactccattttatatttttgttgtagatctgcagtacttgatttgctaaaaaatgcaattaccagttaagtgagggaaggttgtagtctttgttcagtacgtaaccaagagttttctatcattttaaaaactatcactagtggcaacattgctcatggcatttgagttccaggtcaaaactactgcagtagtctgcatttgtagtgggtacattaatggtaattatatgtacatatgcaagcatctaatgattgtgtcatcaggagttttggccatctccagattgaattacacattaccgtaagttgcttccttttatttctctgttacattacagttagatattaaagatacctttaatcatgatagatgatttaaaaatatgcctcacgtaagttatattgtttgtgttttagaataataaaacatgtttaaaaatatttctgataaaaagtggctgtgggcctgaaggggcgaaaaccattagtctacagtcattgatgaacagtctgtcccttaggccctcttagttggagctggagagtgtatagatacgaacttgaactctggtgttctaatatt

SEQ ID NO: 20597 - DNA, 1050 bp, Homo sapiens
aactatcattgataataacttattttttaaaaattacttttaagttcagttgtttttcatcaattatgggagctttaagtgaatgcccttgcagaatgtatgttgtatgtttttatttttattttttgagacagagttttgctctgtcgcccaggctggagtgcagtggtgcaatctcggctcactgcaacctctgccccccgggttcatgtgattctcctgcctcagccttatgagtagctgggattacaggcgcatgccaccacgcccagctaattttttgtattttcagtagagatgggatttcatcatgttagccaggatggtctccatctcatgaccttgtgatctgcccacctcagcctcccaaagtgctgggattacaggcgtgagccaccgtgcccagcctgtatgttgtatggttttagggagaacagttgaatcacaagaagaccataacatttgtactcagatgtttttttccccctagaacataaggattttactataatacctcaacatcagggttttcagcaggatgagtagtagtcataggtaaataattattggttaaatctcttgggaaaagtgactaggtctttttttttttttttcttgagatggagtcttgctctgtcgcccaggctggagtgcagtggcgtgatctcggcttactgcaagctccgcctcccgggttcacgccattctcctgcatcagcctcccgagtagctgggactacaggcgccgccaccacgcctggcttttttgtatttttagtagagacggggtttcaccgtgttagccaggatggtctcgatctcctgacctcgtgatccgcctgcctccgcctcccaaagtgctgggattacaggcgtgagccacggcgcctggccgtgactaggtctttatatgagtaataccttgcatttggttagtacagtaggttgggcaagtgatattatgtaggacagggattcttaaactcgaacatacatgagaatcacctagagggcacaagattgctgggttccacctccagactccttatt

SEQ ID NO: 20598 - DNA, 1028 bp, Homo sapiens
aaaaaaaaatcgcacacaaaaaaatctcataatgttttaagaaagtttacgaatttctcttgggccgcattcaaagctgtcctgggcagcatgaggcctgtgggcagagggttggataggcttgccctaggtgatgttaatgaagataaagaagaggtagagaagggaaaataatttaaaggtatgcttaaatgctaaagcttatattggtttttattttattcttcactctgacaaattgagtaaaaaaggttaaataatggctttaaaaatttaatggcaactatggctgggcgcggtggctcatgcctataatcccagcactttgggaggctgaggcgggtggatcatgaggtcaggagatcgagaccatcctggctaacatggtgaaaccccatctctgctaaaaaaaaaaaaaaaaaaaaaatgagccgggcatggtggcaggcgcctgtagtcccagctattcaggaggctgaggcaggaggcggagcttggcagtgagccgagatcgcgccactgcactctagcctgggcaacagagcaagactccatctcaaaaaaaaaaaacaataatggcaactattagtaaaatttaaaaccagtcgtgtatcttctgcaacattggagaagatggagcaagtaaaacagttcatagagcaaaagaaggaaaacaaagcaactgtcaaggaagcttaaatcagagagtacatgtataaagtgatgtaagtaatagcaaattcattataataggaaatgtaatttgattaaactacccatttaaagacaagaatactaagattggtcagaaatcaaagtccaaacaaaagatctaaccaaattaatgacattagaaaaaacaaaagaaggcaaagataacatcaggcaaaaataaaagaaggcaaagatcaactcaaacaaaaagaaacttggcattgtattattatcagatgagatatggatcagagtaagaaagcactaagaggaacaaaaaaaggtgattttatgaatcacagtgaagatcattc

SEQ ID NO: 20599 - DNA, 1028 bp, Homo sapiens; identical to SEQ ID NO: 20598

SEQ ID NO: 20600 - DNA, 1028 bp, Homo sapiens; identical to SEQ ID NO: 20598

SEQ ID NO: 20601 - DNA, 1028 bp, Homo sapiens; identical to SEQ ID NO: 20598

SEQ ID NO: 20602 - DNA, 1028 bp, Homo sapiens; identical to SEQ ID NO: 20598

SEQ ID NO: 20603 - DNA, 1034 bp, Homo sapiens
tgtaaggagacagtttgggcctgctatttggcatctttcctggcacctggagagagtgtaccatttaggatgcttccggctgcagcaataaggacacgttatcttacatgatttaaagcctgaaaacaagcagtttagatagtttaacagctcaacagtgtcactggggctctttccatttttctgtttctttatcctcggcttactgacctagtcctcacgttggttctcatggttgccagaaggctgctgctgcctgagaagcagaaatatcagtcaaattagaagggaaggtggaattccagagatattgtaaatatagaactggcagctgtgctcttcatgggcagggcgtgtgtcatattctgtacttattttgtgacctccacaaataagtatctagtgttcagcatctaatggctgcagaataaataatgaatgaatgaagcgatcctgagtggagaggagagtggcacgtgcaaatattttccaagttacctgccaggccaggccagactgggacaaatggacgtatccagagggcacttgggtggttgggaaagagttaaaatgaggaaagatgtttcaggagaaagaagaaatgccagttcctgagggggtattgtgcccttgtcctcctctcttggggaggagaaggctcccgagaagacagagctgacagtcaattaggaactgagggttcacagcccagcttcttcaccaccagcccaagtctaaagaaactcacaaatctgctagtgagtcaccacctccctctcctctgagcaactgtaagatacctagtagtagccctgccctatcctggaattagccagaacgtcctcatgtagcctaccaagaccgcttctggccctgtaatcaccagtgtgcatttgaattctgactccactatatatcagatgtatgggtttgggtcagttacccaatctcattaagttactgttttcttatctgtaaaaccctgtatctcatgtagataatgtattccctgcttagcacagtccctgcacaga

SEQ ID NO: 20604 - DNA, 1123 bp, Homo sapiens
cctaagctaaagctcagtgtgtttgtttggttgtggtaaagtctggggtgggggtttgatttggggctttagatagtaaatgttctgatattttgatctctttttggtaggtaatctggattctttagtttttaaatcatgagtgtctaattttctaacttatatgttaaaattgcctgtatgcttggctgatatgtgtccaatgaagggaaaattaatttatatgttaaattaattcctccaagcaaattatcctgaataatttgcactgttgtgataaactaactagggtgaccccaggcttgatttgaggattgcaggaagagatatttagtgattaaagtagggctttctgtcttttcggaggaggcattaatactttttaggttttctttaagttaagaggcagttgtcacgttatcactcttttcattttgcaagttagtctcctttaggacccagcttaaggtattacctccaccctcacctcttggccactgtaactgaaaataatctcctcctctgaataccagtgctgcttacttactatttatatcactcacatatgcctatgaaacatgacaattttggtttgatactaatatccggccttattctcaatcttaacatcatcagggatcatgattttaacatcattatcatcatgatgagggaaacctatctttgtttagggctttcgttgctgattttacacaaaataatacttgcatacggttaaaaaaatcacgtgaaatagagtttttcaatgaaaagtcattcttctaggaactttgacctgttagatatatatcgtatatttgatgactgctgggtatgttttgccaagagtcatctatgcaaaatacagtggcttgagataaacatctcaggaaaaatcatctcatacttatattttacttaacaagaattcacccatatgcaccaagatatccccccaaaccaaaagataaattagtgtaattaagaatactataaaattatgttttgcacacctatataaaattctatatttatctattcatgagttattatcagagctatacacaaaactaggtgtattttatgggcaaattcaaggatttataaagacaatattggtatt

SEQ ID NO: 20605 - DNA, 1625 bp, Homo sapiens
acatacacatacgtatgtgtatatacacagggcttctctccagtgtggatcctctgatgttgggtaacatgggcgcttctactgaaggctttcccacactcctgacaatcaaatggtttctttccagtatgaaccctctgatgctgggtaagagatgaactctggctgaaggctttcctacagtctttacaggtgtagggtttctctccagtgtagacctttatatgttttgtaagagttgagctctgactgaaggcttcaccacattctttacacttgtagggtttttctccggtatgagttctgtcacataaatgtggcagagctttcgtgtagttcagccctcattagacaccagagacttcacagtggagaatctccctgaatgtctggacaaatccactcagactcttcatttggttaaataccaaagaattatacttttataggttgttacagtggcgatgctttattatattttaagggatgaaaatccctcctctcctaccctggttattttctcttgcaaagctatcagaatatcacaaatccaagtgaagaaacactgaactgaaatctggactagcctaatagactctaaagctcaatttttatatgtatatgtgtgtatttttgtctgtacctgaaatgactgctgtcaccatgcagtgattttaccccccttccctggcctcaggaataagccaagaaattctagttgtgcagaactgagcttgttgccccttcttgtactgatggaaatagtgccatgtccaaacaaaataaagaagctcatagctaattacatatcctaataccaccttcctataaaactttgccttaatctgtagtcattcctgcccccagctcataccctcctgtgggcagcttttgtttgctttacctcatcccactgttttgtgatcaccccccgggagatgagggactcagttaataggccagatgtcaagactgatgacatttcacacactaagagaacttgaaagtttactattcatacacagggtttctggggagagcaggatagatgaaagctggtccaaaatggcaagaacagagaggaggctgggcctttaaagtagctagggaatggggctggagagcattcgatctgtgggcttgagggattcaagcttcctgccagtgctgggagctcaggagatgcccatggatttctttatctaaagcaccaggtgtgcggtggggcagtgtgggggaggggagaatagaaaatggtggaaacttaaatgctgtcaatggccagacatcaaaaatggggccaaactctgttacatctaccttttcagaaatcttttttcacttatctcaaaatagctctttaatgttattgtgtcttttttttttttgagacggagtcttgctctgtcaccaggctggagtgcaatggcatgatctcagctcactgtgacctccgcctcccaggttcaagtgattctcctgcctcagcctcccaagtagctgggactacaggtgcccgtcaccatgcccggctaatttttgtattttttgtagagacagggtttcaccatgttggccaggatggtctcaatctcttgacctcatgatccgcccgtctcagcctc

SEQ ID NO: 20606 - DNA, 1046 bp, Homo sapiens
gtgtttcagggctttatgtcattcaaggatgtggctgtgaacttcactaggaagaatggagagaactggaccttgctcagagagtcttgtacagggatgtaatgctggagaactataggaacctggtctccttgggtgagcttgggtccttccaccccagattgacctttcaggatacctttgccttctaaagattcccttgcttctattagggaatggtaacaaatgaggctttggttattttcccccacagaatccagatcagatccttaaactgtttctcaccctacttgggtagaaattatttaattgcttttgacaattagttatttcgttttctcctctctaaaatgcaacagagtgggactgagaatagagtggtcctttctcttttgaacttaaaattacattctgtttgtatctcttcagtaggatttccattttccaaacctggtatcatctcctagttggaagaagtggtaagcccacgaacacaaatgcaggagggagaggtgccaagaagcagcggtacacgtaagtgagaacaaggcagattgcatctttagaaataagagttaggggttcttcccaaatcctccgggcctgtagaaaatgttgaatccccctgcagtctcatcttcacttgaccacatcagaatcctaatagcttacctctttatttcttcccagactcaaggaagagatacttcctccttaaagttataagcccaacacatgatccagagatcagctttgtgcctcatcctgaggcattttatgaggctattcccatttcctctttagtagctggaatcacttcttcatttactctgtccttatcctacctagttttctgctatataagaaatatgaagagaaggaaagaatttgaataattttaaggatataaaattgacataatttgttgtgtagatttgagaggtgagggagtaacaaagaaaattctcaggtttcggccaggcgcagtggctcacgcctataatcccagcactttgggaggccgaggcgggcggatcacgaggtca

SEQ ID NO: 20607 - DNA, 1142 bp, Homo sapiens
gtatgaccaaacatattgatcatacctttttttcctcgtaaaacaaagtatagaaagaaagcgccataaagtcttggttaatgttgatatgcagaaaatattgagaataataattaactgatgattaaatgacctttcctgagtgcttattctgtaccaggtactggtttgggccgtttatgtgcattaacacacattgtagcaacgtaggtaccattattattctcttttgtaaaattaggaaatgaagcccagaagaaacttggctatggttacacagtgccaggatgtaaaggcagtaggcaggcagactccagagccagagttccaatgacaaaggattacaggaggcatgaattctacaaaattgtgaaaccctgtacttggtaataactgaggcctaaaagaactacttcttcccccaaacaaatccacaaggaggtttaagtactgctttttggagatgggtggagagaggattgaagaaataataaactgtaaaatattaggaaaatatagaatgatatgtagaataagataaatagcatgtaaccctactacctagagataagcgcaaagaaatgctcaaaggtaatagcatcagcagttctctccctacaggcaaaaaaatcaaaatggagaagtaaattatgagcagaaggttgcttgttgggcatagaattcagaccaagggaatttagggctcattcattaattcattcacaatacttagggactgctgtctgccaagtacaccgtgctcagtgcttaggatgcagtggtgaatgatacgacacatacaatttagtggagcgtgtgtggtgttaacaggcctgagatggccacagactcaccgtgggcctggaatactcacgatggggtggctaaaggtgtctgtgaccatgactgctggggtgggcactgctgtcttttgctgctgtgactccctttttcttgttctacaaaattggtcactttctccatttgcgaataaaggagttgagcctggaggtctttaagcacctctccaactgtaacattgcacttcttgttttgttttagggttttttggtcccagggaacctcgttttcagagcagtggctcacgcagatcctgagcccagttaatggtcatacctttc

SEQ ID NO: 20608 - DNA, 1060 bp, Homo sapiens
tggacagggtgtgtgtgttcagcagtggattgtcagacttggggtcccggctgctcccttttgggtctctccccgggcccgctgatctgactgtaattccttctgctggagctagggttcggccaccttgacgcgccccctctgcccctggagcgtgtctttgggttttgtgtgtgtgggagtggggtgtatgtgtgtttcttatccgagacacctctgggtcgtttgcttggaaaccggctgagggcccgcataccctggagcatttggttgcaaagtgaggcaggtagcgcccaaggctcctgtaccagggccaggttaggcaccaacgcgtcccttatgtctctgcagcctgcagtgtggtggaaccgtttcatagactgaagtgtgaacgtaggaggggatggatatcagagatctgtttatccacattttcagagagtggtattgctctgatgtgagcgtaggcaggttactctctgtgtctcgtgttctttacctgtaatttgaggtttgttgtacctactattaagtggtggttgtgaggattaaatggaattttgacatgcaacagttgacacagggccagacaccaagtaagggatcaatcagttgttgcttttattaatagtaggcatccatctgcccatttgcacgtaagaaggaaacacccaagaatgaaaagtagcttgttgtaggtcacccagccaactagcacatagtggaaattagaatccaggcactcccagcagggcactttccaccaccctgcacttttgtattcatcaggcacagtatccttactgttgtctgtaactgtctatgttcccagtgtctgactctgcagggccctagtggtataaaggtactgagacttgcctgtgttcagggcttcctgaagattaaatggctgccgaagttcttgagtttagctttagctcaaaagatactgcgtcagactctgcgttctgagtagagtctcagagaatgaaaaaagaaatacaatgaaaaaggggaaaacttcaatccagaacctcttaccacagtttctggtagaatg

SEQ ID NO: 20609 - DNA, 1081 bp, Homo sapiens
aagttaatgcttccatacactttaaaaagtaggcccagcgcagtggctcactcccgtaatcccagcactttgggaggccgaggcagttggattacctaaggtcaggagttcgagaccagcctggccaacatggtgaaacttcgtctctactaaaaatacaaaaaattagctgggcgtggtggcgggcgcctgtaattccagctactcaggaggctgaggcaggagaatcgcttgaacccgggaggcggaggttgccgtgagccgagatcgcgccattgcactccagcctgggcaacaagagcgaaattccatctcaaaaaaaaaaaaaaaagcattttaagagccacaaaacctaaatgcatatgcaatcgttggagtaaatctgggtattgtgaaagcaccattttttttctgaccagcagagggtactctttggctatgctcaccaaaatcacttgagaagggttgatctcaagatgtgttcagagtatgctaggataagatcaaatcaaatttgatatactcaaaatgcattgactaatgaactactcttaggatgtaaaaatggccaccttataaataacagccatatcaggcccccaaactgccatcgcttattcaacttggatggcttttgttttaaaagtactgtactgcattttgaaagggtttatcttgagttactgtttttaaggaactgagaaaaataagccaactttgtttcctcatctcagtcaaaattaaggagacttaagtatatgtgcttgaaagattagtgcagccaagtattcaaacatacttgtttccaaaaaggatgggaaaaaagccaactgatgttagcttatacaattgttctgggctctcagatttgatggcctgagggtttggaatgctgtcactttaaacaataatcgccagaactgttctgtgtctgaataggttaatccatacactgacagtagtttgggttggtttgttttttttttttagacagagtcttgctctgtctcccaggctggagtgcaatgggcgatctcagctcagtgcaacctccgcttcccaagttcaagtgattctcctg

SEQ ID NO: 20610 - DNA, 1049 bp, Homo sapiens
aaagtaagagaagacagggcagcaaatcagcagaccaaaaacttatggtagaaatgccaggctgaatcaccacacccacagcgcacaggaacaccagcccatatgaatctacagttctacttagaccagcagggacagcaccaagtcacgtgttacaactgaaagcatcacttgacgacatcctgaaaggtcataatcagttgggaatgaaagtcatttttcctttaaaatacaaaaatggcagtgtgtacaacccctccttcactaaggctaaattgaggaaacctgaatatcaaaaacgacagatttaagccattgatcgggtgccacagagacaggaatgatagctattcttccacattactagacattattctccctacacaaaaatggatttagagcttgacagaatttgtcaaaggtctacttttctttgacagctcagccaactcttccctgatgtgttgtacagaaatttcatcttttttcagctttgcttgcttcagtgcttcctggtagatctcttttgcttgtgtatatcgttctaaaataacccagagagaagggacagtaagaagaaagtgtatgttttcaaggtgattctgaagagagagcatgaatgcagatatagggctaatttactgtgtgcttatgaagcgacaagctggtgctgcctcatttcatccccatctgacaggctggaactccactgaatgctgtgggattcctaacggccctttccagtatatcctgaggactttgatgagcccaagatttcatgaatggtggtatgtgtaatacacctgtcatcccaggtttctgaaaatgatcggtatagtgtgctgacactaagaaatgtctgacaaaatgatacttcctgtcataaagcttcaccagcacactgtgagaaacacattgtaactgaacacatttagaaatctgtaaagcactactgacgtaaggtactatcattgcaaggttttctccagcttgatggggttcgacaggctagtgcaggtctgtagaagttacgtgaattgaacacaata

SEQ ID NO: 20611 - DNA, 1061 bp, Homo sapiens
atgctcagcagtactccaccaacaccgattgcatgtgctccctctgcggtgaaccaagcagctcctcaccaacagaacaggatctgggagcgagagcctgccccactgctctcagcacagtacgagaccctgtcggatagtgatgactgaactgcacaaagtgaggggaacagggtgcaggagagggatctctagtttttgtggtttaatttttagtagcaggtcaaaaacctgccctcctgtgacttattccctgagacttttcaggagagccagcccacagatgatgaagaaatgatggaagttcatttggagagtcaaatgggaaaaaaacaaacaaaaaactgcctttgatacaggcaattcagtggactataataatagtggagggttgagatgtagagtttttaaaaagtgaacagttgctgttcttacatctgtaaagaaaaccataatgtctttaaatcactcttctgtaaatagatgacctttttgcagtgtatatccccttgctgtagtatctggtgtacttatgttcaaatcagcgcatcaactttgggggtgatttttaaaaatctttttgtctatctatctttttaaccctagccttctaaacaacctcatacagcccagttacataatgttggctgtcacgggcattgtacttttatctgatattgtttcctctaaattcagctttccagtgatgtttaaaatcttgtgaaaatgtttagatttttaacacagaccctgtcataaaatctgtacattagggtcaaaaggtaaaagtaacaaattctgccatattgtaaatttccagtgcaggctttaatttttttttttcattagtagcactgaaaaaatattactgcatgggtatgttctagttcagtttataaagttttaaaggcttatttgaggcatacctcactgttacgcacactggtaatttaaccatgcccctaagtattccttttctcctgcatttgatgcagcccaacaaagcttttgttttgaaataaatttgactaccctgtccatagctacagtagattatttgt

SEQ ID NO: 20612 - DNA, 1042 bp, Homo sapiens
tttaaacgaaggcctttctaactccaaattgctagtgcctttcttacaaagtgttgctattaatttattgcatttattcttagggagctaaacagatattgctacttttcaatgaaatgaagaaaatccatttttggagagggagtgatgttcaatttaattatacatttacatctttcccctacgtttatgagtgttttgaggacagggaccatgtcttattcctgttcctatcaccttaattgtctttcctggcatagagtacgtgttcttgtgtttgaatgatgactgaatccacatgattggattaggttttcaataacctatagtctctgttctcatctctggctctagctagatccttggtggcctggagtttttagggaaaccttgtttttttttaaatgtgttagtataggaagctgccagtaaaatatgaaactctttatattaaactcagctcatttgttaggttgcttgaaatgattgtaacaaataggcagttttattcctatactgttgtgttccagtccagctgttgattgcttagatatgagttcttgctattttgtagtcaagcgtgctattagttttaattttagtgtacttaaaactaattctagtaaaattgttcccagtttaggtggtaaccattaatatatcagtgtttgtgctgttaaggagagagcatcataagctgtttctgagttttcctattaatattcatttactgcttcttcattccttcctaagaatttctgctctagattatctccattctaattctaattttatgatttcattttgagagctaaatcatttttcctcaaatgatgtactaagtggtttatgattacatactgtttcttagggctgtaaccacaaacacaggatgaggaggcagtagttttctaagtactctctgactgttgttatcattgataggaatgtccccaggattaggagtacgtggttgtaatatacttaactttggccctaacaggaatgatgcccgctcaccagggagtataagctacttgcc

SEQ ID NO: 20613 - DNA, 1046 bp, Homo sapiens
gttaaaatgatatttcacatatactgggttaattaaataaattctacaaaattagctaggcatggtggcacacacctgtaaatccagctacttgggaggctgaggcaggagaatcgcttgaacccaggaggcggaggttgcagtgagccgagatcgcaccattgcactccagcctgggtaacaagagcaaaaccccatctccaaaaaattaaaaattaaaaaaaaagtttaaattatttgaccaatttcttcttacttttttaatgtgaccatcagaaaaattaaaattacagatgtgattacattatatgtctattggatggagccgttctagagtgtcagttcagctgggtaaaaggaaattcacaggaagaggcttctagaaatacaccagaatgtcatcatttataggaatgttttttgtttagttttattgttcgttctttttcaatttcatataaattattttcagacattaaaatcctttatgcttttagtttcagaaggtcaagataatttgatctttcacttttatactctgtaggaaactttagccttctcaatggctgtaaatacttcaatgaggtcatcaaaggagtagaattcatcctaaacaactactttcaaacatggtttctatcaccacctgaaacatgttcattatcagatttttatgctgtatcattatctttaaggtgcagaaaatagttctgatacagaaagtgctccttctccttcaccagttgaagctgtcaagcccagcgaggacagtcctgaaaatgctacttctcgaggaaacacagaacctgcggttgagcttgagcccaccacggaaactgcacccagtacatctccctccttagcagttccaagtacaaaaccagctgaagatgaaagtgtggagacccaggtgaatgacagcatcagtgctgagacagcagagcagatggatgtagatcagcaggagcacagtgctgaagagggttctgtttgtgatcccccacccgctaccaaagctgactctgtggacgttgaagtgagggtgc

SEQ ID NO: 20614 - DNA, 1045 bp, Homo sapiens
ggctaattttgtatttttagtagagacggggtttcactatgtcggtcaggatggtctcaaactcctcacctcaggtgatccatccacctcggcctcccaaagtgctgggattacaggcgtgagccagtgcgcccagcccatagaaggctttttaagcatgtgatgtttgagttgatcaccaaaggaaaagtaggtgaaagagcctttcagtaaaggtgaatggcatgtacaaagtctctgtggtagaagatgcatgaggcattgaacaaactaaataaaggccagtgtgacttgaattcagagagctgtgtgcaagctggagaggctggagggggcccactgggcaaggccttgcagatcataccagcaattttgggactttatcctaatagtaatgggggtccactgaaaagttatgagagtgagagagtgagttattgtggtaaaatctggcttttaaaaagacaactctatctttgttgtaaagaatggtctgaagtggagtgaagagagttggttttggactagagtgctagctgtgaagttgaacaggattggatagattcaagagaaatttttagagagaaaatcagtgagccttgtcaaggctggatatggggtaaatgagaagagggtttaaaagatgacttcttggtctctgttttgtttaattggatagtaaaccctagaaaagaatctgatttgcgagtggttattacaactctagtacaggacatactgaatttgtgctgcctttgatatatctaggtaaagatgtcaaaaagcactgaaagtctatttatagaacaatataaacgattatagaacaatataaacgatatggggaaagatctgttacaacattaaattaaaaatctgtgaaatagtattctacagccttctgtccagtgtggtagccgctagacacttgtggctattgagcacttgaaatttggctagtttaaatttagatatgcaggctgggtgcggtggcctatgtctgtaatcccagcactttgggaggccaaggcaggcggatcacctg

SEQ ID NO: 20615 - DNA, 1748 bp, Homo sapiens
ttccaactattcgggaggctgaggcagagaattgcttgaacccaggaggtggaggttccagtgagctgagatcctgccactgcactccagcctgggtgacagagcaagattctgtctcaaaaaagaaaaataaattgagtggtaaaaagaaattcagtagtaatatcaatgatgagttgttgcttataaaattgcgtgattcttaatgctagtgaaggaagtttcttgcagcattatttataccaaaaattgaaaattaccaaaatgccttaaaataggagaattttaattatatgtcaacataatatatgtcagtattatgtcaacataatgttttcatgggatcattaataacaataattaggaagaatttgtaacagtgatatgttctgctcatggctacattatgttaaaaaagtgaatatgtaattacatagggctttcctggttgtgtttacatgtatacataaatatttatattcatgtatatgcctctgaaagattgaaaggaaatgtaccggtatatttaggatctcttactgttggaataatgagcagtgatttttgtagtgttatgtcttccacatttcaaggtatatattatctttagaaaaaatatatatatattgtttttattagataacattatctggagtgagtaaaaagcatggaggtatgtgatttttggctttttatacatgtatagtggtgagtaattccaaaagtggatcagatgtaacttttgcttagtttgataaaggcgagccatctacacaaaatttggccagttagtgattatggagaggtatttatctgcactttaaccagaactattgtcaaacatgtgacctccttgtctggtgtgtgtgtgtgcttatcaatgttctacattatttcagaaatgaatttttttttctttttagttatttaaatcaaataatactctttcctcctttagacttcacgaaaacctcgtgaagagcgagatgtgtctcaatgtgaaagtgtcgcttccactgtttctgctcaggaggatgaagatattgaagcctccaatgaagaagaaaatccagaagacagcgaaggtatctcaaaattttaaatttagttgtgacatctgctatccagaataaataatttttagtcatttgactgtgtaggagttgcttcattgaggaaacagtgtgccagtgttttcatggtgtggagacttcaaacttgaacataatgtttttattcatttaatcaacaaatatttatgtagcacctaggatggtccagaagatcttggaaatggcagtcctgcttcagacatcaagtgccaacatcaataaaatacctgtgtgtctgtgtcattgccacatttatttgttcagttagtatagttggttacatttctctttattttattggcttaagtttgatttattttcatatttttacagagatttatatgtactgtagtaatgtttttacgtaaaaagaattagtgaccttagaagcaccgatagaaaaaaaaaacacgaaacttaaggaaatttaagaaataatgtatctttgtcatttaaactaatgacaagttcatggaaaggtaaatgttttcttgatttttttggtaagaaaaaagatacctaatttatttcagtttacactctgattaaagtttctgtggattttttttttttttttttggaaattgcttctgatgtggggatttttataatgcttttagtagctcttcatatatt

SEQ ID NO: 20616 - DNA, 1034 bp, Homo sapiens
agcagattgctctgtgattcagaggaaagagcatgaagtttgtaaccaggccagcgaaggtttgagtcctgtctctgccactttcatagctttgtggccttcctcttactctggcactttatggactttgtgcttttctgtcgttgcttgttaatgtactataatttgaaattgaactaaaatttctaataggataaataattggtaatattgagaaagattagctaatttttggtggttaaatatttaccttgcagttgtaaagataaattattgtaaatagcttgacatttgagtgacacatttcatatttttttgtatcaccccttatatatgtatacaaatgcatagatacatattctttgcacgtatgtgtgtgtttatgtgtgtgcatatatatattgattagagaagtgttaaattgcataggtttctgtaatgcattgtattaccataggatttttttaaattggctagtatttttctgatggcattgcttgattgtgaattgactgaggacaaatatggattataagtggagtcatatatatgtctttaaattgtgtttatcatttatatatgattatcttattggcttgatatattgtgtccagagatctagatgtacctaatcatttagtttgcaagtatttgagctattactaatgtgtctaatgttgtcctagccctgtgagagatacataggaaggacaaggtttagcccttctgttaatgagcatgttttaaatttgagggggaaaaatatagaactgtaaatgagttttgtttcaataagtatttttataagtatcaaagtatatatgataagtaattgaaagcacacttctagtgtcaatggttgtgaatacagtgattaagttaatttattatttctcttgtttgcttgatcaggtgactgttcaattaacatttggtctgtttttaaaatgcaggtctagtagaacatggtcgtaactgggcagcaattgctaaaatggtgggaacgaaaagtgaagctcaatgtaaaaacttct

SEQ ID NO: 20617 - DNA, 1083 bp, Homo sapiens
tttacatattccattaagtagactttcgctcaaaagtataaatgcatgaagatgtttcttatagcattatagatagtgatgaaaaaattggaaacatattaagtatctaaaacatgataaattatgtatgggttatcaaattttaaggtagaattggaatgcttgagtgacagattaaatgtggaggttgccaaaaaagggaaccaaccccagatttccgagtagaatcttaacattttcactttctcgtgggtccaaatgctatgagcatttgtgtctgcgtgtaggacccttcaagcagtacatatagaatacattaaaaacctctagactggtttttaacacacgatcaccagttacattgtaaatgactaacaatcatttaaaatttttttagatagacataatttatcacactataaggagctatttctgtttgcctttgaattttacaaatgatggttcattctagcagcaaattgctcgaccctcgcaagaagaaaaagtagaagaaaaagaagaggataaagcagaaaaaacagaaaaaaaagaagaagaaaagaaagatgaagaggaaaaagatgaaaaagaagactccaagtgagttaaataattagttatataataagttaaatgtttatttttattttatttttatttttgtagatatagggagtacagttgtcacatggatatattgcatagtagtgaagtctgtgcttttagtgtaccatcgcccaaatagtgtacattatacccattatacctcacccaccccctcgcaccctctcacctgtttgaatctctagtgtctcttattccactctctatatccatgtgtccacattatttagctcccacttataagtgagaacatgtgatagttgaccttctgtttctgagttatttcacttaagatgatagccgttagtttgatccatgttgctgcaaaagtatagtttttttttttttttttttttgtgatggcgtctcgctctgttgcccaggctggagtgcagtggcatgatctcggctcactgcaagctccacttcccaggttcacgccattctcctgcctcagcc

SEQ ID NO: 20618 - DNA, 1050 bp, Homo sapiens
aatcaaccagaacctccaataatagatcggttaaagcgtgtgtgttttgtttcgcagattggaaggataacaacaaaatgttcatatggttgcctttgggtaattggtcagattatgaactatttacatgtttgtatttttaattttccatttttttgggacaacaatgacataatgttttaagcaaaataaaagtaactggtcagctactactagtagtaggtgtcaagtagtttataaatatgcatagtcttaatgttaactaaaaaatccagccaacctgtgctctatgtgttgatcttagtaggaaacagagctacctttcctctctcctctttgtgcttttcgttcacagttgagtcataagccaaatgtacttctgacttaaccttaagaagtagcatttattttaaagtattaggtttgtcagaatcagagtttagtttaattattattaatttgctacggatatttaataggaacaaaaaatctgccagcgttatgatcagctcatggaggcatgggagaaaaaagtggacagaatagaaaataatcctcggaggaaagctaaagaaagcaaaacaagggaatactatgaaaagcagtttccagaaattcgaaaacaaagagaacagcaagaaagatttcagcggtgagtagtttgatgtttaatgactgtgatatttttcttcaaatatttattgtttcttttttttaaaaatttttttagtatgtattgatcattcttgggtgtttctcggagagggggatttggcagggtcataggacaatagtggagggaaggtcagcagataaacatgtgaacaaaggtctctggttttcctaggcagaggaccctgcggccttctgcagtgtttgtgtccctgggtacttgagattagggagtggtgatgactcttaacgagcatgctgccttcaagcatctgtttaagaaagcacatcttgcactgcccttaatccatttaacccttaatggacccagcacatgtttcagagagcacggggttgggggtaaggttatagattaac

SEQ ID NO: 20619 - DNA, 1044 bp, Homo sapiens
atcttaagagaggaatcataaactctagggcttaaagctgccaaagattgactgtatgccagatgcaaaggatactggagctttaattctattaagtctattagagttgttattgcttttattggtgttttccttacagaattgtacaggttttagggtatagccataatcttattttcccagaaggcctcttagattcagcgcatactattagagaatatgaggcttttcatcagtgtatattagctgaaatatctgtactaaggtgttttgaagcaactgtccagttatctcttgtatgcattcttgactcagaactattgacttttcacagttccttaatcattatttaatacattttagggttctgtaatcctgtgaactaccctcattgtaggtttctcatagtctaagtaaaattagtactctaaaatttatctgttttataatattgcttatgtctttacagcagactggaaattaatagggtgtgtgtggatgtgtgttggagggtagtggattttgggtgaagcggctttcattctgctacagctctgctgatttggaggcacaatgggatgtttttggctaaggaaatgttatgtatgctgtagtgtgggctttatgaaagtaggcctagagatagtagcaactgaagttcctaggtcacttctctgacttgtgtacctcagttttggtttggaaagcctaaaaacttttgataggaacacttggccatgttatagttgttaagttgggtggacacacaggttttacctggaataatactatttcccagccagttgttcagaccatttgaagagccgttgcaaggaaatggctgagaagttggtatcttcctttgtcatgattgcattatttacctataaattctctataatttcagtattgttatactagaggctgatcaacactaactcacctcactttgtatagcttttagggtcttcaaaatagtacatggtatatctaaactataaaagtgaggtgagaatttgcatgtatgtgaatatgaaagttact

SEQ ID NO: 20620 - DNA, 1028 bp, Homo sapiens
aacctggctcagggagtgtgattcccatctggcagttgaggaaagtgagtcagagggctgaagcggtaggctggagccagtgctttccgagccagctggcagcctgtgggtctcatcactgaagccataagctgtggcatatcctttggaagccctaatgtgtagcgtgatgatgcctgcaggtgggggcttatccaggagccggtacaccatctggtctcacccatactgaggatccccctttgtctgtgccactttctcgtaggaattgccccccactgcctggatgagggcactgtgcggagtatggtcactgaggaattcaatggcagcgattgggagaaggccatgaaagagcacaagaccatcaagaacatgtctaaagagtgagcttctgcctctcctgccctgaaaaggaggaatgattggggccagcaactttgctctccctgccgtgcctcggtggtgctcctgaatgtggctgacctgggctgctggttccgttgactagggtcatcttgatctctgcagtttgctccagctaccagtttctttaggcagctctttgtcctccctctgcccagattttgatgtagtctaattgacatccttctcttcccaacttttgtgtgatcttttaggaaaaaaaataaatatttttaacattaaagcagtcactttggtttatcatttcttttgtactgtgatttgcttctgaggccagtcgattaatagcagatatatactcagcactatcaagatgtttgccaccaggcattgtggcttaagcctgtagttccagctactccggagggttgatcgagcccaggaggttgtggctgcagtgagctgtgttcgtgctactgcactccagcctgggtggcagaatgagactgtctcaaaaaaaaaataagaaaaaagaaaaaaatgtgtagctaaattggaaagaagacataagataaacaattattaaaaatggaagattgtggcagggcatggtggctcacacctgtaatcccagcactttg

SEQ ID NO: 20621 - DNA, 1032 bp, Homo sapiens
tatattaacaaagttgtgtaaccatcaccccaaaaagaaacactgttccagtagtagtcactccccactccgtactaccctccagctcctggcaatcactagtctactttgtctcacagatttgcctactctgggcatttcatagaaatggaatcctctctgcagccttttgtctctgccatcttcacctcgcgtcatgcttcaagggaatctgtgctgcagcatgtttcagcacctcatttcttagtttggctgaataacattccattgtatggataacaaattttgtttgcccattcattcgttggtgggaatttgggttatttctatcttttggctgttatgaataatgctgctataaacatttgtgtacaagtgtttgcacagacatgttttcatttctttagtatacacctaggagtgaaattattgggtcatataacactatttaaccatttgagaaactgctagactttttccaaaatggaagtatcattttatattcccaccagcagtgaatgagggttccttttcctccacatccttgccaacatatggcatgatctaactttctgatcatagcccttctagtgggtatggtgtctcattgtggttttgacttgcatttctaatgacttaagatgatgaatgtcttttcatgagcttattggccatttgtatgtcatctttgaagaaatgtctattcaaatcctttgcccatttttttgggttgtctttttattgttgagttttaagagttctttgtatatgttctggatataagaatcccttaacagatacataatttgcaagctggggacagtggccaacgcctgtaatcccaacactttaggaggtcgaggcaggaggaatgcttgacctcaggagttcgagactagcttggacaacatagcaagatcttgtctctaccaaaaataaaaaataaaaaaaataaaaataagattagctgggcatagtggcacactcctgtagtctgagctactcaggaggctgaggtgggaggatcgcttg

SEQ ID NO: 20622 - DNA, 1050 bp, Homo sapiens
agaaaccccgtctcttccagaaatacaaaattagctgggcatggtggtgcatgcctgtaatcccagctacttgggaggctgaggcaggagaaacgcttgaacccatgaggcagaggttgtagtgagccgagatcacaccattgcactccagcctgggcgacagagtgagactccatctcaaaaaaaaaaagaaaggaaaaaatgttgctccttctgccctccagaagcacagatggtgctgagggccttgtttgtctcagctcattgaccagagccagtcacgtgtgccttagccaagtagtgcacccagaaggggaggtggagacaggtggggagcagcgcagatggccactcacgagaatccccctgggtgccttgggtcactcattaggaaggggacaggagaagctcaaccgatttctgttctcggatagctcctgatgtagccggggcagagctatgctgttgggaatgattggactggtggcactttgtgtgctctgcatggagagagtatagtgggactgatcctccaggagtcaggtcctggagttggctgtgaacgagtaggggtccgagctgctggcagctttggcttaaagaggccatcccttccctttgcatttcaggtgtttgaggcagagcagtttggatgcccacagcgtgctcagaggatgaacacagccttcacgccattcctacaccagaggaacggcaacgccgcccgctcgctgacatcgctgacaagtgatgacaacctgtgggcgtgcctgcacacctcctttgcctggtaacgggcgtctctgcttttggcatatctgttaggatagagcagtcacgatacattggttggcttgtccatggatttgggagaacagtccttagccgtgtttgcttgctgcctctgtgaggagcactggcctgtgggcacttgtcagtgagcacagatctgggctgggagtccttgttctgtaggcctcttcccctgagtgtgctgaaaacatattgatgtggaactcacttcttcctgggttcaagtgattctcctgc

SEQ ID NO: 20623 - DNA, 1049 bp, Homo sapiens
tcccaactaacagatttacttttccttttcatggacagggctgccggtcacttgctgcagggcacccgggatatatcagccatgataaagagacctccattaaatacgtcagccaccagcaccccagccacccccagctcttcagcattgtccgccaggcctgtgtccggagcctgagctgtgaggtgagccttgtggccacagagcctgtctctgtgggagcccacatgctcccaggtgctctgggtgggctcggagccagcattgcacagggaggcaggcactggtcctctctcagggcggacccgcagatcagcacagcacagggtacaggacgcctcccttgtccagaattgcgggaggagtcatgttggacttgctgagcattttctgattgagtgctagcttttgcactttaagcaccgaacttttattatttgtcctttctttattattattgttttcttttttccttcttttgtgtcagggtctcgctctgtcgtccagactggagtgcagtggtgccgtcatggttcactgcaacctcaaactcctgggctcaagcgatcctcccgccttagcctcccaggtggctgggaccactggtgtgtgccaccatgctcaactggggtttgttttttgttgttgttaagacagagtctcactcggttgcccaggctggagtgcagtggtgcaatctcggcttactgcaacctccaccctgggtttaagtgattcttctgtctcagctatcctgagtagctgggacaacaggcgtgtgccaccatgcccggctaattttttgtatttttagtagagaagagatttcaccatgttggccgagctggtcttgaactcctgaccttgtgatttgcccgcctcggcctcccgaagtgctgggattacaggtgggagccactgtgccccacctttttaaaatttttttgtagagatgaggtctcagtatgttgcccaggttggtctcgaactcaagcaatcctctggctcatcctcccaaagcactaggattacaggtgtgagccgccatg

SEQ ID NO: 20624 - DNA, 1074 bp, Homo sapiens
caaaaccccgtctctactaaaaaaaataaaaaatcagccgggtgtggtggtgcacgcctgtaatcccagctactctggaggctgaggcaggaaagtctcttagaacctgggaggcagatgttacagtaagctgagattgcgccactgcactccagcctgggcaacagagggagactctgtctcaaaaaaacaaaactctctcagattgtatggctgtaaataaatggtgggttagatatcccagctaactcatcaaaacctcccttaactgtgaaaacacttaaagggcccagtataactttatctattcccagctgccacctacaacatagagccttatgtttttgctgaaatgtctgtggagttccaggttgggaggttaggaaacatctctccctatgtgagaagcagagtcggggtggctggaggagaagagcaaagccctccctgacggtcccctttaggcaacagcctggctacagctgcagcagtcacctctgtgtctcctgagggcatgctgcctctgattctgggggctgaagggggagttttgtgggtggtctgtgtttcttacctctgagcagggaagtgaactgaatattaaatctcagaaaactatgtttttttgtaattaatttaatggcaaaatgtcacctgaaatggtgtctagtcttcatttatctcagcatgaatatactcgtttcactgcaaaagatactatgtgtttgattatgaggtttgcctagatcctgctgggtgggatatttggtattatatgatagatgtattagctttctgagtccaaaatactctggctccaaaacccatgtggccccaggggtttcacatcaagagattgtgaacctatagcacccttgtgaacagtgtaagttagaaaggatgcagctgacctaaacccgccgctgaccaccttctaatgtgcctgtcatgcagatgctgaagtgcattgagctggatgagcggctgaaagccatggaccaggagatcacagtgaaccctcagtttgtacaaaaggtgatgagggttcccttattacaagaagtaggctgggtg

SEQ ID NO: 20625 - DNA, 1042 bp, Homo sapiens
aaccagtgtaacttgtgagccagaaaaaccagcttgacctacaggtttaaaagaccaggatctaagagacttaaataacaagcagcctaattctctccataaaattttctttttggcccaagtgccaacagaaccattctaagtaaatttctgtcttttgccatcaagaggtagccattaaaaaacagctgccattaaaaacacaaactctgtttgtgactagtaattgaagtttagataaaagaacccaaatgctaacaaacataaaagatagtacatgttacaaaagatgttaaattgcaaaatagcaaatgaaaattaaataacggtttcaaaaattagctgggcgtggtggcacatacctgtaatcccagctacttggaaggctgaggcaggagaatcatttgaacccaggagatagaggttgcagtgagccgagattgcaccactgcactccagtctgggggacaaagtgagactccgtctcaaaaaaaatttttttttgatcaaacaggaagagtctcaactcgaaatggtctttccagggctggggtagtgactcacaaagtcatcaaggtcctgggtccttcgtatgttgacacgaagtggtggattgtggtacactgagctcacaagcactgcctgccagagggacctggggagggctaccataaggtatggtgggcaggaaccgtgtctttaaaggacatagctagtcagaaggttacatctgtgatagtggctgctccatttttggcatgatgtcccagtgctaaaatgaaaagaacggggaaacatcaaaggatttttctagccaagtttttcttactagaaaatccaaagaagtctcaacaggtagactgtatcagtaggtgatggcatggctgggatggaaggcagctggggatgggttaaatctgccacctctcccattgaaatattactttgtgttaacattttagtagatgtttttctttttctttttctttttctttttttttttttttgagacggagtcttgctctgtctcccaggctggagt

SEQ ID NO: 20626 - DNA, 1084 bp, Homo sapiens
tcagcctcccaaagtgctgggattacaggcgtgagccactgtgcccggcctgtaactttttttaaaatcccgaatcatttttttaaaattgtggagcctgccaggtgcagtggttcacgcctgtaatcccaacactttgggaggctgaggcgggcggatcacctgaggtccggagttccagaccagcctgaccaacatggagaaatcccatctctactaaaaaaaaattgtggaacctgagacttaacatagctaacttcttacaccttaaaatgttattcatttatcttttttttttttattttttgagatggagtcttgctctgttgcccaggctggagtgcagtggcatgatctaggctcactgcaagctccgcctcccaggttcaagcaattctccttcctcagcctcctgagtagctgggattgtggacgtgcaccactacacccggctaatttttgtatttttagtagagatggggtttcaccattttggtcaggctggtcttgaactcctgacttcaagcgatccgcccacctcagcctcccaaagtgctgggattacaggtgtgaaccaccgtgcctggcctcatttatttatcttattttgcgatgttcaaagtccagaaggcaaaagggcaggtatataatgaagtctccttcccattctgtttgctagccatctatttcttctctacaaaggaaactatgttagttatttctcgtgtatccttccaaaaactttttatggacataaaagcaaatacgaatatatattttctcattttttacacaaattgtaataatctatgcatactcttatgtagcttgctttttgtatttaacatatcttggagatgattctgtagcagtactctacaggtacggagtattctataatatgagtatgcgatggttttagaagtctgcatgggatatttacattgtttccttcaagaataacatggtatgtggattatttcaaacacatgttctagtttcatatgaagatgtgctttttaatgttttaaaaaaattgtgattgaggtacaacatatagacagtaaaatactaaagtgtatag

SEQ ID NO: 20627 - DNA, 1027 bp, Homo sapiens
tgtagtcccagctactcgggaggctgaggcaggagaatggcttgaacctgggaggcggaggttgcagtgagctgagacaacgccactgcactccagtctgggtgacagagtgtgagactctgtctcaaaaaaaaaaaaaagaaaagctaatcataatttctactacatcttttggtttatctgcttccatctatactgtattatttgacttaacaatgtcaccatacatctgtatttacactttgtaattatcaagacatgtcagaaacaatttcatctggggttcacaataggtcagtgaggcattgcgactgccagtttataaataaaaatatgaagctcagggccccacaactcaaaattggaagaatatgtagattcaaaaccagggtcctcagccagaagctcagggttctttccataccttatctaacatatacaacggtaaacaccttataccttcaaaatgcattcatgtccattactcacctgatatatatgtttatgtgagtttatgtgtgtataaaacatgcatgctctctgttctttcttgagatagggtcttgatgtcactcaggctgaagtgcagtggtgcaagcatagctcactgtagcctcgacctcccaggctcaagcagtcctcccactttagcctcctgggtagctgggaccacaggcatgtgccaccacactcagctaactttttttcttttggggggacaaggtcttgttctgtcacccagtcaggagtgcagtggcatgagcacagctcactgcagcttcaatctcatggactcaagtgatcttccaacctcagcctcctgagtagccaggaccacaggtgtacaccaccacgcccgcctaatttttgtgtttttttgtaaagacagggtttcatcacgtttcccaggctggtcttgaactcctgagctcaagcaatctgcccatctcagcctcccaaagtcctgggattacaggcataagccaccatacctggccactttttttttctgtagagatggggtctt

SEQ ID NO: 20628 - DNA, 1035 bp, Homo sapiens
ccatcttaaaaaaaaaaaaaagatgtagtccagacaaaaaatgatgaggatctgaattagggcagagaggggagagagaaagaaatggagctgagagactttggaagtaaaactaaatcatttggatgcagagagctgttaatagtaacgtgcatttctggcttgggagactagaaaacagaatagagaaaaaggtgaaacattcagggtcagagagaagtgggaggtccagtgtaatctctaattcgttttgagaccacggacaggttgtttcactcctctggtccttctggatcctcatccgaagtgaaggagattaagaatcaattttgggaacttcaggctctgaagtacaaagttgtggttagagttccatcagtttggttagtgctgtagctgaaatgcaatagtgttgttcctgttttccagggcaaatgacacagctttgtgaactgatcaacaagagtggggaactccttgcgaagaacttatcccatctggacactgtgctcggggctctggatgtacaagaacactccttgggcgtccttgctgttttgtaaggagcatcttcttttatagttctgtgcttgttaaaatggaacactgtgcacttcctggctttatttttatttatttatttatattttttgagatggagtttcgctctgtcacccaggctggagtgcagtggcacattcttggcacactgcaagctccgcctcccgggttcactccattctcttgcctcagcctcttgagtagctgggactacaggcactcgccacccgccccagctaatttttgtatttttagtagagacagggtttcaccatgttagccaggatgatctcgatctcctgacctcttggtccgcccaccttggcctcccaaaatgctgggattacaggcgtgagccaccacgcccagccctggctttatttttatttatttatttattttttggtgtagaaagtaaaccattgtaaataacattgagctcttttgcaaaactaaagttatggcagttacagt

SEQ ID NO: 20629 - DNA, 1017 bp, Homo sapiens
ggccccttccaccgggcgctttgcttgacagtttgggggcgtgacttccgccaggagccatctcgggcgactattggttccttctgtctctcttgccttcggtgattggcgcaccgccatgtcatctttgccgccgatccgcagcttgctgactaggccgccgggagcgggcgggaggcgagtccgttctgggtgtcttggctctatggctcgcctctgccagctcctccgctgccaggcggcgcacgctcgggaacctgtgcgcctattttggtcctacagaatgctgcggaagctctcgctcgtaggactccatttcttcttctttgtttttttttagccgaggctggagtgcagtggcgcgatctcggctcactgcaacctcagcctcccggcttcaagcgattctcctgtctcagcctcccgagtagctgagattacaggcgcccgccagctcacacggctttttttttttttgagacggagtctcactgtctcccaggctggagtgcagtggcgcggtctcggctcacctcaaccttcgccttcgaggttcaagcgattctcctgtctcagcctcccgagtagctgggattacaggcgcctgcccggctaatttttgtatttttagtagagacagggtttcaccatgttggcctggctggtctcgaaccttgatctcaggtgatccactggcctcggcctcccaaagtgctgggattacaggcatgagccaccgcggccagcccacgcggctaattttttcgtatttttaatagagatggggtttttaccatgttggccaagctggtttcgaactcctcacctgaagtgatccgcccacctcggcctcccaaagtgctaggattacaggcgtgagccactgcgcccggccaggactccatttctaggggtagaattgtgatgattttactcgcactttccaggttgtttggttcattcattgcgtatgaatgtaccgaattctggacctgaaattcgaatgattagatgctg

SEQ ID NO: 20630 - DNA, 1047 bp, Homo sapiens
ctgcggatgcggttattggaagggctgaggggtcagaggccaggtttggccccaccaatggctggcaccaataacaacacccatgtagaccaggtgtctgcccagaagccccatgtacctgaggtcaggaagcctccctgggaggtggaggtgctgttaaggagcagctggtgggaacccccaacgtgcttctctccgagggcctcaggggctcttagtctgccggctcctcaggctggggcttcctgcacccctagcgcccaccctccaactctcccctgctgctgagacagatcttggagcctcggccaggctgtcctagtcacaaggtaagtgtccaaggcaggcgtcagagtcaccagcagccacttgaggcctccttccctttgaattgagaggcatggaaaagggagcgtctgcgaggaaaggatggctgcatgcaggttccttgtcaggtgggtggggacgtgggacatgcctgacatcagagaagccacatggggcagggggatggggaaatggcctcctctgggcaagggtctggtgggacctgggggcatttctctctctttttttttcttgagacagactcttgctctgtcacccaggctggagtgcagtggtgcgatctccactcactgcaagctctgcctcccaggttcaagaaattctcccacctcagcctcccaagtagctgggactaccagtgtgtgccaccatgcccggctaatttttgcaattttagtagagacaaggtttcaccatgttggccaggctggtctcaaactcctgacctcaagtgatctgcctgtctcagcctctcaaagtgctgggattacaggtgagccaccgtgcccggccaggggcaattgtctgctcgaaggcacatgttccccaacagcctttgagcgtgggatcaagggagtgcagctgtcttgaggggcgggacagcccgtggcgagggacagtgccctccccatcaggagctcagtgctaaccgtgcctccactgtgactgtcacggtggtcagcctcatagtcatcatca

SEQ ID NO: 20631 - DNA, 1064 bp, Homo sapiens
cggggtttcaccatgttggccaagctggtctcaaacctgacctcaagtgatctgcctgccttggcctcccaaagtgctgtgattacaggtgtgagccaccacacctggccaagggggcacattttttgattgcacagaagctccatatgggctagcagcagctctggggggctattgccctccccagctgtacttgacactctctccaaggtagggactagggcgtatttatcttggtatcaagattatccagtacagcaagtctcagtgaaaggttgataaacagaatttagtacacttggtctttcaaaatgaaactatttgactaaggaacttaatgaaagacaaacattgtatcatgatacagtcatttaatgtctctgagccttagtttcctcaattatgactaatatatatctcttagaattgtttaatgttcaaattggataatgcatgtaaagcacttgactcattaattttcttttcctccatcaaaagtatttctgaaatgagtggattctgaatttggactgtaaccaggtatattctggaaagagtatatatttaaaaaaaaatagaacaaagatttttctttattttaacagtgtgacccctcatgctaccaaaagaaattaaaaatgaatacaacttgttgtactttctggaaagaacaaaatcttcaaaatcagacttcactttgagtcccagctccagtaacctctttgagcctgagcttcctcatctgtaaaatgaggatagaagtcctatttttaaaagtatgtgtcggggcattaaatgagacgtttgctagggctaccataacaaaataccacagactggaaggcttaaccgaacttattttctcatagttctggaggctgaaaatccaagatcaagctgcaggtttggcttcttcagaagcctctttccgtggcttgccaacagctactgtcttgctgtgtcctcacatggtcattcctctgtgcatgcatgattggattagggccccattttaacttaatcacttctttaaagaccctgtctccaaattcaatcagtcatat

SEQ ID NO: 20632 - DNA, 1050 bp, Homo sapiens
ttctcgggccaggagcaaggggctgttcccaggcacccatgcaaccgtatctcccctgctgcccccacaggtctacatgtgggtggggacccagactagccaggtggagatcaagctgagcctgaaggcctgccaggtaatctgggtggagggagggccgaggtgggcctgtgggcagggcagggtcatcacccaaggctcgctgtccccttgccaggtatatatccagcacatgcggtccaaggaacatgagcggccgcgccggctgcgcctggtccgcaagggcaatgagcagcacgcctttacccgctgcttccacgcctggagcgccttctgcaaggccctggcctaagacaggctggcacagccccaggcttggtgaggaagaggaaggggcctcatccactgtctgctagcaaagaatgtactcaggtgacaccacctgctccagccacgtccagtgccacagtccccagtagcctcaagcagcaccaatggggatgaccctgacaggtgccctcaggggtctgggaaatccaactctctccacagtgtgagtgcacgtgtgaagccccctcactcttccgctagggataaagcagatgtggatgccctttaagagatattaaatgcttttattttcaatattaaaaatcagtatttttaatattaaaatggcgctaattttaacaaaacgacagaaaaaaaccccaaggtacaatctacagggaaactcatcttgacccccccccctgccccccccccccgccggacacacacacctgactaggccccagatgtgggtgcccagcagagctcccagtcacatccatgcccgcacacacacactcatgacaggctggggactggcccagaagcaggtaccaaaatagtttagttttagaaacaactgtccagcccaggcgctagaaaaatactctttgcagggctgggcatggtggctcacgcctgtaatcccagcactttgggaggctgaggtgggtggatcacgaggtcaggagatcgagaccatcctggctaacatggtga

SEQ ID NO: 20633 - DNA, 1025 bp, Homo sapiens
ctgcctcagcctcccgagtagctgggactacaggcgcgtgccaccatgcccagctaatttttgtatttttggtagagatggggtttcaccatgttggtcaggatggtctcaatctcttgattttgtgatccgcccgcctcagcctcccaaagtgctgggattacaggtttgagccaccacacctggcctataaaagagttttgcactctccttgaaagggctcaggcaccctggaaccacacttggagaactgctgatacagagacatgggacttctcagaggtgtttttattttagtgaattactgggatcttagatttcatctgcactgtttcccactgtccactcctgtgatgactggtgggggcttgtggtgggctgatagagggcctcacaggggacttgtgtgggcttcctgatgcataaggaatggtggagagaggcctagggctaaagcagccctcactggactaaggagaagctggcatctggttgttaatgttttttctcatcttctggcctcactaggttaaagttaaagtttaagcgcggtagccttcccccgaccatgcctctggagtttgtttgctgcatcggcggatgcgacgacaccctgagggagatcctggacctgagattttcagggggcccccccagggctagccagccctctggccgcctgcaggctaaccagtccctgaacaggatggacaacagccagcacccccagcctgctgacagcagacagactgggtcctcaaaggctctggcccagaccctcccaccacccacggctgctggtgaaagcaattctgtgacctgcaactgtggccaggaggctgtgctgctcactgtccgtaaggagggccccaaccggggccggcagttctttaagtgcaacggaggtagctgcaacttcttcctgtgggcagacagccccaatccgggagcaggagggcctcctgccttggcatatagacccctgggcgcctccctgggatgcccaccaggcccagggatccacc

SEQ ID NO: 20634 - DNA, 1033 bp, Homo sapiens
gtctgaacccacactgctcactcaggctgctcacgctggcctcatgtatgtgccaggaccctgctgataagtcccatggctcaagctttgcaggtagggccttgtaactaatctgctgtcccctccattcgtttttgtcaaggctctcaagggctttctctggcaaacctagtccaggaatacctgcagcacagtggaggggaagcagagctccctgggcatgtgttacataagcagctgcgtcatccacaaagggagtttcttaggcctatgacttgggaagcagtgcttcaacgtgaagtccttgaccatcactaggacatccagaaaccctgcaggtttaggtaaaattagtagaggttcacccgtcatgatttatttgataaaaatgtatgaaggctgggtgtggtggctcacacctgtaatcccagcattttgggaggccaagatgggtgaatcacttgagcccaggaattcaagaccagcttgggcaacacggtaaaaccccatcttgctgggcgcagtggctcacgcctgtaatcccaacacttcaggaggctgagctgggtggatcacctgaggtagggagtttaagaccaccaacctgaccaacatggtgaaactctgtctctactaaaaatacaaaaattagccaggcatggcggtgggcacctgtagctgagattgtgccattgtactccagcctgggcaacaacagcaaaactctgtcttaaaacaaacaaacaaacaacaacaacaacaacaaaacagatctggctgggcacggtgactcatgcctgtaatcttagtactttgggaggccaaggcgggtggatcacctaaggtcaggagttcgagaccagcctggccaacatggcaaaaccccatcactactaaaaaaatacaaaaattagctaggcgtggtggcacatgcctgtaatcccagctacttgggaggctgaggcaggagaattgcatgaacccgggaggtggaggatgcagtgagccaggatcgcagcactgcactccagcc

SEQ ID NO: 20635 - DNA, 1031 bp, Homo sapiens
aaggttaaggagggggactgtgagcattaatagcactaataaagatgtgatttattttagtcttgctgtcatcctccctggcccattacaatccacttaaagttccctttgttatccagaaactcctccctatttgatattcgtttgactttcaccacaataaacctttttctatctgtcatatcatgacatgtctctgagacacagcctttctgtttgtctctccttaatatagtaactcatgaccacaaagatggtatcgtagaattcaactggaaaaggcatcgactctttaaccacacggcttgcctagttctctatcagttgtgtgtggaggtaagaacccctaatgatctaggaaacattctgcacacctcccaaaccactcccactgtcggcagaggtgatctgtctcattctcccattggactttagctttaagtttgcatctcaggggatcactttttgggaaccaataagacgaaccccatgagaacagcactaaaaggaaaagggaagtatctacattatttttagataaaatcagaaattttgggaaacgtatagttgaaatcccctcttggggcatatactatcaccagaaattagcaaggattatctagaccagtccaggtcattgacttatagagctaggagagaatgaacagcatttggctcagccccctctttattggtcacatgaggacatctagagaagtgaaagtcacaaattagtgggctaattttatatagtgataaaagctaggaagaaaataaagcaaggtaaagggatagagaaaggccggagggacagtgaggggaggggtaacacttgagcagaggctggagagattagggaaagggctggcggggtgggtgggacacgcatgtgtcatagaagggagcaagactggcccgggtcataggccagttggtggcagagttgggacccaccctaatgtttcctggcccttgggctgattgtttactttctgatgccacttcctattagcacataacagcctggttta

SEQ ID NO: 20636 - DNA, 1048 bp, Homo sapiens
gttgtaatttggatcagagcaaaattttaaactaaaatttccaaatatcaagcatctgttttcttctcataaggtttacaacatcattaagaaggagagtaaccggcagagggttggattggagctgattgcctcggagaatttcgccagccgagcagttttggaggccctaggctcttgcttaaataacaaatactctgaggggtacccgggccagaggtatgtgaatatcttcaaaggcctggttctgacacagtcatagggagtactcagtcagcctaggacctaaacaatttggaaatttcagaaaacaataagcttcccagctgtaggatttctgttccacgcctgctctctgacagaactcttttattcccagcatgtgataacactgaagagctcagcgcaggtgtactcaggggcacatttcacagttctttgggggctttctagaaaaacaggccagtttgtaaggagtattgagccactggactggtgtgtggcctctgtctagaaaaggtcagtgtcatctgagggatgctgcagaaggtggccgttgccatgtgagtcatcgagtctgtattgggaatggtgtggaagtggaggctgaatctggattactgaaaaccgtttctgcattataaatgttggatttacacatgcagtggctttcagttgactctttcaccctcagaattacagtgttatattcgtttttgttttttacagtcatcatcaggcaaagaaaataaattacagaattagacatggcttttgcaaatgtgtgcatttttgtcccaaaggaaacagaaaggtcacccttggagaaggaattgccattctgtcctgagatgcccctgaagctctatgtagaagactgagaatcaagttgaaggcattgtctttctcctattgtgaataactaacttttgcattgtgccttaaagaattcaccaggtgttttctttatttctctctctcctttctttttctttttccttcctttctttcttctttcaggctaaggtattttgttaacaccaggtgt

SEQ ID NO: 20637 - DNA, 1059 bp, Homo sapiens
gccatcacgcccaactcattgttgattcccgcccccccgcccccccccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaatttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcgaggaggccattaagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttctgggctgttcgctcctgcttggcagtgtagcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccgccccggctggagtgcagtggcgcgatctcggctcctagcaacatctgcctcccgggctcaagcgagt

SEQ ID NO: 20638 - DNA, 1049 bp, Homo sapiens
acggtgccatcacgcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaacttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcaaggaggccgttaagactatactttcagggatcatttctatagtgtgttactagagaagtttctctgaacgtgtagagcaccgaaaaccacgaggaagagaggtagcgttttctcctgaacgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttctgggctgttcgctcctgcttggcatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggattgcagtggcgcgatctcggctcctagcaacatctgcctcccgggctcaagcgag

SEQ ID NO: 20639 - DNA, 1022 bp, Homo sapiens
gcagaccctcagcctgcccactcccctctctgcccccctacccacagtccaaggatgggggctggaaacctctcagaggtgggaggccgctggctggggtccagctttctggcagccccttggcaggagaggaaggtgagccccctggctcaacaccctgacctctgaggttgtccaggcccttctggaagcagagccccttcagcattactttgggaggccctgaccctgggcctccccaccttcacaagaacccctcgcacctcacgaggcagccccaggccctctctgccctgccactgagctttcggcagacatggtgccccagcctagatactgccctcagcgggatccaagagaaaccacaggctcctggcaaacccccacctcccagcctcgcccatgttgccctggactgtcgtcatggcacttgccctgagaccatctgggccgaccctcttctgccttttatctcacgagcactcccgtgccctccccccaactcactgtgcgttctgaaactcatcgtctgttgtcagcaaaattcctgtgattccatcttctcggaataggaagttccctctgccttctggccttactgaagcccactcagtaccctgcagccctcttaagtggaatctttttcctcccactccccatgtgcggtgagcctagagcaggggtgtgtccttgcctcttcctcaacctcctcacttggaacagtctgtcttcacctctacccctcacagccaggcaggcatatctcttgttactggtgaaggcactgcctccaaagtctggattgaggcatccctccctcaggccaggccctccctcatgtggcgcttccctgtgctcttcaaaccaccaggccctccaagctcctggcccagccccttttcgccaaccatcagcccctctttccttgctttcctcccagcccagtttagaactcttggtcatctgcatgcacttcccatagtgccctccatccttcgtttatgctcacctggcaaggtctc

SEQ ID NO: 20640 - DNA, 2002 bp, Homo sapiens
gtgttcgtatatgtaggaggactttagttttattattaaatgtaactgttttaagcctcatgggcttagtgactaaagagtcctgtgaaacttctgtgtactgcagacttggtatagatagcagactggagattgatgggataccaggatgttattacttatcacatacaagcccaataatctggttttttaggcagaggtggtggactggttggagtgtatgtggtcctgctacattttgagtagccacaggaggatggcagttctaagagtatttgcagttatgagcaagctagttatgtagcaagctagctgatgtgcttacctaaattttaccactttgcagcactaagctagaagtcatatctaaactattaccaagcagaaagaagaaaacatattcagaactgttaactttggggcaaagatagaatagagatgacaatatagtgatttttttcattagttcttcatttttgttattttatttctagataaatgtagtattgagagaagactgtcggcgctctgccatagcaccgcaaccgtgtgagcagcaggctcatcccgtggaccggtggtgggaacgtgaggtgatgcctttgggattacagcttgagttctgtcaccccatccccaggaaactgtagcttcttaactggtgactaccaaagaacaagcagtgatttgaaaaaggaaaaacaatccaaaaactacatatttgtaggaaatctgccttattggagaaaatcaccctttccctttttctttgtagaagcaggagcaagagtgtttggctcccagtttggacttggtgaataaatgtaccttagaactaggataatcggtacagttattcttaaagataattaaaaatgaaacaaagtgagtgctcgtcactgggttcatcagagcagtgtgtgaaattccatgtgtttgctgaggtgtaaaggtaaatgtattcacccctcatccaggcagtttgatatttggagtaagtttgtttaaatctgagcatgcatctttaaacagctcaggaagaaatagcttaagaagaagtgaaacatggatcttggaagaaattttgaaatcttcaatttgatcctaatatggatacatgttaatcttccaaaatctttcatattgcactaatttattaaaacaactgtgtattggattttgtaatttaactaaggcacaatggacttgtttaaaatattttacttgattgtatacatagaccctttccagaattcacatgtaatctccagtgaacttttaagtggttaaaacttgtattcatgtgaacctttgcacattttttttttttacttctttatctacacctacagattttctcagtaatgtttttgttagcttttggttccattttttattgtgcatgcagaatgtacattgatgcctgtgaccttaggtttattaaaggctaggtttatttgggcagtattagaaacaaaatcatggatcaagagatactcttgataatttgaatagggccaaaacaaagttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattacttggtttcttttacttacctgcttgaatacttgaataaaccattcaccaattttaatccttttattttaatccttttacataaaataatctgaactctttgacaaattgcacagagctctttggcattaatctaattttaatgtactgataaaaacaaacatggttttcctttactttgacaaagtaatgtaatttttaccttatttatctgtatgaaattccagtagttaatttgaacatttatttatatgacgtttgtat

SEQ ID NO: 20641 - DNA, 1046 bp, Homo sapiens
cagatttaatgacaaaggccttgagtcaacatacttgtaagtaattgtgcatggatgattaaaggccaggttccaaggcctaagtaaactaacttatctagatcagtttttttacatccccttgttatctaacctaagctttcaggaaccagataagagaatctggttgccttcagccaaatcctaacttttgtaaaacctcccggccttccaagaaggtttgcatctttctacaatttttcccaccacccgacctatctcctacatgctcctgactactgggtcacacaaacctgccagtactgaatagttcatgcatcgtattaactagtttacatatatatatatatatatgtctctttagaccacagctcctttcaaaatccctaaaactcaagcatcttccaacctgttagccttggttactcgtcatgggcctgctgaagaacagtcgaaagatgggaatgagccacgggaatgtgcccattgcctcttagtgcaaggaagtgagaggcagcgggccgagcagcagagcaaggcagtgtttggcaggtaaaagactgtttccattctagcattaaacatgaaaactgtaatagtaaaacatagatttctgttataaaagcagcaagactacattagtgtagcgggtgatttatgccatatggttattgatatgtaccacgtacatttagaatctctgaaaaccacagatgcttcctgtaactatgtaagtacatagttcttcctgaactttttgaatattctatttctgtcctttatttgtattattgaagtttatctctaccctgaattgtttggtatctatttcttgtttcctcattctctaacttcctattaacccttctagttttaaaaagtatacttttcctttattaaaaacatcactattctttttagatctgtcagtaccgggaagttatcagatcaacaaggaaagactcctatatgtcgacatcagggcagcacagacagtttaaatacagaacgaccaatggatataggtaagaaaaatgtagtttctt

SEQ ID NO: 20642 - DNA, 1029 bp, Homo sapiens
gtgcttactggcagcaaattaataactctgattctttttttgtttgtttgtctgagatggagtctcgctctgtcacccaggctggagtgctgtggcacgatctcggctcactacaacctctgcctcccaggttcaagagattctcctgcctcagcctcccaagtagctgggatgcgcaagtagctggcatgtgccaccacacccagctaattttttttgtattttttttttcagtagagacagggtttcaccgtgttggccaggctggtctcgagctcctgactttaggtgatctgcccacctcagcctcccaaagtgctgggattataggtgtgggccaccacgcctggccataaccctgattctttacagttcctaggcttttgacgtagggatctcagagaccatctagtttagcccttggcagtttttttttagtagtacctcaaaattatttgaaacaataaaagcataattgttcacattctacatctggtattgatatttaatgaaaactgtattaatgagctacttattataattagcattttcacttgcaaagtttcgtacaccttggttacaaatctggcagagcagtgacttgtacagttgacgattactactatttttagcttgctgaaatcaaggtagctactttttttttggtggacagtctaattcaataagctgtttatttttcacagtcctttgtgccttcttgtgtctcgaagaatcatatgatatatgttaggtatgagcgaagacgtaatttgcttttctactttctgttttgtgaaatagcggattttggttttgctcgttacctacatagtaacatgatggctgcaacactgtgtggatccccgatgtacatggtgagtgagtgtttgcatccttgtgtgtttaaagcatggctccataatcattggaatttaaatataatgcgtgcttccaaataagatgtgattttacatatagtccaagttgttattactaatgttaattatattactgataatgctataatac

SEQ ID NO: 20643 - DNA, 1073 bp, Homo sapiens
ttttttttttgagatggagtttcgctctgtcacccaggctggagtgcagtggcgcgatctcggctcactgcaagctctgcctcccgggttcacgccattctcctgcctcagcctcccgcgtagctgggactacaggcgcccgccaccatgcctggctaattttttgtatttttagtagagacggggtttcacagtgttagccaggatggtctcgatctcctgaccttgtgatccacccgcctcggcctcccaaagtgctgggattacaggcgtgagccaccacgcctggcctagcctcttttttttttttttttgagatggaatcttgttcttttgccaagtctggagtacagtggcgcactctcagctcactgcaacctctgcttcctgggttcaagcaattctactgcctcagcctcctgagtagctggggttataggcacctgccaccaagcccagctaattttttgtatttttagtagagaaggggtttcaccatcttggccaggctggtcttgaactcctgacctcgtgatccactcgcctctgcctcccaaagtgctgggattacagtcttaagccaccatgcccccgccgtgtctttaatatatggaagttcctacatggtagaatttatccaacctgttatttaatgacccctaggtttcatattatagaagatttctttaccctgagcttatgaaaatgattccccatgttttcatctagtacttagggtttcattttttcatatttatatttttgatctctggaacttagttatgtacaaagggataatgtagggactcaacttattttccagaaagcccaaccagctatcccagactcttacctgtttttgaggatatctacagaagaagtcttctgtaagactgttaaaaagagttaggacttagggaatttgaagaattacagcaaatcagggtcagattaggtgagaatcaatttataaatttattaatcagtattatatattctgaatatttttgcaacctttggtataattagtattaatgagatacacattgaaggagagtttttccacaaaccta

SEQ ID NO: 20644 - DNA, 1083 bp, Homo sapiens
ccctcatttaacacccgatttcctcaaaactgcttcctgtggagagctcttttttaagaattgtagctctttgagctaaaaatcatattttctttcagtgagataatgtgctttttgtttgatcaggcacatttcttattctttaattgaatttttatagtcttaatataagtataatactagaagtgtatgtgtatactttaattttatttacatattaaaatatagtaaagtcattagaatacttacatatttttcattctcaattttcttaataggaacttcagcatgaaaatattgtagcactctatgatgttcaggtaccttattttgaaaatttttaaaaattaaaataaattttttttaatttcatacagatttaagtgactcttaatagaaataaaaatgaccttaattcttgttgaaaagatgcatagcttgagttacatgtttctgaattaagaaattgtttaaaacagaacagagtaataggctgaaagaatttgctgcatgagtaagtttattaacaattgataatacactataggtgtagcattgttttaggtgaagtagaggactgttgataccagatctagcattctctgatgaatgttgaaaggacaattaaaaatagagctttttttttttttgatggagtctcactctgtctcttgggctgcagtgcagtggcttgatctcggctcactgcaactgctacctcccgggtttaagcgattctcctgcctcagcctcccgagtagctaggactataggtgtgcaccaccatgcccagctaattttgtgtgtgtgtgtttttcatagagatggagtttcaccatgttggccaggcttgtctcgaactcctgacctcaagtcatcctcccaccttggcctcccaaagtactgggattacaggcgtgagccactgcgccccgcctaaatagaagttctttttttaaaaaaacattttttttattttgtagagatagggtccctctgtgttgctcaggctagtcttgaactcctgggctcaagggatccttctgcctcagcctctcaaagtgctgggattacagatgtgag

SEQ ID NO: 20645 - DNA, 1089 bp, Homo sapiens
gagttaagaccagcctggccaacatggtaaagccttgcctctattaaaaatacaacaattagggccgggcgtggtggctcacgcctataatcccagcacgttgggaggccaaggcaggcagatcacgaggtcaggagttcgagaccatcctggctaacacagtgaaaccccatctctactaaaaatacaaaaaattagccaggcatggtggcacgcgcttgtagtcccagctatcgggaggctgaggcaggtgaatcccttgaacccgggaggcggaggttgcaatgagctgagattgcaccgctgaactccagcctggtcaacagagggagactctgtctcaaaaaaaaaaaaaaaaaacaattagccaggcgtggtggcgggtacgagtacctgtaatcccagctactagggaggctgagggaggagaatcacttaaacccaggaggtggagtttgcagcgggctgataatgcaccactacattccagcctgggcaacagagtgagactctgtcttaaaaaaaaaaaaaagaaagaaagaaattgaggaatgtggagattgtggtctgtgatttgttaggaatcacacagcaggttagtagcaactacagggctttggttcagaataccaccttgacaatggtttgtttacagttcggctccccttcctctgcctttctctccttccttattgagggcagctggaaagaattttcatcatttactagcctatagctttaatttgagttttgaaaccttgataatagagcacagaggaaaagactgagttttctttttttgagacagtcttgctctatggcccaggctggagtgcagtgacaccatctcagctggttgcaacctctgcctcccaggttcaagcaattctgcctcagcctctcgagtagctgagattacaggcacgtgtcaccacgcccagctaattttctgtttttgtttcgttttgtttttttctgagatggagtcttgctctgtcacccaggctggagtgcagtggtgcgatgttggctcactcaaacctctgtctcctgggttcaagcaattcttctgcctcagcctccccagta

SEQ ID NO: 20646 - DNA, 1031 bp, Homo sapiens
gctttttaactttgttttatagtactatagttttagtataaacagatgtatgtatacacacaactatggctttataatatgtttcagtcattgttagagcaaggcctaccttttgggtgcttcttttacaaaattgtcttggctattcttgtgccttttttcttatttgtgaattttagaattgtgaattacctgttgactcaccatgttttgtaaactgaggattttgaatggaattgcactcaattaaagattatcttgctttctgtgcagcaatgttttatttcaaataatccctactttaaattacttaggatagctataaattgtgtttctggctttctagatttagatgaaacgctttaaattgattgttttctcctaaatttaaaactgattgttagaagttaaagtcttctgttcattcttatttaggaagatgacatttggaagagtcagtgacttggggcaattcatccgagaatctgagcctgaacctgatgtaaggaaatcaaaaggtttgtggtgtttttatacttcatattaagcctttactcacattagtgattgactgtaagtcaaagaccacttaaggtttaaactgtttattttgtaaagtaaccactgtatctttcaccttgtgtttatagtcagaagtaagtacaagggcttcctgtagtcacatctttatgcaatctcctctgaatcaaaagttagtgaacttgctttgccactccagaaggcacatgaatatgaaaaagcattgtctattttcttatttaatggcaaaatacccgacctaagttggacttaatgtttgagaccgtttattttattaaattatattttttctcttttcttttttttttttgagacagttcttgctctgtcacccagaccggagtgcagtggtctgaccgcacctcactgcaacctctgcttcctaggttcaagcgattttcctgcctcatcctcctgagtagctgggactacaagtgcgcaccaccacacctggctaatttttgtatttt

SEQ ID NO: 20647 - DNA, 1021 bp, Homo sapiens
gttgagtgaaagttacttctatttcaaacactgaagaaaattttgtacaaatctgtcacattccaagcccaggactgattgtttcatatacttctaattttacaatttctattgtagtccagtgtgaaaaaagccagtattaaaatactgaaaaattttgatgaagcgataattgtggatgcggcaagtctggatccagaatctttatatcaacggacatatgccgggtaagcttagctcatgcctagaatttttacaagtgtaaataactttgcatcttttaaattttttaattaaattttacatttttttctaatctattattatatgcccagaactttcacttagagtgtgcagtataatgtggtggttaagtataaaggctctggagtgacttcctgggttttaatcttggctctgccatttattggcagccgctaacctcttggtatctcagtttcttcatctgtaaaatgagaataataaagtgaaaagatgccaacatcatttactctgggctgcataactgatacttggaaaaagtattcctttgagtttaagaattaagttggttattcattttagcttgtaataaaaagatagtgattcataggatatgccacttactgaaatttaccacagatccaatcataaaatcactttctcttccctaaagatagcttgattaacatgtaaaggtgtgtaaaggcttgattacactaccctgatccgtaccccagttcccagcagcaccatgaaaaagggatttcaacatatttaattactttcagtagaaagtaacagtggtaggccaggcgcagtggctcacacctgtaatcccagcactttgggaggccgaggtgggcggatcacgaggtcaggagattgagaccatcctggctaacacgatgaaaccccgtctctactaaaaatacaaaaaattagccgggcatggtggcaggcacctgtagtcccagctacttgggaggctgagacaggagaatggcgtgagcccgggagg

SEQ ID NO: 20648 - DNA, 1273 bp, Homo sapiens
gactcacatctgtaatcccagcactttgggaggccgaggtgggtggatcacctgaggtcaggagtttgagaccagcctgaccaacatggagaaaccccatctctactaaaaatacaaaattagccgggcgtggtggtgcatgcctgtaatcccagctacttaggaggctgaggcaggaaaatctcttgaacccgggaggcagaggttgcagtgagctgagatcgcaccattgcactccagcctgggcaacaagagcaaaactccgtctcaaaaatataattataataaataaataaaagtaaagtattgatgtttgtgaatgatttattcttctaatgaactagaggagatttttccaggaatttcagagccagtgaggttatgttgcttgtatgtgtcatgtgtatccaggtgaaaaaacttaattaaacgctattatataataccatacataaaaactgaattttaggaatactgaagaatgacatatagaagtcaaatcattaaatagctagtagtaaacagaatagagtgtcagctgttacccaatgatgataatattttcacgattaaaattaaaccttttctgattttaaaggaaaagttcagatctgtatcatataaagaatgtaaattttcagggtaataaaattaaaatgcagagagaaaaatgcaaaaatagttcttactagatgtgtgtatgtaaggaacttagactaattttaagaacactgtcaagaccctggtagttaggtaggaaaaaagacatgaatgattcattcaacaaaaactttgagtatttctgtgctagatggtagtgttacagtggtaaacaaaataaatgtgtttctgctatcctggagcttagtctacaaaaaaggtacatattggccgggcacggtggctcacgcctgtaatcctagcactttggaagatcgaggcgggtggatcacctgaggtcaggagttcaagaccagcttggccaacatggcgaaaccccgtctctactaaaaatacaaaaattaactgggtgtggtggcggacacctgtaatcccagctactcgggaggctgaggcaggagaatcacttgaacctgggagacagaggttccagtgagtcgagatcatgccactgcattccagcccgggggacaaaagcgaaaatacgtctcaaaaaaacaaaaacaaacaacaaaggcacgtattaaatacgaacataaatatttacaaattatactgaataagttctcatgtttattatttgcttgtccag

SEQ ID NO: 20649 - DNA, 1123 bp, Homo sapiens
tacatattagtgtgtgtatatatatatatactagaataaaaaaatcaaagtatctcagagtagtaaggacaaacatttcagaaaaatgttttcattatatatacatgtatgtatgtgtatgctgattcaacaaatatatttcttataggttatagcaaaatagtttgaaagcttttactgtgttttatcaggaagaccttaggtgaacgtatattcacagataaaagaggttatttattcattcaataaatattacattctcataagtcctaatattatgtatttttattcttcaaaaaagttagtatttgtgatttatgaaataagacatgttcttgcacttttagcagatctgtcccgatgttgggcttctttaatccttagtgtgggtgctttgcactcactcactgctggggacagcaagacccctgttagtctcagctgtgtttcttaaattggcccactgtaccttccagttagctattctggggtccatgtcatgttggctccattttccttttctttctcccacacagatacctataacggctataacataggcctggtggctgttggtggcttatccctatctgcttgtatttaaggggtactgtttcactgagttttgctgacagatgttgtcatgagatttgaggttttctgtgttgttgctctatttttatgtgggaatttgctactatcatcatccctagaccagcttttcctagtaatacaacagggatgttctgactgattagagtttgcctgtttgaagaattggttggctagtgatttttttttgaggggagtctgtaccagttaatagcctgactggcgtgtggataaaaaggaagcagtttcaagtcaaataaaacacttaaaatgaaaccacactgcaactctctttcttttacttaagcttaatcaaattaatgatgatgtaatcccatgaaggaaaagtcttctgaaggatcaagttgataacattttgtgatcaaagaatttgagaaaacctctatcccagtgtctatcattatatattttaggatgttaattacctgtgtggctttaggcaagtcatttttcctccttgagccccattcttaatcctgtccaaattatt

SEQ ID NO: 20650 - DNA, 1049 bp, Homo sapiens
cggctttcacaactttggtggcatcagagggagaccggggagagggagagggagacgagggagagccccttttttgctttcttttggattatttgaatttttccttaaatttatttatcttacttatttatttatttttttgagtgattctcctgccacagctcccaagtagctgggactgcaggcatgtgccactacacccagctaatttttttgtatttttagtagagacagggtttcaccatattggccaggctggtcttgaactcttgacctcaagtgatccacctgcctcggcctcccaaagtgctgggattacaggcgtgagccaccatgccctgcctttttctagaatttatatattgagttcttgattgtatctttttatgtaggctttttagtggcttctctaggaattacaatatacatacttttcacagtgtactcacatttaatattttgtaacttcaagtggaatgtagaaaacttaaccaccataaaaatagaactagggatgaggttaaaaaagagagagaaaagaaatgtaataaagatttaataacaccgtttttttttttttttctcttttttttttgagacagagtctctctttctgttaccaggctggagtgcagtggcgtgatcttggctcactgcaacctccgcctcctgggttcaagtgtttctcctgcctcagcctactgagtagctgggattacaggtgcgcgccaccatgcccagctaatttttgtatttttagtagagacggtttcactgtgttggccaggatggtctcgatttcttgaccttgtgattcgctctcctcagcctcccaaagtgctgggattacaggcgtgagccaccgcgcccggctaagtctttaaatatttttttgacattgcactttttctcttttccttctaggattttagtaacccaaatgttagttttgttattgtttggcaggttcctgaggctttccttacttctttaaatttttttttcctgttgttcagcttcgaaaatttctattcatctgtcttcaaatt

SEQ ID NO: 20651 - DNA, 1027 bp, Homo sapiens
cccaaagtcctgggattacaggcgtgagccaccatgcctggccataagtaggcttttactgagccttgtgtgtattggctatcctagtgattacagtgaaccagtgcccttcttattaatcacacatttaattgttccctaaaagtgattagttcactttatttatttagtaagacaaaaaatgaagaatactcttaactgagcagtctgttaactgtaggaaagcactgacacttataaggcttagttttctgtcatttatccagaagtatggttgattacagtttttacttttttatttgaatgaacaaccttaatttaaaatatattttgtttattttttgttgggatcgatacattgtccttgtttatagattagagcatgctttttaaagatgctgtattactcactgattttatttgtccagtgtacagagattgaagtgggaaaattataatggaaattgtttccatagtcattacatattaatttcatcaatttatttccataaaatctgtagattgctacttatttagatttttccttcaaatgtttttatgttgtattgcttgcactgagtatttattctatatgctcaatttgctggagaagaagactaattataacttaggcaagttgtaaaattagggaaaaaagtaaggtaccttacagcctagtttacttatttcttatgtaaagccagttagattccacattagttcaaactgccttctttgagcaaaacttgattggcagtgataaaggcttaaagcccttctcaagcagagacctgtaaagactagatctgactgtagtagaaggaaggaacttagatgtttcaggcagtgagaacaccagtcttccactctaaactttgccactaacagtatgaccttgggaagttgtaactttcttcagattcttcatttgttgaatggggggattggcctagctaatttctaaatctctactgggctaaaaaattctgtgcttatactctgattatgaagtacataatctgtgctt

SEQ ID NO: 20652 - DNA, 1045 bp, Homo sapiens
gtacccgccaccacaccctgctaattcttgtgttttcagtagagacagggtttcaccatgttggcaaggctggtctcgaactcctgaccttaagtgagccacccgccttggcctcccaaagtcctgggattacaggtgtgagccactgcgcttggccaggaaatatctaatttagtaagtatttatatctgggaaaggaagggtcaggtggtgattcataggaactctaaagtctatgtataatacttagggggacagaaggaaataaagcaaaatgctgatatttgattgttgagttgtgtatatgttagaagtataacataggagatctgattgatagtaggagaatgtttttaggtggtaaaagtggaaccgtggtggtttgttttggcagtagaatcagttggtcatagtttgtatgtggaaggtaataaacagaccatgttaaggatgacttccggaattttggtctgagtagtgggtggatgacagtgtcattcatgagggaagatgaagactgaggtaggaacaggtttgggagaagatgacatgttcccttttagacaagtggaattatggaagatggcaggtaggtggttagctatatgaatttgagataaaagatttaggatggagatataaatttaggagtaacagcgtatctatggtattgtaagccttaagaatgggtaggatcagccaggaaatacagatgtatatgcagaagagaggagtcaaggaagccaagacaagttaatgtttaaagtgagtgatgtagtccatgggcagatgctgctgagagggctgcaaacaccagtgaccctacaacatttttaaatgtcgtcttcctgacagcagtgatcagtacctgcaacgatcttatttatttttttcatgttagtctccacacacttgaatgtagactttttgaaggcaaaatcattgccttttctgagctgggagcatgtctggcacataccaagcactcaacagttgatgtattgacttcatccagatactctgagggcgagttatttcctgctac

SEQ ID NO: 20653 - DNA, 1710 bp, Homo sapiens
caagcagttctcgtgccgcagcctcccaagtagctgggactacaggcatgcaccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaactggccagttttccttttattgacacaagcagccgaagagagggtggcaggagggagaagagcggccaggggacaccggcctgcatgggggcgtccctggtctgagtcagtggccagagctgcagcctggctttgggcccaaagtcttgtctgggtgtcagggaggccacgcactcaacgtttcgtccctttctgtgagtggcctgctgcggtttgagcctcgtccctccttttttgggcaagaaggtgatatccaggattcaggacagccatggaccttcagacctgaagcccttgacatgctgaatccttgccaggcttggattgcaagac

SEQ ID NO: 20654 - DNA, 1029 bp, Homo sapiens
gcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattagaaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggtagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattttcagaaatggtcccatgtgaccaagttctgctgtttgggtgacagtgctttgaagatctcctttgaggatgtgcagtctttttttttttttttttgagatggagtttgttgcccaggctggagt

SEQ ID NO: 20655 - DNA, 1031 bp, Homo sapiens
ttcctatttctgcagcgatttgaacactcagccaagctgcggcggaagatcaccacgtatgtgtccttccccctggagctggacatgacccctttcatggcctccaggtatgtggggttgtaggcccgttctgtgtcctgaggggctgtgatcctatcaggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccaggaggtggaggttgcagtgagccaagatcgcgccactgcactccagcctggtgacagaacgagactacgtctaaaaaaaaaaaaaaaaatgactgtcgatactaatataaaccccaccttccccaaatctgtttatcctgatcttaagatacagcacatgttaatgagttgtttttcatcagataccctgtttttgttttgaatttctcaacaattatcaatccactttcaaaccggcaaagtcctcaaggtgggatcacagcgagaaggcaacattttagttcgtggaacagatgttgaagtacaggcagacatagttggttttgcagttgtagattgcattttccttttcaaatctgcctattctggggtacttggaattcagctgcttactaatgcatgagacacataggagtttcctgtggttctgtgacaaatgaccaaaaacctggcggcttaaaattaatttcctcacagttctagaggttggaaatctgaaatcaaggtgttggcagggctccatgtcctacaagggtcttggggattccattcctcaccgcctccagctgctggtggttccacgtgttccttctgtggctgtcactcccctggcttccgggtcaca

SEQ ID NO: 20656 - DNA, 2259 bp, Homo sapiens
taatcacccaactgtctccttcccattggggactctccaaaaggactgatggttgctctgaaatagccagagagctgggacacaggacgagcaaagcttctcttggggtctcattggacctgggccatctcccccaacatagtcccacagcctggccccagggtggtaccctgatgatttttcagagttgtgtggtgttggtagttggcaggggcagctcttagcgctggaggtgggaggctgggaatgaatgacttgagccaagatcggctcctccccactcctcatggtggagatcccagtgtgagggacctgcagctgaagtctatccatacaggcagagagactgagaggtgattctcagatgagtgtgggctggtcacttgcaggtcttcctaaagcccgtgctggcgtttctgattcagcagatctgtggggggcaggggcttcttcactcttaatcagttcccagctgatgttgatgccgctggttcagatgccatactctgagaacccatgcgctcaggtcacagggcacctggctgcttgtgagtttcctgtggtctctgggctggcacagctagttgtagccgatatcctatcagttaattttaacttggagtcttttagagaacagagtcctgttctgacggttcaccgagttgaacagcttggtgggctggccttcccatcgcttctcatccgtctcaaggctgtgcacccgggccctaggcgcttacgtacaacctatgggttctgagatcacagcccagaaacaacccacagttgagctaaaatggctggttttggtcaaatgtgactttgggttctgttttcttttggtacttactttttttcctctgaaaaactacgtgatccttttaattcttacctagaaatcaaaggaaagttacttagtagcttaggtagaatttcatgtcctagtatgatttataagagaggaaagagccactgtggaagtgactatgctgttaccccaagcacctagtgagaataacgaagagccttctgtaagcagcagaaagatgttctaaaaatcacttgttcaaaaatgcattgctgttaaatgttcacatgacaaaatgtgacctctgacgtgcttctgacagaattcccttggaaatgtctgaaaagaaatgtaaggttcttctgtttagaaacctggttgccagagctgttcagcgaggtggcctggccacatggccttggttacgtgcattttgtccttgtggccttcacggcatctttctgttcatcttttgttttgttttgttttgtttttgagtcagagtctcgctctgtcgccaggctggagtgcagtggtgcgatctcagctcactgcaacctccgcctcccaggttcaagtgattcttctgcctcagcctcctgagtagctgggactacaggcgcccgccaccatgcccagctaattttttgtatttttagtagagacggggtttcaccgtgttagccaggatggtctcggtctcctaacctcgtgatccgcccgccttggcctcccaaagtgctgggattacaggcgtgagccaccgcgcctggccattctgttcatcattctttgcgccttcctgtatggatattcttgtcctctgaattttgtcccatgaatttgagatccctctgggaagcatttttctctctaatcttaaaccttctgctctcagaagacttagtggcccttctctattcctctgtcatgattcaacgtctttgaactgtgatgtatatacaggtgtcctcgtgccctgtccccactgtctagtgaagttatgtagaatatgtattccacacacgaattaagttctgctacttaagtttctttttcacagatctgcacacatggatatgaatgaagtgtgtattgaatagagagggtgggagtggcacttccagatgcaactgactggaagacacgctgtcccctgggggctctagctgatgaggacagcctgtgtcctgcggtgtcactttctgaacttggggcaccatgatacctactcagggagggaggttgctggggcttccccgggtgtacctggcccaccatatgttcagctgtctcactggaacaatattgattcagtcattctttatatgataatgggaatcgattattctgctcagtcactgggcattaggtgggttttcttggcaagactgaagctgtggggctcttgttagggaatgagaaaaaggagcattgaaaatccaagtgct

SEQ ID NO: 20657 - DNA, 1033 bp, Homo sapiens
gattgccagcctctggtcgagcctaaccgatttcctcaaagtacctgcaatgtgccataactgctggggacacggcccaaataggagaaaggagggtgcagctgggaagttggtgggtggttgtatcactgactttagtgataagctcacttgtgttagattgtttttagactccggcttgttaaggtgtaaattacagtcacacccaccttctagcctatagatagatgagtttcgacgaatgcatagttgtgtaactgctgctactcaagatgaagaactgttacctctccgaactccctcgtgcccctccgaagtcaacccccagtccccagaccctggtagctgccgatctgtcttcggtcccttgagtgtcctttaccagcgcatcatacggatggatgcatgcaggaagtagcctttctgaatctggctgtccctacttaatgtaatactgggtggattcacccgtgtcttgcgtgcatccatgatgtgtgctttcgatgtctgagttgggttccattatgtagatgggttatggtttagttgtctgtttcccagttcagacacatttgggtggtctgtggttttgggttttttgatgagaaataaaactgccctgaattctgtatttgcacaggcaagacccctctgtgggttctgacctggggaggaagccgtgggatggaaggtgtgctgctgggtctgcggctggagttgagctgttggagaggactggctggcaagccctcagctaattgccattagcctcagaggcagagaatcctgtggctgatgctggtgaattctgcataatcacagtgatgtgcttccctttgcggaggtgctggtgtccatgggcctgagtggtttggctagtgctttgaggaaactagtattgggcaaatcgagtcacttttatttgcatgtgatctcatagtagcaagtcataattcattttttaggcttatatgtggaaaactagatggtagaaaggaaaaaattcatatgaggactcgaaaagtccagtgag

SEQ ID NO: 20658 - DNA, 1038 bp, Homo sapiens
tgtaaaagtggcataaaaactagcagaatgcgatatctcatcgtgttctggcttgaatgaatgaataaaagaaaatgagtatgtagaggtagaggaagccgctgggatccagcgacacctgtggttcagcacacaggtaactcctgctctctggtgatttgtgtccaggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggaggtgagcgccattgacttctgcaggggaacatttctgttactttgttttcaccttcaaaaaaaaaatttaaggtggaccatgataaaggaagatacatttagaaccttttgtagtaagttaatgtttaatatacatgtctattatggaaaacacagttttccaaaaagggaagacctggcgtgatttttggggacgcactgctgactcagaacaaggagaagccctttgagaggcttgtggcagagacttccctggtgggtgacatttgtctctaaagacgggtgattctcccccttcctcttcctccatggtctaccttcctggctcagaaaggcacgcatgtgtcaccctcctgtgtcctcctggtatgcgagtctcctccaccgccaggtctctctaagcatgccccatcagagcctctgtcctcatgagctacgcgctgcacgttggctgttcctgtgggctgcacgtgtggcgttcctgtccacttctgtccccggcatcagagcatggcagcgttcagagcaaggcgttcacggctgccgcctcagccctcaccggctccgtgacctagacatgcttctcagagctgaagcagctcagttacctcaactaataagcaggctggtgcctgttcttcaggtgccttgcacaggagccagccaacagccctggcctgttcccattcgtaacctctgcg

SEQ ID NO: 20659 - DNA, 1559 bp, Homo sapiens
tttttggtttttgattctgacagatgctcatagtggttgacagtgatagtgacatagtgacaggtgtggtttaccccagttgacaggtgagcatctgatctccctggtagcaaagccatcactgtttgcaaaggaaacatatgaacctgacacctgttttacattcttgccttgattactctccattgaaaacaccccagtgttttgagaagggaagaatagcaacaggggctctttcagtgagcagaattatttgtgtttaacaagtcttctctggagagcaatctctgacttgtgttcgctgttcttttccctctcagaaatttaataacattgtgactaagtgtgggtgtattattctgtgcagagcacttaaagcacgggcctaagaaatgtatgtccaggattaaaatggaattcttctagaatcattttataattctgtctatccaacatgctgtgtcttttaaagtattttgaagtattcagaaatgttggttggcatggaacaagtacttctgagcgcatagggtgtgcgttgaatggaatactatgccaattagcatttaccaccactctctgaatattttgtggcacacacgtttttaactgttggatctatcttagtttggtaactcgacgctgagtttatgctatttcagtttgctgaaaagtgcaagctctctccttcaatttcacttgtttgcgggagaatccttcatgtaagttcccattggtgctgatgctgccatctctgtgctgaaggatggaagacatttgaaaaacaactgttttggcattggcgttggggtagttttgactggaggtgctgcttttcttgcaggaaacgtagctcacatcctcataccctctgtgagaagctcctttaagtgttgtgtgtagcccctctcagcacagtagagtttgagaaagccctggtgctgtggatgttgctcactgaaatgcaccctgacagacagcatagcgccacagcttttatgtgtaaacacacttgatgtgaaaatctagctaatagcgcttggaactgtccttcatctgcttaggcgttggagagaagttttcaacttgggaaccaaccaaacgggagcttgaactgctgaagcacaacccgaaaaggagaaagatcacctcgaactgcaccataggtgggtggagcgtgtcgtcactctcagctaggcttctttccagggtttaaaagtaaatacagaattgtgggtttcttaagtccacatgattctgttgaagccctgcataactgtcactcatcaatgtgctcagcaaccagctcttgagcacctgttctctgcagggacctgcagtgggcttggggcgcagagtgatgcgtagcaacagccctgccctcacagccttcagcgtctgtgtgggtaaagggactcaagttgattttggccagggtgaggctgggcacagtaatcttcagggagagaaatgatgtgtgtgagtgtaagtgttcgctgaattttctacaaattgagggaataccctttaaaactttttctttttcttttttgagacag

SEQ ID NO: 20660 - DNA, 1107 bp, Homo sapiens
gacggagtctcgctctgttgcccaggctggagtgcagtggtgagatctcagctcatagcaagctccgcctcccaggttcacgccattctcctgcctcagcctcctgagtagctgggactataggtgcctgccaccatgcctggctaattttttgtacttttagtagagacggggtttcaccatgttagccaggatggtctcaatctcctgacctcgtgatctgcctgcctcggcctcccaaagtgctgggattacaggcgtgaaccaccacacccggttaaccccagttgtttataaattgttgaatggagagagtaccttttttcaggcactcagaggactttatcttacttacttttatgataaaataattaagagcccaaactattagtcctattttattttattttatttttttgactttttacaaattattacttttaacaaagaaagcaaaagtggatcttatttccataaaataaaggtttatgttgacaattaaaaactggacatgcacacgattagaaagttcaaacgacacgaaaatgtatacttctccccaaaggaaacgactgtgaacagtttcttgtgactgttttagaaaattgaaatttatacatacatatgtatctcttcttatttgtgaaaagaatatactagtattactataatttttttatttttatttttattttttgagacagagtctcactctgttgcccaggctggagtgcagtggcaagatcttggcacactgcaacctccccttcccaggtttcagctgttctcacgcctcagctccccgaatagctggggttacaggcgtgtgccaccatgcctggctaattttttgtactttagtagagatggggtttcaccatgttgaccaggctggtcttgaactcctggcctcaaatgatctgcctacatcggcttcccaaagtgctggggtaacaggcataagtcacagctcctggcctattagtcccattttttagaagatgcagttgagaaattgtggtagaagacccaccttcaggcagctctgggtcaagatgtcaatcaaagtcatccgatgagaaactattttccccctgtacttaaggt

SEQ ID NO: 20661 - DNA, 1034 bp, Homo sapiens
atgtgcttgttgggccatttgtatatgtttggagaaatatcagttcatgtccattgctttttttaaattgggttgtttggtttttgttgttgttctttatatatacacatgcacagtatacagtgtgtgcgtgtgttggggtgtgtgtgtatattctggatactggactctgagcagatgtatgatttgcaaatgttttctcccattttgtaggttctttttagtttcttgatagtgtcctttgaagcacaggatcagacgtttttaattctgatgaagtccagtttcttttttcttttcaagacactatctccctctgtcacccaggctggagtgcagtggcacaatcacagctcactgcagcctcaacctcccaagctgaagtgatcctcccaacctcagcctcctgagtggctgggaccacaggtacgcgccaccacgcttggctgattttttgtactttgtgtagagatggggttttaccatgtttccaaggcttatcttgaactctgggctcaagtgatcctcccatctctgcctcccaaagtgctgggattccaggtgtgagctgctgctgcccagcctggttttattttttcttttgttgctgatggttttgtgtcagatctaagaatcccttaccaaatccgaggtcatgaagacttgcccttaagttttcttctacgagttttatatttctggttctcatatttaggtctctgatccattcgagttaattttttgtatacagtatgaggtaaggatttgtaggtgaatattcagttgtcccagcagcatttgttacagagataccctatcccctcaaatggtcctgatgccttgtggatgtcggttggttttatgcagtgggagcgttgcagtgtgaaggcgtcttaaagaaggcctaaatctagaaggatttacataggcactggaatggtgatccgtcttcccaggctagagtttttgttgtcagctacatgtgtgggctgtttttcacgggatatcttggccttactgtaaattctcatcac

SEQ ID NO: 20662 - DNA, 1034 bp, Homo sapiens
gtcattcactgaaacattgctatgtggtgtgtgactataccagacataagattgaggttttatcagtatgtcagagacagctgttttctgtatttagcgccagttgtcttgttggttggctgcttgaataatgttggagaagctgtctcttagctgtgttggctccataaggcctgtaaaatgtgtcttccctggtgattggtaaacccgtgcaggggagcatcctaggttgtgtagtagagatagaccataatggagtgtgtagcacagtcctaggttgtgtagtagagatagactataatggagtgtgtagcacagtcctaggttgtgtagtagagagagactataatggagtgtgtagcacagtcctaggttgtgtagtagagagagactataatggagtgtgtagcacagtcctaggttgtgtagtagagagagactataatggagtgtgtagcacagtcctaggttgtgtagtagagatagactataatggagtgtgtagcatagtcctaggttgtgtagtagagagagactataatggagtgtgtagcacagtcctaggttgtgtagtagagatagactataatggagtgtgtagcacagcaggagcttgttgtgtttagttgttttgttcagtgttaggtttctgagattcatccacgctgctgagtatatcataagttccttttcattgctgtgtactttactcaattaactgtagtatagtttattctttttacaagtcatgaacatttgtattttcagctctgcggtgttgcaagtaataatgctacaaaagtccttgtacgtgtctttggttgcgtataaacctatgaattgaagcgttaggctgtagggtacatgtgttcaatttaatagttgtcttctatccatttatttggaaaataagaaacctacaacaaatagcaagaatgctaaaatgaatattgtatacatttatatggattcatcaattgttagcttcttgctaactggttttatgtctgtacctttttctgaatcatctgagg

SEQ ID NO: 20663 - DNA, 1056 bp, Homo sapiens
aactcattggtttttatgtaatgtccttattctgtctcagaatcccacattactttgagtcttcacgtcctcttgggctcttctagacagtgacagtttctcaggctgtcctgtttggtgaccttgagagttttgaggagtcccggtcatgtagtttgtagaatgtccctcagttttggttttctgatgtttttctcatgattcagctgtggttatgagttttgggaaggaagaccagggagatgaagtgcccttctcattcccgtaaattaaggatgatgctgtcaagatgtcttgggttgctgggcttgactgaatggccgaagtcatgtttgccaggtttctccactgtggagtgactctttccctcctttatgtactgtttataatagaagggagtcactctgcataggtactctaccggggtggggagttctgttcctcctccttgaggatggagtagctacttaaattatttggaacgtttatgtatggaagatttgctgatcctcactcgtgtgtttattcatttgtgtatatcaacatggacttgtggatattgaatgtatgctttgggttatcatccagtgctgtgtggtttgttgtgttgctcccatcatctggctgtatccactgggagctctttcagctggctccggtgtccctttcacatagccacattattttttgttcgttgtttttgagcacttccttactttctggaactacacgatgttctgggatcatcttatgtgttttctgccccagccttagactccagcattttccaaggatccctagtttcttttttgggagaatggaattagatctcaagatctgggcactggtgtgttcatcattactgggatatcctggcttcttggccccctcaagggacagagctgggaaacaggtgtgtatatacaaatgcgtgcatatacacgtctgtaatttgatatatattcatcagcatccctattaagctctacatgagttcatgtttatatctccaactctaatccatttctatagggattattctagccttcccctcca

SEQ ID NO: 20664 - DNA, 1051 bp, Homo sapiens
atgcctggctaatttttgtatttttagtagagacagcgtttcaccatgttggccaggctggtcttgaactcctgaccttaggtgatccacccaccttggcctctcagagtgctgggattacaggcgtgagtcaccatgcccagcctggaaaatccttctgcaatgcaaatattcaccatttaaacttgggtgaatcagtaaacctgggttttcataaatctagattccttaaactaaggtagtccagcatgacaaatgaaatgcttgttagttttatagttactgcatgttggagcaacttatttggagtaaaaatgttgccaccatttacttcctctgtttgatttgggaacttatcccctttgggccccagttttctcacctccagaatgagtagattctcattctacctgcatctctaggcacttataagataagacgtaaagaggtaacagttcctcattcactataaagcattacatgttgaatggagtctgctggaatgatctgtcctcagacctgtcctcagctgctacaagcatcctctactgctgcatgtctacatcaggtgagtgtttctcaacctgatagtaagaaattagatcatgagaaagcccagaattgtctggagcctcctgccatagctcttagaacccttggttgcacttgacctgtccacaggtggtctctctctggtggcctaagaaaggccacttgattcatctctctgtttcctgtgccatgcacaagcttgatgctgaataaacatctgaaatgataagcaaatgaaaagcagatgtgaaaaagagcaaacacttttaacatgttaggctccctcgctgtaatcttctcgttttcagtaactgggatttcagcaccccaattgctaccccgaagagtcagcagtcagcaataactacaactcttttgtgcaagctgccagattggatcctcagaaggggcacacacaggtatatgagaaccactattttactatcataatttgtaaatctcgtgggttaaaatgagaggaaaaaaactgaccctctgt

SEQ ID NO: 20665 - DNA, 1047 bp, Homo sapiens
cgcccagctaatttttgtatttttagtagggacacagtttcaccacattggccagcctggtcttgaagtcctgacctcaggtgatctgcccacctcagcctcccaaagtgctgggattacaggcgtgagccaccatgcccagccttatcttagattttttaaagttatatgttaaacacatcaaaagttatgtttacaatatgtgaaaagtaataaacatgccacagcatgatggcccttaaaaacataatgcaaaatgaaagaagccagttgttgaagaccacgttacaggattccatttaaatgaaatacccagaattggcatatccagagagttgggaagccgactggtggttgtggagggctggggagatgtgaagggaccactaattggtacagggtttctttctgagatgatgaaaatgcaccaggatcagttgtgctattggttgcacaactttgggaaagccacttcatcgttcacctccgatgggggagttgctctgtgaattctatctcagtaaagctgtgaattctatctcagtaaagctgccattaaaaaatacaaatcaggccaggcatggtggctcatgcctgtaattccagcattttgggatcacctgagatcaggagttcgagactagcctggccaacatagagaaactctgtctctactaaaaatacaaagttagctgggcgttgtggcacgtgcctgtaatcccagctgcttgggaggctgaggcaagagaattgcttgaacccaggaggtggaggttgcagtgctccgagattgtgccactgcactgcagtctgggtgacaagagtgaaactccgtctccacaaaataaataaacaaataaaaataaagaaaatgagaccaggtacaatggctcttacttgtaatcccagtgctttgggaagctgaggctggcagatcacttaggagttcgagaccagcctggccaccatggtgaaaaccctgtctctactaaaaatacaaaaattagctgggcgtggcagcacatgtctgtagtcctagctatttgg

SEQ ID NO: 20666 - DNA, 1032 bp, Homo sapiens
taagcttttattgatctaagaaaatagatgctgagaattgtttttgttttggcttgagacaactgtttattcaaaatggatctgcaaattagcagtgcataggctggatccagtccttgactgttgaacctcaacagtttttaagagaatttaaattagttgccagcagatttcatataaaacgctccctgaaaagctgggtagtggctgactctttttggtcgggacaagtgcttggttccagttcttggttcctcacctgacagcttgactcaaatcacctgacagcttgactcaaatcacctgtcagcttgactcaatgcatttgcctgcttggtctctgtaggtgttcaggttgcacctttggcctggaactgaaggctctactcacacacgcagatgttgtgtgtcagcaggaatgtggcatttggttttgtagtttggatgtcaccatctactctcctagataacgtggtatgggtggagactacctgtctgtttgctcttgctgtaaacccctagccaggttctgttggaagagtcatttccccgagcccagcttccctaagctcttcccatgctgagcaggggatggaaacataacccgctgtggggctagcgagctgacttctgggcatccctccattcctgctcagttggtgatgactgttcaggtggggcagggcggattagctgatggcccagcactctagattatgagatctgagtgtattattggctcttatgactgaagtaggctgtttatggctctctaaaatgactttgttccatgtcacattcgtgctgactcaaatctcagctccatgttatacgagtgctctctcccgttgctgctcacacctggttagcatctgcttttgctgaagctgagggaaacattatctggtttggggaaggggctagaacagagtgacactttgggcacacttgccagatttgccagcggctaccaactctgaagcatgcattgtacttaaaggtcccacccagtgccagactgcctgcagtatt

SEQ ID NO: 20667 - DNA, 1062 bp, Homo sapiens
ggttccacaccaccactgtggaccagtgtgcctatggacttaggagagttcccagatcgcacaagggggctgccccagagggtgttcagcttgttgccaacagttgctgaagccaaagtctgcaaccttgatgttcaggtcaagtagccagaaacaggtgttctggctttaggtccctgtggacaatgccattctctccttcccaggctactgatgtcctgggttgctcctcttatggtagaagctcaagatggaatggctggagcttggctgcctccggttagagcctgggctctgtattgcagacatcacctggcagaattcctcatgggccccttttgtcgtgggtgcgactgctgggccagggttgtcgtgggtagtaaaggtatttaccaagacaaccgtgagtaaagaaaggcaaatttattacagaaactatgaaaatacattgcaagaatgcaacatgcagcacagcagagaaggggctgtctgcaaagataaagggctggagggaagttttctaaggttgtgctggacggcgctatgtgcaggtgagcttgtgctatatgctaagaatatgttggaataattttaactgccagacctttcctcttctggtgcccgagggaaacgccctgctgcttttagctgtcttgtaacccacacgccttttcacttctgaagttgcaagaataacggctgtggtttttcacacaaaagggttgcagactgggttaggtccctgttccgccaacctggctgtttcccagtttcagttaacttagtggtttactagagccccacacctttctctttcatatggccatgatccaggaggtaatccgtcacctcccctccactagagtgctccatggccagggataatccgtcacctcccctccaccagagtgctccatggccaggggtaatcctcacctctcctccgctagagtgttccatggccaggcagtgtttcctgggtccagagcacctcaaacaatttcagtgttgtggtgactcagggccttcaccatacagacttgacagcatagtctagaggct

SEQ ID NO: 20668 - DNA, 1058 bp, Homo sapiens
tccttcatttctatggccaattggtcatttggttgacagacacacatcaggcactgagtatgcctcagccttgtgtcagacactggaatacaaagatttttaattgtcatttgccaattttattgccaacgtatacaattttaatcatccaaagagaggttgtatagcattgtggccttcccaggttcaaatcctagctgtgccccttacgagctgagtaaccctgggcaagttactttgtctctctatgccttgattttcttaccgaaaatggtgataataatagtacccaccttgcaggaggagggtagttggcgggagtttataaagatgaaaggagttaaagaatatagagctaggaacaatgcctgggccacagtaagcacgacataagtattagccattttcatgtttttagaacactgcgttgtccaaataaaatatgtggctatgtaatttaggcccctttaaaacttttaaaacaaaaatgcatgaagagattgtaagaaagaatgtctgaaagaaatggattgttttctttttgtttgtttgtttgtttttatttttgttttttgagatggagttttgctcttgttgcccaggctggagtgcagtggcacgatcttggctcacttcaacctctgcctcccgggtttaagcgattctcctgcctcggcctcctgagtagctgggactataggtgtgtgccactacacctggctaattttttttttttatttttagttgagatggggtttcatcatgttggccaggctgatctcaatcccctgaccttgtgatccacccacctcagcctcccaaagtgctgggattacaggcgtgagccaccgagcccggcccagaaatggattgttttctaggctggaaggggagtgttgctattaggggagagcctcacacagcactgcaccacacaaagtgagccacagacatgtacctgggactccctggcggaaagagtggcttctggtggtaccacctccacttttctttgtcttttttttttttttttttttttttttgagactcggtcttgc

SEQ ID NO: 20669 - DNA, 1053 bp, Homo sapiens
atagcaagggacagtaatgggagacaggaggaggacaggggctcagggcagcaaggatagggggcagggctggtgaggagggcagtgaaaaaggtaagagccctgtaactgatttctgttggcatccagctctgttggtgatcttgaagggatgaggagtggggaggccaggagtggatacagggatgttgcctccctgtgggtgtgtaggccatggttcagctatcacccttatcccacagatactctcagcttggtctgtctgcaaccttcctggaatacatcaactgcactggagagatgttgattggaacacacttggtcttgccctgtgggacttaaattctttttgttttctccctaggaagcccagaattcccacgtgtactgggtgagtgtcactgtctgggagaaggggagcttgtggggtgtgcctgggggtcagggtggaggtgggggagcccaccttctgacgagagcggaacctgtgcagtgcatgtgtcagctttgttgacttttgctttgcacagaattctgaggagggttacccaaattttattttttttaaactctctctcccacacccacctcagtggcgctactgtatccgtttggagaaccttgacagtgatgtggtacagctccgggagcggcactggaggatattcagtctctctggcaccttggagacagtgcgaggccgaggggtagtgggcagggtgagcatccttggtctagtaattctggtcctgtgtggcaagcctgggggcttagcgcatggcttccttctcctttgttgttatagacagaggctcactttgtgaatacattgtgttgttttgggttagaaatcttaaaacaactacatgagatatgtttcttgaaacccatttcatagatgaaaagagtgagactgagaagttaaataaccagcccatggtcccatagctagtagtggcagggcctcaatttaaacccaagtgagtctgaagtcaaaacttgtgtagtttttaaaactggtatagtgtcttttaaaaactaaaatttgaatgt

SEQ ID NO: 20670 - DNA, 1044 bp, Homo sapiens
acaatgggcagaggatcatgccaccttggattttcaaaccgcagagttgggatttgcagtcagcagagcacaattatgttctttctagataaccagagcagaggatttactctctgcagacctcagcttttccgtctgtaagatgggtgtggtgatgccagagttccctgtttctctggggtcagcgtgtacaagcccagaagtgaacaaccttgtgacatgggtttcattttccacagttgacagataaagaaacagagacccagggggttacattggctcacccaaggttactcagtaaatggtggagctaggatgcaaacctacgtctgtgtttaaaagcagctggtctcaggatctgggttttagtccgagccctgccacaggcctgtttcttcatctgtgatgtgggtggtttgcttttgatgacatcacagacccctctagatgtgacagaatttaatctcaacttctgttgggttgttgcacattttgtaaactgtgggttctcctggtatatctataaagaacagcttctccagcctctgggtctttatgccccagtctggaaacattcatctttttccatctgtcctggaatgaggatctgatgatgacagagactctggtgccatacagagcccactgtgggttctggtgtccccagaatccatgtgtcttcattcattcacctaaactttttttcccagcactttctctgtgcccagagatgtcaagagaaacaggagaaaagaacagcccttactaactagctacttccaggggaccaggcccagtgatgggtgatttccatgtgaacttaatgttgctcacaatctaggaaataggtattatccttatttagcagaaggaggaacaggaacccaaaggataagaagctattcagtggtgacaccgctatgaatattggaactgatcagaccagcagttaatcccaaacaggagatgattccaaagaggataaaccagaaaaaagccatttccatcaagctttcatcagacaatatcacatgtacttttttt

SEQ ID NO: 20671 - DNA, 1070 bp, Homo sapiens
cactccaagatgggttcatcttttcttcctttcccattcacctggctcaatcctcctccaccaccaggggcctcaaaaggcacatcatccgggtctccttatcttgtttgataaggctgctgcctgtctccctctgtggcaaggactgtttgttcttttgccccatttctcaacatagcacacttgtgcactgagaggagggagcattatgggaaagtccctgccttccacacctctctctagtccctgtgggacagccctagcccctgctgtcatgaaggggccaggcattggtcacctgtgggaccttctccctcactcccctccctcctagttggctttgtctgtcaggtgcagtctggcgggagtccaggaggcagcagctcaggacatggtgctgtgtgtgtgtgtgtgtgtgtgtgtgtgtgtgtgtgtcagaggttccagaaagttccagatttggaatcaaacagtcctgaattcaaatccttgtttttgcacttattgtctggagagctttggataaggtattgaatctctctgagcctcagtttttcatttgttcaaatggcactgatgatgtctcccttacaagatggttgtgaggagtaaatgtgatcagcatgtaaagtgtctggcgtgtagtaggctcttaataaacactggctgaatatgaattggaatgatacaaagtctgagctctactctttctgcattcacgcgtaagtaacagtttcctggtgtttgtcctcctgtgcccacaggtccactttgcttccacgtggccatgtgcccttcctagctggattgcccaaggctgttagcatctgctttttacctgagatactaattcatcaggtcaaaaaaaaaaaaaaaaaaaaaaaaaaagtcttgagcaccagctgcagggagccttctgctaggtacaggggtcctacagagaacaaagtaggcaggaccagtgctttcacagagctgagctttcagggggaagagtcagcggacaaataaaaataatttcacataatgcattagaaagacaaaaacaggctggtcagatggtgactgag

SEQ ID NO: 20672 - DNA, 1119 bp, Homo sapiens
ctcagttgcagattctggccaacatggacagccagctaaaagagctacagagtcagcatacccattgtgcccaggacctggctatgaaggatgagttactctgccagcttacccagagcaatgaggagcaggctgctcagtgagttcctaacggggtactgtggcagtaggcatccaggatttaggaccaaatgggatctaatatgttgtctctggcagatggcaaaaggaagagatggcactaaaacacatgcaggcagaactgcagcagcaacaagctgtcctggccaaagaggtgcgggacctgaaagagaccttggaggtaaggaatatggcttgggccaagggagctggtaagcctcaggagtgtgattcttgcctgatagtgttgaggtaaggtttgagactgtgaactagaaaaagcctctgtacccagggcactaaaattctccctccctgtcttgctccttctcttgtcttcccagtttgcagaccaggagaatcaggttgctcacctggagctgggtcaggttgagtgtcaattgaaaaccacactggaagtgctccgggagcgcagcttgcagtgtgagaacctcaaggacactgtagagaacctaacgtaagttctctaactttctgtacttccccctaagtgcttatttttttctcaggaacacttctagaagccaaaatctccaagaagagaactgtgagtgttgagcctcttgtttctctcctttaatgcagctctgtggggatttgggataggcgttcagagaaggtaatttggtctttggtcatcttccctgttccttatttcagggctaaactggccagcaccatagcagataaccaggagcaagatctggagaaaacacggcagtactctcaaaagctagggctgctgactgagcaactacagagcctgactctctttctacagacaaaactaaaggagaaggtaggatcctggggttccttctcttctcttccaattgtatctttattttacagatagtcttcctaaaacattactctttttctaactgtgaccttttatgatttcagttacctacaggacctcattagcctgttgctcaaacctttcttcccctgtct

SEQ ID NO: 20673 - DNA, 1022 bp, Homo sapiens
cattttattggcctctgcagaattgctttttctggattggactttggtaatccatatgaaaatctctatgaaatttaattgctcgccaggtgtggtggctcacacttgtaatcccagcactttgggaggctgaggtgggcggatcaccagaggtcaggagttcgagaccagcctggccaacatggtgaaaccccgtttctccccaaaaaatacaaaaattagctggtcatgagggcacacactgtagtcccagctactcaggaggctgagggggaagaattgcttgaacccaggagatggaggttgcaatgagtgaagatcgtgccactgcatccagcctgagcaacagagtgagatcttgtctcaggaaaaaaataaatttaattgctgtggatactgtaaagggtgtttatcgtaacagttcataatattctatttaagaatgcgtgggagaaattttctctggacccagttatgcttttcctgaattgctgtttggtttttaccttaaggacactaaatattcagctgattgtatttttctgtttgtactgatactagaccatttagagcccaatttgtggtctaccttcagcaagtgtttatgtattttgtatgctagtcatgttcttggttctgtcttccttttctacttttattttccttattctcatttttctaagttttaatcgttttatattactataatatctgcatcttgtaagcctttttgtaataaggttgggatataaataaataaggcaatgtatcctttatccttttatctcatttgtttctctttagacacttttattactttttaaaaattgtgatgaccagaactgcacactggataaaaactctgaatactaaaaataggaattaatggtttccaaaatagtagttaagagcatttgtttggaatttaggagatctgatgcctggatccaccaataactatctcatcgtcttttttttttttttttttttggtggggatggagtcttgctctgttgcccagg

SEQ ID NO: 20674 - DNA, 1069 bp, Homo sapiens
tctctctggcgactggaaaggtgagagaatagtagtagttttgggcagagaagagctttgccttgtggtgggaagaaggaagaccttaggaaatcttgccgtattcctactaaggaatgaacccctacccctacctccactccctacctcttaactcagtttccagtggctgcagagagagatcatgtggccatgttggcaagtgtgacccacagtgactctgagatcccagcttctcttaaccagggcctctcactcctgctccatgaggtaaggatgagcactgctttccttcttggctacgaaaccattaatgctctcctgccttcattaaagtgatttttccccattcctctcatcagtttttttgagggggctccaacttaactacctaactacttgccatctaagctgtactgagtcacattcctaagttcctggtcccccaaatctcctccccatctagaacagagaggtcccttctgagagagtggaacactgtacactcatctgaaaactcacaagcacagctccttattcccacctttgccccaaattagcctctatttctccctcttttacaaatcatctactcttcagggttcttattcctaccctccacagctccatgaacttctttcttcttttccatcctttctgttcaggcctgtcctgtcctagtcactcatccttcatgctctattttccttcagctcttatgccagaaccccctccatcgtctacgttatctgcatcacttccaggtccaccctttctttcggggtgtggccttcgacccagagctcctacagaagcagccagtgaactttgtcacggagacacaagctacccagcccagttcagcggagaccatgccctttgacgactttgactgtgatctggagtccttcttgctctaccctatccctgcttgagcctctctactgtaaattggggcccggctgggagcctgaagatctccatccctgcctactcagtatgaccaccttgataatccagtttgtttttattttgtagcctcttaccgttctgctctcctaggctttag

SEQ ID NO: 20675 - DNA, 1027 bp, Homo sapiens
gacctgaacatgcaacagcaggaagaggaggagaaagcccggctcctcattggtttaagtgtgggcgacaagaaccctggcaagaagtccatctttggcaggcgcaaatgatttggcgattcgagtggctgcagtacaggatctgactctggctcaggctccagggacttgtggggtgggaggggcttcccgttatccacgaggatttgtgggtgtcagagcccataggcatcactcttcagcacctggtctgttcgctgcagggcatggtggacagtaatgctgagttctgtctcacactgatcaggctcagggccagagaggcaacaagagagcaagacccagggaatgggcccagggcaggaccctattcccttggggtcaagtgaaagggtagggggatagtcctgatcaagtgtgataaatttttatagacatatataaatatatatatattatatatatatttctaagtgtaactgtccttcctctgtgccaggaaacgggagggggctgatcctctgatcctcactccactgtcatgtttgaaagaggtattggtgttctggagtgggggtcaacccctccccagtctctgtgctaagttcacttgggaggatggcagtaggagccagggctggccatgggtcccctacccttccccgtaggatataccctggagaatggcaaaatgatttaaagagaaaaaaaaagatattttaaatttgatgctcatttttgtgtgtgtgtgttgagtgcatgcattcaatctgtgtattcctccctcatcaacccagaacatcctgcagctgccactctgagggtggccccttccttcctctgccctgaagctgtatcacagaaatttctagtcctagtgtgactctggccccatgctgatgggtttctgcagactggaagaggcggggctcgtgtcacgcagcatcagggagaggaattgcttatataactgggacagcagatttagcagagagaggaggcagaggctgggaatgggagcagtaag

SEQ ID NO: 20676 - DNA, 1074 bp, Homo sapiens
tatagctctgatgccatagggggagagtaagaatgaacaaagaaataaaataatttttaaaaaatgatacaggccacgtgtagtggttcatgcctgtaatcccataactttgggaggctgaggtgggaggattgcttaaagtcaagagttcaacaaaaattttaaaaattagctgggcatcgtggtgcatacctgtggtcccagctacttgggaggctgaggcaggaggattgcttgagccctggagttcgagcctgcagtgagctgtgatcacaccactgcactccagcctgggcaacagagtgagaccctgtctctaaaaaagaaaataaataattaaaaacatatatgataggccgggcacggtggctcacacctgtaatcccagcactctggaaggccgaggcaggtgcatcacctgaggtcaggagctgaagaccagcctggctaacatggtgaaaccccatctctactaagaatacaaaaattagccaggcgtggtggtgcacgcctgtggtcccagttgcttgagaggctgaggcaggagaatcgtttgaacctgggaggtggaggttgcagtgagccgagatcgtgccactgcactgcagcctggtgacagagcaagactccatctcaaaaaaaaaaaaaaaaaaaagaaaattgggtgtggtggtgtgtgcctgtaagcccagctactcaggaggctgaagcaggagaatcgcttgaacccaggaaggagatggatgttgcggtgagccaagattgtgtcactgcacttcagcctgggcaacagagtgagaccctgtctcaaaaaaataaaaataagatacagatacaggtgagtttgatcagatgcttctcttgttgagtaagaagatgatccctagaagtatggcccagaggcaaataatctttcatgtctagcttggaatagaatattctaatactgacattcagcttttctgccattgacgtaaagaaggcagtattatttattactttctcctaccagaggcgtttggaaatgaattagaacattttttaatgtcacaatggctagatagtactaccagc

SEQ ID NO: 20677 - DNA, 1020 bp, Homo sapiens
gccatgacattgatcctgaactagcaactcagattaagccacctgaagttcttgagaaccaggaaaaggaagatctcctaaagaagcaggaaggtattcagggcttgaaaggcttttaggaagggactagagaaattgtgaaagtagttatttccttggtggttttgagacagtagagttattaaaaatccactgtgcactggcattaacatttcactttgctctactttttgtaagttctgctatgagaaaataacctctattcttggagggagctgggatgaatgggcattgtttatgattctgaagtaaacatgtttctgcccatgagcaactctcaccctttctgtggggttgactagtggggtggttccaaatgtgggttaagagatggagtagatatttaggtagaaacttgagccttttatttagctgctaacaattatctaggggctgtggataccttcacccttatccaccatgagctggaaatttccaccaacccagctcagtatgccatgatcctggacattgtcaacaacctgctgctccatgtagaacctaagcggaaggtgagcatgggcccttgtagaatgctggttagcctcacaggaacacccagactttgtgctttatttgggcttctgtaacaaaagccatgcttcacactgaaaaagggccttgtggttggtagattctcttagtcggcagtgacaattgaaattccacttacttaggaaaggcctgaatatctctcagaccgtagggcttgtttgcctgattgttttctcctagtcatttctctactcagtcacctagacacctctaaaaacatttactattccctgcttccacctccatcccatcctgttgggcctgacctattgtgaaatccacattgccacattttctgcattgacctactactgttgctattaccagtgacagataaaggttagctttctagaagagaccccccccatttctttctcctttctctatttcactttactacaagac

SEQ ID NO: 20678 - DNA, 1154 bp, Homo sapiens
tcggtgctcagtgtagtgttttatacaaaataaatgtttgttgaactgaacttaaatgataaggaatgtctttgtcttgcctgcctttgattgtaaggtggcagtcatgtctttgtgtagtgcttctattgtgctgcacagagaacttaaggttatggtttagaagtgatgcttcttggttattttaggttcaagcgtatagtattgctggtgttcattgtatttggcctatgaaaatgataattttatatgagtcaacctaatatccttttggggttcctgcagattaccattaagagtagcaataaactgatgagttcagccttttatcttctaggtgtgtctcgtcctaagaatcacaataaaactctgaattctcactctgattgtgagagcttcagaaactgttccatgataggaagctgcagttcttttcttaccaaacaatgatgtcttgttcctatgcagaaccttcccccaaatcctggctcccatcatctttagcacctccatctccaatgtcaacatttccattcaacttggagatacaccaccttttgccttgggattcaattctatctctctgggtaaggctctcagatggaataggaacaagaatctgtccgttagtggagctaggcccaattgatggccacagtggctccatgcaatccctctttctcacctttgttcagattaccagcacctcaggccacaaagcatccatcagcggggcgtcctaactgtggaccacctctgctggcgtgtgggcagtgactcccacattcagcgggcgccacacccacccaatatgcatgtttggggtgaggcacttgttctggactccttcacactacaggtaggtgagggctttggtgaataggggcctgcacagctttcctcatcctgtcatgcgtcagagcgctgagcatcctaatgcagcaggaagtgcattagggcattataaaactgtgcgcctgcatacttctaatgggatccgtctgcttcttctctagggtagctataaccagcctctgggcctgtccagcacccagtcagataccctttttcttgattgtaccattcgaggacttcaggtggaagcatcagatacctgtgcccaatgtctgtctcgtatcttatccctgatgggt

SEQ ID NO: 20679 - DNA, 1107 bp, Homo sapiens
tgtatattctctaactaaatcctcagcatttcacaaataaggaaactgaagcctaggaaggttagctaggtaacttgactgaagtcatacaggcagtcagtagtaaaaatgatgtttaaattatttggccctaaggtccacattcttttcatttaccaacctgctccttgtactctttaggtttttagagactggagaaagaagtactgcaggtgcctggatctctggggcattcgccttatggtccatccagcttaggcatttgcttagcctactttatgtgggaggatttgaccatagaggccagggcatttcgggagaactgggagtgttaagaattgatggttcttacgttattcattcatattttcagaggtgacagaaaacttagttgagccaactctgcctggcctattccttctccagcagctgccagaccaggtcaaggttaagatggagaacacaagcgtggtattgtccatgaatagtcaaaagaggtgaggtctctcctgacacagaagatgggagagtgatagtgggagctgtatgttggtatctctgtaaccagcctagtatttgctgagcttgtctacggggagaaaggaagtagaaatggttacatccatgtagtgtgggaaaaattaaaaaaattattattatttttgagacggagtcttgctctgttgcccaggctggagttcagtggtgcgatcttggctcaccacaacctctgcctcccaggttcaagcgattctcctgcctcagcctcccgaatagctgggattataggcacgtgccaccacgcccggctaattttttgtattttagtagaggcagggtttcactgtgttggccaggatggtctcgatctcctgacctcgtgatccccctgcctcggcctcccaaagggctgggattacaagagtgagccactgcgcctggccaaaaaataattacttttaaaaaataaaagtaaaagaagtaggaatggcattccacatcttcctgagctggaatctgtctcggtccaggcacctgacttggactctgaagctgctgcagttcctgtaccaccgtgatgaggatcagctgccccttcgaagcttc

SEQ ID NO: 20680 - DNA, 1074 bp, Homo sapiens
tatttttagtagagatgaggtttcaccgtgttagtcaggatggtcttgatctcctgacctcatgatcctcccaccttggcctcccaaagtgctggggttacaggcgtgagccaccgcgcccggcaaggccaagtgctcttaatttttttcctttcccaggctaatctgtgaggtgagcttatgtaagatcaacagcaaagttctaaagagtggtcagctggtaagtatgccatgatcattcagatgcctcatttcctcctgggcgtaaagtgtgaaggagcttagggcttacatcctaggttctttgaccttagggggttccctcaagtcagtacccagtgttccagatcaccacattttgacctaaaacttccaaactttcttacatacaccttagaggcttatcatccccacaggaggacacctgcctagtggagctttcactggccctggacctgtgtctaaaggtgggcattagcagtcggcatctcactgctatcactgtggatgtgtggacactccatgctgaactgcatgagggcctcttccagagccaactgctgtgccagggcccaagcctagcatctaagcctgttccctgttcaggtaaagccccagtgattgagcttcttggctgccttgttctcagggtttgttttggaagtagaaaaaatagtggtctcactgcttatttagatgtgattcactagtcaccatggactttgaccctaaggatagttagaggaaatagggcatttgcttgtgctgagtggcagaaccagcattgagtgggcacctatcatgagttagacctgtactatgggttttttttttttcctttttttttaaaaaaaaagatggagtcttgctctgtcacccaggctggagtgcaatggcgtgatctcggctcactgcaacctttaaccttctgggttcaagtgattctcctgcctcagcctcctgagtagctgggattacagtcatccgccaccatgcctggctaatttttgtatttttagtagagacgggatttcgccgtgttagccaggatggtctcgatctcctgacctcgtg

SEQ ID NO: 20681 - DNA, 1050 bp, Homo sapiens
cgtggcttatttagcagctagcacacagagctttctccctcactgttttaggaaattgataacctgtggatttccagcaaactccttagccatgatcttccgtgagtaccctatattctcacttctcccctagaagagtactttggagttggtgtttgcagagtgacactcttctgcagaggcatcacaatccaaggaggaagggaggttgttgctgaagtcttcctgttagcctgggtgccattgtgttgtgaggaagatattgataactgctatgaaactaatctctgtgatttgagctatatttctaggaaggatgagaaagtgaatgtgagggtggggaatagactgctatgggagggatggacctggtggcagtgagatttctcttctgggcagacactatgtggcattgtgctttggagaagtgcgtatcagaacggacctacagaaagtttctgacctgtctgccccattctcccagagcgctggggtggatcaaaaggaactgtccttcagcccatccttattgaagatcttctgccaagtgagacaacttctcctgctatcctggactgtactttggcatggttggctttggagttatgggtagatttttctgtttttagggcataatgctaagagctgcccctctttctcatctggaaaggaagggcagttccttaacattaattattgttcatccttgcttcttccttccagctattctccattcatgtagatgctataaacatcatggttctcaaggtggatacctctgagtccttatggcatattcagatcagtagaagcagatttcttttggatagtgatgggaaaaggtaagcactggggagcagaggatctagccgtcctattcttgcctcagagttgcttcagggcctccttatcaaggtgttaagttctcattctgtgcagttggaggagatgctaagattagacatttccaattgccttgtcccttctagccaccagagcttgactggaggtaagtggtgaggaaagggaccaagttctcttttttttaaa

SEQ ID NO: 20682 - DNA, 1020 bp, Homo sapiens
aagcgccggccttggctggagcccgtggaccagcgcccacccggacgccggggcgggagcgggcggttccatcgaccctgagggtggaccaaggagactgagggttccacccgtggcatcacaattacctccgcggcggcgaggccagagaggcatttccaaggagacgcgggcgcactgcccctcccttgcttcctcctcttccctccttcctctcctagtttcttccctcccttcccgccctactccttccctcccttcccaccctactcctttcggctgctctggtgcccacccccagtgcctcgaggtcgaggagagctcctcggccccgcaggacggggaggattctgtacagatgagcataacttgtgagttttgagttaggcctttgtgcgccgattaacgcctcacggggaaagacgccataagcctcccactttctttcaccctatcaccctcctcattcattgtgtgtgttgtcagtcactcctgctgcaggaactctggactgctgctggtcagaggtctcctcctgtcctctggaactaaagagcagattgcttttctcagctctgaagagagttactaaattcgtctccccctttgtccttcctcccctcgtctccttcacaaacagagctgatgggtgtccgagctctgggggagctagtgagtggagagtaaacaggctctgaccctgcatgtgtgctttttttttttttttttttttttgagatggaatctcgctctgtcgcccaggctggagtgcagtggcgcaatatcggctcactgcaaactccacctcccgggttcaaacaattctcctgcctcagcctcctgagtagctgggattacaggcgcgcgccaccacgcccagctattttttttatttttttttatttttagtagagacggggtttcaccatgttggtcaggctggtcttgaactcctgacctcgtgatccgcccacctcggcctcccaaagtactgggattacaggcatgagccaccgcgcc

SEQ ID NO: 20683 - DNA, 1028 bp, Homo sapiens
ttgctaccccccttcccctccctccaggactaagaagcaagatttcccaggtgctctgaaagctaattacttactcatcgaaggatctcaaatcaaagctgacccagtcttcatatccttcaagttcctttccattcctcaaggctttgttttgtgtctatattgatcccacagccactgcacttgcccttgccacacttgatctcaagggcatcttggaagtatttgaccatttcttgagatatggggggaaaaagtctttgtattggcatcttggttccagactcccctttccaaacctagaaaaatacagtgacctttgagcatacccaagatccctttctcactgttgcctgtcccctaactcacctccccacagcccctatcctttccccctcaacaaaaacaaaatctaccttacttgaggaattaggtaggtaaggaatgatcacattggagtttgggattaaaaacaccaaaaaaaaaaaaatgcatttggttctctctacactggctaagaatattgctctacactgtaagttttaaacgttacgtttctgtatgaatgtagtgtgggtttgagtagcattgtgtgtgagtggccccacaggtacattcaccctctagtgcagcccctcagtttaatgaaggaaaaaaaaacaaacacaaagccttaagctctttgagtacttcctttaccaaatgagcatggttctaacacctggagctgggcctacattggaaacaagcccctcctgccctctgtccattcttagagcataccttcatccactccatgctcagcacgtctcatcccaagcgacaattagttggctagaaacacttttctgtaattttaaacttagactgttttgttacaaatttttgcaccattctgttaaagatgcagaattgggcttttttattttttacagatgaaataagcccttacctttcctcttgtctctggggaatgtcagctgatggttcttatttaaggttttgcattttgttcactatccactact

SEQ ID NO: 20684 - DNA, 1033 bp, Homo sapiens
atgcccagctgagaaaacttttttttttttttttttttttgagatggagtctcgctctgtcacccaggctggagtgcagtggtgcaatctttgctcactgcaacctccacctgccgggttcaagcaattctcctgcctcagcctcccaagtagctgggactacaagtgcgctccaccatcccaggctaattttttgtatttttagtagagacagggtttcaccatgctgggcaggctggtcttgaactcctgacctcatgatccacccgcctcggcctcccaaagtgccaggattacaggcatgagccactgcgcccagcagaaaactttttttaagagttaggcttaagtctggtatgtgaggtagatggtgctgtattcccagaatgataccccttttttgttcaatatactgtactcatctttggggttcttccttaacaaagctactgtagccttgtggccaccctccctaccctcatttcactttatttctgaatcctttgacagccctcttcaccatttcagcatcagtggaggcaggacaaagaaaactaatcaatgtggataagtgtccccttccatactcctgaatgaggtcaagcttcccccttgcctctgctaaaaaaaacctcagagttggtactaacttggaacaaagggactcttctactcatcaaggtactatacgacttctacttggatttcaaggagagaagcccaccagcatggaggtgggctaggtttaaagcactgtgctaggagtattatatgagattatgaccaataagacacataggtacagtggttgaccaaggcagcttctgttggaattctgatgtcttgagtttagggacttgctctcaatcagtgatcccagacttttttgccagtatttgaaagcacagacctgttttgggaggtggggatgcctggctctttttgcccagatctgcttgtgagcatgggcccaaatctctctgcccctcctgacttgagctttcttttcctgcttcccagagcaggagttgct

SEQ ID NO: 20685 - DNA, 1077 bp, Homo sapiens
tctcccgagtagctgggactacaggtgtgagccaccatgcccagctaatttcattgtggttttaacttgcatttctctgacagttaccaatgttgagcattttttcacgtacctattggccatttgtatgtctttggagcagtgtcttttgagttctattcccatttcttaattgggttgttttgttgctgttgagtcatttctttatgtattttggatattaaccccttattggatgtatggtttgcaaatattttctctctccctgtagattgtctctgaactctgtttttgtttctttgggttttttttttgagacggagtttcattcctgtcatccaggttggagtccaatggtgcgatctcggctcactgcaacctccgcctcccaagttcaggcgattctcctgctgcagccttccgagtagctggtattacaggtgcctgccaccacgaccacctaatttgtgtatatttagtagagatggggtttctctatgttagctaggctggtctcgaactactgacctcaggtgatctgcccacatcagtctcccaaagtgctggaattactgtcatgagccaccgcacccatcctcttcaatattttatacttattagtgtatgggtctttcacctctttgaataaatttattcccaagccttttttttttggtagttattgtgagattgttttatttatttcttttttggatagtttgttcttagtacatagaaacactgctgatttttatacattgatttccttatgctactacttaactgaatttgttcattagttctaatagttttttggagtctttagcgttttctatatgtaagatcatgtcatctgcagacagagaaaattttacttcctttccgatttagatgtctttttatttatttttcttgcctaattgctctgtctgggacttacagtactatgttgaataaaagtggctggagtgggctgaggcggatagatcatgaggtcaggagatcgagaccatcctggccagtatggtgaaaccccgtctctactaaaaatataaaaattagccggacatggtggca

SEQ ID NO: 20686 - DNA, 1027 bp, Homo sapiens
ggaggctgtggtgggagaatcacctgagcccgggaagtcgaggctgcagtgattgcatcactgtgctccagcccgggcaacagagtgagatgctgtcttaaaaacaaaagaagtctgggtgcggtggcttacacctgtaagcagtttgggaggccgaagcaggaggatcacttgaggtcaggagttcgagaccagtctgcccaacacggcgaaaccctgtctatactaaaaatacaaaagttaactgggcacgatggcatgtgcctgtaatcccatctacttggcaggctgaggtgggagaatcgcttgaagtggaggttgccgtgatatgagatcccatcactgtactccagggtaggtaacagaggaggactgtctcaaaaagaaaaggaaatcaataggacactgaggacacgtctcttttgctgtataggaattttagggtttttttttttttttgaaacagggtctcactctattgcccaggctgaagtgcagtggtgtgatcttgactcactgcaaccttggcctccctggttcacgtgattctcctgcctcagcctcccaagtacctgggattacaggcgcgtgccaccacacctgtctaatttttgtatttttagtggagatggggtttcaccacgttggccagactggtctcaaactcctgatctcaagtgatctgcccacctcagcctcccgaagtgctgggattacaggcatgagccaccatgcccagctagtatgttattttaatagaaagttacatatttttggaagtaacccttataagatggataaagagggatagaaacaagggacataatttgcctttcttgaagaagaagacttgtaggtccccttctgctttcttcaaactttcctgtcagtattgttttttgaaggttaccctgaaaagtggacttacaagcaaaatatttttaaaattttaattttatttggatttttttgttacttcttaaaatgttgtgggtataagcaaaatcttatctctttaaaatgcaaa

SEQ ID NO: 20687 - DNA, 1075 bp, Homo sapiens
agaacttttctccagagagacaaaaagaacctttcattttaagaaaagtcctttgactatttccatagtccctggcaaaattaagttggaaaaggcagctttttcagccagatatatttttatttttgcctcttctccaagctgaaccagtgtcccaactgaaatgtgtcattcttatcagtgatagtatattttgggagaaattgttccttagtgcgcctagaagtaagaagcttatgccacttcagcctgcacatcaattttaatagctctctaaaattgtttataccaactccctccacctcacatctgtccacatctgctcatctttcagttcctcacaactagttaagaaagtctcataggccgggtgcggtggctcacgcctgtcatcccagcactttgggaggccaaggcatgcagatcacctgaggtcgggagttcgagaccagcctgaccaacatggagaaaccccgtctgtgaaaaatacaaaattagccaggtgtggtggctcatgcctgtaatcctagctactcgggaagctgaggcaggagaatcgcttgaacgcgggaggcggaggttgctgtgagccgagatcgtgccatggcactccagcatgggcaacaagagtgaaactccgtctcaaaaaaaaaaaaaagaaagtatcattgctcaaccagagaaatgccagtctttatcaaagtcatagttacatacaacagcagtctttggtatgtgtggaagtttgcattactttgttttcttattgtttaaagagcctttcttgccaggtgtggtgactcacacctataatcctagaactttgggaggccaaggcaggaggatctcctgagcctaggagttcaagaccagcctgggcaacagccgagatcttgtttctacaaaaaataaaataattacctgagtgtggtggcaatcacctgtagtcccagcttactcaggagattgaggcaggaggatcacttgagcctaggagtttgaggctgcagtgagctatagtggtgcaactgcactgaagcctgggtgacagagtgagccctgtctcttaaaaaaa

SEQ ID NO: 20688 - DNA, 1033 bp, Homo sapiens
gttgatggcagaacagcctttcttcttaccaccctttgcgggagccattctgctaggcccaaattggaaagcagtcatcactttaaagctgggggtttctggctgggcgcagtggctcatgtctataatcccagcactttgggaggccgaggtgggtggatcacttgaggtcaggagtttgagaccagcctggccaacatggtgaaaccttatctctactaaaaatacaaaaattagtggggtgtggtggcagacacttgtaatcccagctactcgggaggctgaagcaggagaattgcttgaacctgggaggcagaggttgcagtaagccgagatcgcaccattgccgatcacaccattgcacctgggccacagagtaagactctttctcagaaaaaaaagctgggggtttctttaagtgctgtttgctgggaagatattacctgaacaatcactttttttctttttctttttttctttttttttttttgcattcagcaaagtgtttttgaggatcagttgctgaactgaatgaaaatcagattttatgccacttgcagaattgggatgatttagacaacattcgtgttgcttcaaaggagaagcataagcattattagtcataacttaagatttacttccttccaaaagctaagcacttctaccattggcattttatttatcttcattcttattatgtaaaggataggacttaatctactttaaaaggaaagatatatcaagtctgtgagaagttgaagacagctcatcctaaattaggagggaaaagtcccatttactgggttcctgtatggaccctctgccttacccagctattcagctgggaatggttttactagaagaagaagaacaacaataataataataataatagtaaagtgctgggattacaggcgtgagccaccatgcccagcctgttttactattatgaagacattaatttagcagctgtaaagatactggtttggcttttgcttatcttactctcccagaactttttcttttctttttt

SEQ ID NO: 20689 - DNA, 1026 bp, Homo sapiens
gataatgggataggaaaccatttcagctgtggaaagtaatagggattacgaagcttactttaccttttttaaaaagaagatttcaaataccttagaatagacatgttactaaaaagtagattcacagtaatcctgtgtcaggttttgggtttttattactcacttgtcccttaaggctccatgagttgtatttaaattgggagggaaaggggatcccccagatgttgactagttaacttgctactgagagtgaactgttaaaaatcactgattgaagcctttacagttagctagtatataaaacagagttagctagtatataaaacaaagttagctagtatataaaacaaagttagctagtatataaaacaaagttagctagtatataaaacagagttagctagtatgtaaaacaaagttagctagtatataaaacaaagttagctagtatataaaacagagttagctagtatataaaacaaagtgcactttgatatctaaggtataggaagctggggaagtgaccaaaaaaaccagttggaaggcggggtgcaatggcttgctcctgtaatcccagcactttgggaggctgaggtgggtggatcacttgaagtcagaagttaaagaccaacatggtgaaaaccccgtctctaccaaaacataaaaaaattagctgggcgtggtggtgcactcctgtagtcccagctgcttgggaggctgaggtgggagaattgctggaacccgggaggcagaggttgcagtgagccaaggttgtaccactgcactccaacctgggtgacacagtgagaccctgtctcaaaaaaacaaaaacaaaaacaaaaaaaaaccagttggaggctgtacaatttcaacttgcttctgtcaaaaaacaagtttgcccttctatttgatatctgggtggtttttatgttctctacccatgggtgagcagtaagtacagctttataaagttatacttcactcacttttttatattactattttttaatttttatgttttgtaga

SEQ ID NO: 20690 - DNA, 1731 bp, Homo sapiens
cccagtctgttctcaaactcctaagctcaggcaattcacctgctttggcctcccaaagtgctgggatttcaggcgtgagccactgcacccagcctcctttggagtttttaagtacgagtatgatatgagtcgatttgtgactagaaagaatgttcagttgctatgttagaaatggattgtagtgcgggcacagtggttcacgcctgtaatcccagcactttgggaggccaaggcgggcggatcaccgaggtcaggagttcgagaccagccagaccaacatggagaaaccccatctctactaaaaatacaaaattagctgggcgtggtggcacatgcctgtaatcccagctactcgggaggctgaggcaggagaattgcttgaacctgggttgcggtgagctgagatcatgccattgcaatccagcttggtcaacaagagcgaaactccacctcaaaaagaaatgggttgtagaaggaagcaaggagaccagtaacaaggctctttgcacgaatcaaatgagactttatggtaacttggactggggtgatggtataaaagctgtggaaagatgacagatttggcatatcttttggaagtgaagttgacagggcttgctttgggattgttacacctttggaagtgaggtaataaggaatcatggataacttctatattattgactggagcaaccagggaggtaaatggttgttgctgttaattgatatgggtaagactagcagaatataattgtcaaaaattcttggacagtggtggctcatgcctgtaacccagcactttgggggtctgagacaagaggatcacctgagcccaggagtttcagacgagcctcggcaagatagagagaccctgtgtctacaaaaaaataagaaaattagccaggtgtggtagtacatgcctgtggtcccaactacttgaggggctgaggtgggaggatggcttgagcccagggggtggaggttgcagtgagctgtgattgtgccattgcacttcagccttggcaacagagtgataacttgtctaaaattaaaaaaaaaaaaaaaattctcggccgggcgtggtggctcacgcctttaatcccagcactttgggaggccgaggcgggtggatcatgaggttaggagatcgagaccatcctggctaacacggtgaaaccctgtctctgctaaaaatacaaaaaatgagctgggtgtggtggcaggcgcctgtagtcccagctacttgggaggctgaggcaggagaatggcatgaacctgggaggcagagcttgtagtgagccgagattgtgccactgcactccagcctgggcgacagagcaagactccgtctcaaaaaaaaaaaaaaaaaaaattctcttttggtcctgccaagtttgagatacttgttaggtatccaaatggagaaattagataggcagttggatagaaatgcctggcattcctaggagaattctgagctgaaatagatagaatttgaagtcatggtatttaatcaggaggtcatctacagatggtttgtggctagagaagagcaatttgaaagagaaggaatagctagtgagataggtggaaaacccagaaagtgatgttttagaaggcaagtaaagaagtgtttcaagaagggagtggtcagcctgggtaacatagtaagatcctgtgtctacaaaaaatagaaaattagctgtttgtggtggcacatgcctatggcagtcc

SEQ ID NO: 20691 - DNA, 1477 bp, Homo sapiens
attttattttttttttaatagagatggggttttgccatgttgcccaggctggtctcaaactcctgggctcaagccatctgcttacctcagccttccacagtgctgggactacaggtgttagccaccatgcccggcctaaactatgagatttaaaagaagataagagaaaatccttattacattgagttaggcaaagagttcttagatatgacaccaaaagcaagatccataaaaataaaaagttgataaattggatttcatcaaaattaaaaacttttgctttgcagaagactgtcaagtagatgaaaatataagcaacacactgggagaaatgttcgccaattatgtatcagacatacagctcatattaagaatgtataggccgggtgtggtggctcacacctgtaatcccagcactttgggagaccgaggcagctggatcacgaggttgggagatcaagaccatcccggctaacacggtgaaaccgcttctctactaaaaaacaaagaattagccaggcgtggttgcgggcacctgtagtcccagctgcttgggaggccgaggtaggagaatggcgtaaacctgggaggcggagcttgtggtgagccaagatcgcgccactgcactccagcctgggcaacagagtgagacacgctctcaaaaaaaaaaaaaaaaaagaatgtataaagaggctgggcgaagtggcttactcctgtaatcccagcactttgggaggccgaggtgggtggatcacgaggtcaggagatggagactatcctggttaacacagtgaaacctcatctctactaaaaatacaaaaaattagccaggcatggtggcttgcgcctgtagtcccggctactcgggaggctgaggcaggagaatttcttgaacctgggaggtgaaggttgcagtgagccgagatcgcgccactgcactccaactccagcttgggagacagagtgagactcggtctcaaaaaaaaaaatttaaaaaaaatgacctaagtatttatccaagtgaaataaaaatctgtgttcacaaaaaaacttgtatgtgactgtttacagcagctttatttatagtcaccacaaactggaaacaacctgaatgactctcagctggggaatggataaacaaactaatgtatctacacaatggaatactactcagcaataaaaaggaactattcatatatgcaataacatgaatgaaactcattggtattatgcttagtaaaagaaacaaaactcaaaaggctatggtctgtatgattgcatttgtatgatgttctggggaaaactcaactataaggacagtggggaacagatcagtgattgcctttgggtaagactagagagacagtgggccgggcgcagtggtttatgcctgtaatcccagcactttgggaggccgagttggggcggatcacctgaggtcgggagtttgagaccagcctgagcaacatggagaaac

SEQ ID NO: 20692 - DNA, 1171 bp, Homo sapiens
tagcggaaggatacatgactttgtggggtgggctctgactgtgggagacggaagggcgtgggggaggtacagtttgaggtgatgatgggagaatttggggcacgggtggcccggtcgccggccgcagagctggacagcttggtggagggggacggggttgcgtgctgtggagtgaagcagcccatttgtatcatcccttcctccaggagcttttggtcgcctctcctttccgcttctttcagagaatgattgcggggggagggtggtggaggatgaaagctctgctggagcttaagaagccacctctgaaccaggcaggggaagggtcggtctcccggagtaataggctgctctgggtagaggatgggagtcgggaaccctcttttgaaagccgggaggggtctagggaaaagagctaggggcttagagtcaggcaggttcgaaaggaagtccaccattgataaagctgttaggtaaccttgggcaggtcccacttaacctttctgaacaccaggaagatgtcatgcttcaaacgggctattgcaagcatcacctatgtaattgagattgtttatgcaaattgtgaattgtaagtactatgttgatgttaatgtatcaccaacaatgttagtggaatttagaccttaccgttgttaatggaatgactgatttctctgttaagataagaagcgtattgtttgtaaaacctcagtagacacatatgtgctttctttatgggcacagcagaccatgtgcagaactaccagttctgtaatgtgataaattagccatcagacttctgtaggaaaaataccgtactccggcgtttttacaaacggtttgcagctcctcacccgaaaggatggagggccaatctattaaaatattttctgaacatagctaactcatgttgccttataacacagttggcactaatgtgctttaacgagttgagaaaaggccgggtgcagtggctcatgtctgtaatcccagcactttgggaggccgaggcgggcggatcacgaggtcagaagttggagaccagcctagccaacgtagtgaaatcccgtctctactaaaaatacaaaaaatcagccgggtgtggtggcgggcgcctgtaatcccagctgcttgggaagctgaggcaggggaatcactcgaacccgggagg

SEQ ID NO: 20693 - DNA, 1077 bp, Homo sapiens
gtgcatatacacataatcaaagatgaagggaggacagagccaagctgaaccagtgagacgagaacaaaatcactttaggcagatcacctggatttgcagaataaaactaagatcctcactcccaaaggagggacctcatctgtgggaaacccccaaagtccaggagaacagggacagatcttgatctctgtgaacacaaggtgggtagaaagttcaagtctcaatatcagacatccaggccctcccccacagacaggcaagtggtttattccactctgcctttctaggggcactttaattaaaatcagtccacccaactacaggaggcagctgcacaggctgcattggggcccatctcactgcaaatggcaagtgagatgcccagctgcagatccttgtacgctctgcactcaatgctgtttgagtaaaaatcacttggctggattttagaaatgccaaactatttgctctgtgaccctgatttgcttccacattccacttcccatctcagctgctttttaatctttctctttggctaatagaaatcgagataaatatgctggacgagaagctgatcaagtttctggccttgcagagaatacatcagcttttcccctcccgggtccaaccttcaccgggcagtgtcgggacacatcagctggcttctggagggcaccacatagaaggtgcgcatgtacacacctgtcaccacatcatcagatctcccctctacgtgtgcgaatggtcaccttgcctccatggagaatctgagcttccagtatctcaaacctccttgtgtgcttttcatgggcttaataaagcaccatggtttttttctgaagagagcaggaacaagatggcaaccacagctttctgatcagacttggggaagtctgctgtaactttctttcatatataagtccacttcgagacacagcaaagcagctaccagtacctttgggtatatgtagtgtactttctgcttacttgctttcaaatatttgaattagaagggcttcccgactgagtgcagtggctcacacctgtaatcccagcactttgggaggctgaggcggg

SEQ ID NO: 20694 - DNA, 1043 bp, Homo sapiens
tcaaaatgcagatcccaagctctgttggccagagggagtgttggcctgctgagggtacctataagtcttgcttgggaatggaaatggaattctatcaggagtcaagcacaccctttgtgagcattcatgatgggacctcggaaactgcttgtcagctctgctgcagccctggccactgtggcaggaaggaccggcgcctctcaggcttctcacccccctctcctctccttccattgcagtggctctgtagtgttgttgcgctccagtgcagcatattgaaacatttatctgctaagcagatgccttcgcattgggactctgaacagacagagaaggctgatattaagcctgttattgtgactgacagctcagtcaccacctccctgcaaacagctgacaagacacctacaccttcccactaccccttgtcctgcccctcagggattagcacccagaattccctgagctgctctccaccccaccagtccccagccctagaggacatcggctgcagttcttgtgcggaaaaatccaagaaaaccccttgtgggactgccaatgggccagtgaacacagaggtgaaagctaatggcccacacctctacagcagccctactgattccacggacccccggcgacttccaggcgctaacaccccactaccaggcctctcacaccggcaaggctggccccggcccctcacgccaccagcggctgggggccttcagaaccacaccgtcggcatcattgtgaagacagagaatgccactggccccagctcttgcccccagaggagtttggttcctgtcccaagcctgcccccttccattcccagctcttgtgccagcatcgagaacaccagcactttgcaaagaaagactgtccaatcacagataggacctccgttgacagattcaaggccactgggctcacccccaaacgccacccgggtgctcactcccccgcaagcagcaggagatggtatcttggccacaacagccaaccaacgattcagctcaccagcgccatcgtcaggtgagtgc

SEQ ID NO: 20695 - DNA, 1063 bp, Homo sapiens
tgcctaatctttctttagcttcccttccttcagctttgataattcagtactggcttcaagaacatggtttattattttctactttgagaactcttgtgggtaacaagagctaaattctcccttattaaaaaaggaagtaggtgtgcttgcacccaaattatgattgacccaaccctcaaattacaggctatggattagaatttgtctgtgcattgtaatccacccccctgtgctccccacactaattatacaccaagcaactttcctatgttgtgacctcacctctatttgcctggtccccgaacatgatgtcacaatgaatgatgacttccttggttgcagaaacaggatgagatgattaagattgtggtttatgtgtgtaacagtttcagcctttaagaaagaaagtaaacaagcagacattatttttcaaatacgtgcataagggttcatatttaaaagcaagccaaagccaggtcaaccacctaaccacagctgtagttaaatttctccataaaccaggctgtcttccagcctctccaccttccaagatcctttcctgtgcatccctaattaggttagagcagggcctgttagaggcacctgccagccaggagccctctcaaacttgccactcaaaaaagctggacctgaaaaggtttaggggagctgaaggaaaaggggtaaagacggtggagaaaaggaaatattatgttagtgcccatcgtgtgccaggtgttttaattacgttatcccattatctatccatccagccatagatggataccgaatgctggccgtaggtttccattttagaaaggaagaaacggaggctcaaaaatgtagattaactttcccaaggactcaaaggtattgacagaaccaatgtttgaaccaaattctctcattccaaacctctgttacctcttcatcagttttctagaaggagagctacttgttggggattacagtatgcccttttctaacatggcacttctcctgagatgcctctcttacctttcacatggacctctgcctaccagtgccaagtctgccttttcca

SEQ ID NO: 20696 - DNA, 1040 bp, Homo sapiens
attgatgcaattttcaaagtaatgaaaaacttgacttgctcactcagagagtgagtcccttttgctctgctgcctactttcccttttgctacaatcgtactacataaatgctcactaaactacttaaaagccggaggctgacccatttcctcttctcactgccgtgtaattcctagtggtattacagatgagagacatgcaaaggtaaacagtagttggggaacaaaaatgatatctgggttattccaagtggatgatacctttgttaacacagacacaaggtgaaaatttcttttcccctaattacatttgctttcttttaagttagtgactttggtgtttaatttttgcctctcccctgttttctgacaaattttatgggatatctcccaagaaatgtttctcagccttgacaggacaaaagacatacagagtaacagcagggcagggagcaactccgtgcctgaatgtagcgtcagtctttcctactgatctgggctctctgcgtgaggctcgttttgaaataagcttgagtgagcaaaagaggactctctgcagggtttgaatttaacggtagcccaaagacatcactttacctccaagccaggcagggataggggaacctctcagaattactagcaagcttgagttccaggtggacccctgtttgtggcagcacaagcatcttttttactcagctatggtcctcagagggatgttgaatattatttttctcctgtctgcatttgtgcagagaacagagcagagaaactaatgaaatgcacagagcttcaagtgaatttaaagaagcctctgcattatgaaataaggcaatgatgacctactcttgcttttctttccactacccctaggctcctgtgatcagctgagtgctcgttaattcccacgttcactaaaccatcatagttctgctgattctcagctttagagggaaactctacagtgaactttttcaattagcagtcatcaattactggtcagaatacattataattgtgaaaattatgctccattaatct

SEQ ID NO: 20697 - DNA, 1050 bp, Homo sapiens
cagactaattcctcaacaacacaatttgggtcctaatcattttaatacatcacgtagtagatccccagaaactgtttgctgaatgaataagtggatgctatttataaggccatgatccttgtaaattctcactaggctgcctcttgttcctgcccctgaagctgctgaagacctgcgttcccggtctgaattcactctaaactggacccagaggaggtgggagcagagaaattcagggagcagcacagtgtggtgaaaagtagactaggggtcatcctgaagcggcggccagagaagacacaaagacatgagcatcggatcaccatgcctttcttggccatccagaaaagattcggccttaacatagatcaatggtggacaatccagagtgctgaacagccctacaagattgctgctcgatgccatgcttttgaaaaagaatggatagaatgtgcatatggaatcagtgttatccgggcagagaaagagtgcaagatagaatctgatgatttcgtagagtgtttgcttcggcagaaaacgatgagacgtgcaggtaccatcaggaagcagcaggataagctgataaaggaagggaagtacacccctccacctcaccacattggcaaggaggagcctcagccctgagcagagcagctgctgatgtctggaggctgaatttcctgttctctgttcctcactggaaagattgtttatggaaaacctccttgtcaaagtgtataaaaataaaggattgctccatcctaaaaaaaaaacaaaaagaagaagaagaagaaaaaaaaaaaggaaaagaaaagtagagtggggctgtcgtcctggccatcagagacttaacctctctgggctcagtgtcttcatctatatatggtcattagtagagcagatcggggttgaaaactcaaatgcccacagaggccaggaaaataatgtagacaaggcaacaaagggggaaggtggcaccctccctttgttggagagcaggcatgctccttgcacagcgctgcccttcttgcccgctgatcatcgccaatt

SEQ ID NO: 20698 - DNA, 1031 bp, Homo sapiens
ttcttccaacctccctgcccccacacacttatcccagacacaacaccatgtggtctggaggtcccagcccccaccctaaaaaggttatccctgagaactccaccagacttgggagcccaagtgcagtgcctggtgctgctcccatctgccgccccccttctctcctgcaattggtttgtactcactgggctgtgctctcccctgtttacccgatgtatggaaataaaggcccttttcctcctggctgcgccagttttcctgcctgttccttcaggctcaggcaaagtctggattggtcctgggggtggtgggcagaggcaggattctgatggggaccgtgagggcatcaccctggtctctggcctgctccccaaagtgtcagaccagtgccacttaaagagcctaggcagctcattttggggcaggcagaggtagtggaatgaggggattggccaaggaagacacaagccccaccttttatgtgaagagcctagggactgtgattcaggttagcaagggtggcagagactccaagcctcatcctccctagcctccacaagggaatgttgaggtccctctgattgttaaatctcaccaattacagagattctcttctcttctcttctcttcctccttccgtccctccctctctccctctctctctctctttctttctttcattctctttctttttggattcaagcccttctcattagaacattttttaaaagcttaattttagccatttcaaaggtgactttttgatcaaaacttggcagaactagctcgggcccacagggcaatgtgaataggttgggagtgctgtctctgccctgctcggtccctgtcttcatgccctactccatgctttgttccttcattgacagctaagaggcagctcatgcagaaaggcaagaaacaaatgacacccctcctcctcttctaccttctaccttctcattctgtagtgtggccagttataatccctgaatgaataaagtagtttggacagatgggtgggaaaaaatagc

SEQ ID NO: 20699 - DNA, 1034 bp, Homo sapiens
catagatctcaagcctaggagtacaaggctcccagggctacagcccacacagcgccacaccctacagcagacccaggagatgcctgactccctccccagccctcccaccaaaggcccacacatgggcgtcaccttggttctactcatcttgtaaagttctaatgaatagaaattagcaactgctgagtgacagcctccccctggctctcctgcctcccccagctcttctccctgtggggagggagatctagcagttaggccctttatgcccacacccccaccatggaagaagggcagagcctgactcattggaatcccattgttgccagtttctctggtgcgtggtgacattttagatcaccctgcttatgtgaagctgtttttggcatgctgccctcccagggcaagcttgctgcttcccaggaggtatgtcccccgagtgcagcccctggggcacagacatttgtctcccagatgcatgaactaacacacctgtcgcatgcttgtgctgtggagcggctggacacctaggctgactttgaatggattataccaaacggactgatgtaagaccttttaaggaatggagcaagtggaatggctcagccctgctctgtcacttcccccatgcagcagatggttactgggtgctctgggaggaacaggaagcatctctgttgtaccaaggaaccagtgttggctccatagtaagacaagagtcagccgagcatggttattcacacctgtaatcccagcactttgggaggctgaggcagacagatcacctgaggttaggagttgagaccagcctggccaagatggtgaaaccccgtctctactaaaaatacaaaaattagctgggcgtggtggcgcatgcctatagtcccagctacttgggaggcagaggcaggagaatcgcttgaacccgggaggctcggaggttgcaatgaaccgagatcgcaccactgcactccagcctgggctacagagcgagactccatctcaaaaaatatatatatatatgagtcaatatt

SEQ ID NO: 20700 - DNA, 1085 bp, Homo sapiens
ttctcccgtttagctgcatttccgatggcacctgccccactctggggagagcagagatttaaaggctgtggtgccttgttactatgccagagattttctcataaaacccacccggggaatggtttggagagaaagagatttgtagtcttaggctgaggagacagtcacgaggaaggaaggccagcagtgcggggtagcaccaggccatggagaagctcccagggctgccctaggtggaccctagatctgcccccttcccaccttagggctggggcccatcctgcaggcaggtctggggcagcgcagggaccctgctgctttggggcaggggagaggtgccaggggcagcccgcatcagattttgaggacagtgccatcacgcatcccactacctggtctcaaccagccagagctggctcttgctgagggaagagaggtcttcagctaaggggtccaccttgggttgccgattgatttcatctgtttcctctggaccccttgcccaccattttccttctatttccagtttgcaggacatggtgacaaagtatcagaaaagaaagaataaactgtgaggactggagcgcatgtgctctctgcctgtcctcgcgggtgtctaaccacccctaacactggctcccaccctggggccgctgcacgcagcatgtggatacagcctccccacactcccgcctcactggtctctaacgctaacatgctgactctatcctcgggggaggcagggagcgggcaatgaggtgtgctccccagaaggctggggctggcccgtgcacccttggtgggcaggatgggggggctcctgccgaaaggaaagcgcagcctatttgagaagtttaccttcctgagctccagcacattcctccctcaaaaaccaagtgtggccacctccctggcctatttctctggggggaaaagtctgtttgggctggatctgtccacatccttgggctccttgggagcctgagctgcctgaaagaagcgggcgtgtttcatctttaaaggtccactaccttctcttggcagacaagggtagaaggtgaggggcatctcccagtttcttgttt

SEQ ID NO: 20701 - DNA, 1024 bp, Homo sapiens
gggtagggtgggcttgctacctggggcctccccagaccagttttccccagtcctcttcccttctccactggttgggtagctccgtatcttcctcttgcatgtcagggtggcggccactagggggcagcaggcaccgtggtaacgaatgggctgcagctttggcacttgcgctcggggacttggcctggcttggaggagctctgctccatccttcaagatgacttacgttggaggatggcgattcgagcacctcttcaccccctttttctccagtttagggaaaggggatgctggcgctgaacagcaccttgggctttggctttggccccttctgggatgtgaagggccccaggctgctcagctggagtgagaaagtcctggcaggtggtgggtgtatggaggaatgggtgcccaggcgtgaggctccatgcgagcgaccccaagaagtggcatccctgcccaggaggagccaggctctaggttagagaagttttctcgagaatgtggaggacagacaggcgggcaggcgtgtggctgtgtgttgagggaagttacttcactctgaggcggtgacaagcctagctttcctctaacctacccagccccaactgcaagcggaaagctccgggtgtcagcacagcgatcttctcaaacaatgtctgttagcgcctcagagcttccagtgttttccggcggggggggggggggggggggagggtgtgtttgcgcacacacacatgtgcacaaatgtctttgcgggtctctttctgtgtgtgtcagtgtgattacacccacaaacatactccctggagactgtgtgtgtgtgcgtttgtcccaagtctgactgtggttgtgttttcttgcctactcatcctcacaacacccccgccccacggtccctccgaggcggcgagctctattgatgactgtttgctaacacactgtttttctttgcatgctgcatgctggtcctttgccttacagaagctgctgaaggtaaaaccttgtttcttgttagctttcc

SEQ ID NO: 20702 - DNA, 1084 bp, Homo sapiens
tttattgtggatttcagcagctaacatttgaaagcaatgtctgtgagcagaacataaaacttattctagagtgcttagcaaggtctcatgcttgaggaattatcgtacttggagcttttaatcagctactgttggattcggcgaatcgattggatctgcgaagtctgggcatgagagccccactctctccaatgtttatagtctcctccatgatggtcacattccaagatatactgatacccacgatatccaggatattggtagcaaacccagctaggaaattcaaagtacatttcattattaaaactaattaggaatctggttaataccccaaaacctgagcctctttactcaacacaatggtatgagatgcttttaggcttagaaaaaatagccatcctaaatgtgtcaggcactatttgtaagcataatatggctatagctagttaattagccttaatcatcaaaacaggtataagtagtcaacgtaaattcttccatagaggcatgtctgggggagataaatctgcaacctaaagtggtagttggtataaagaaattgagattcaaaattatgtagaactagaatgtgacatctataccgatacgtatgaaatctgattaaaacataactattgatgcaacctcaggagttactttgaagtatattccaaccctgtttttgtacttacgccccactttgtatcttcatggagccgacttcgttgttgaaccagcccatggcttgcaaggaggggtagtcgtcagagatctcccactggcgtccaataaagttttccttctcaaagatggtcatcttagactccttatgattctgtaattcagaaattgttttaaaatgtttagtactagtgctatggctatcattcttcatgtttttcaaaattgaaacacttttggattatacaaggaagcacatgataatttaaaaagattaaggcaacagatttgtgagaaaaaagttacccataattttgtttattccaatttaaataccataacattttgaatgtacaaataactgatatactattttggaacaatgaagaggatttgacagtga

SEQ ID NO: 20703 - DNA, 1032 bp, Homo sapiens
cagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcattaaaaaaaaaaaagatctgaattttccctaatgtgacttgttagtttctctctgtatttcctgccagtgtaaatgtgaaagctttgcttgcattacgttttagaaatgcattttgcacactcgaattttgccgaagctccgtgaaaaggttagatctaagtagatgaataaagctatgcacatgttttgaaagtttaatttgtgtgtcattaccaaaagtgaccgatttgtccttactactttgctgttgttagctttaccatctttggaaacttggctcaaagttacatagttctgggctagctcatcagtggaactaggagagaggaaaactggcacctattttaataaagttcaatttaaacgagagcttgacttgtatctattaaagagcttttcttgaaacagggcagttttatcagctttacaaatcattggatgctcttccttagtaatattttggtttatttgatcaaatagaaatggaaagtaattcaaactgaaagacccttttttgtcatatggaacttggtgacgattttttgtcttaaagctggttta

SEQ ID NO: 20704 - DNA, 1178 bp, Homo sapiens
ttaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaatagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaaattggaaacgccatgtagtaatgcctgagatagtcgatggttcttaccacctcac

SEQ ID NO: 20705 - DNA, 2302 bp, Homo sapiens
aaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagttgatctgttttctgattattttgtgtaagcttctaaacaaacttcagctgtgattaatttagcacatttaaataacgtgttattgtttggtataaagaattttccttcaactcagagtattagtactgtagcataaaccaaatacagtctagaggggatttttaacatccctccattataaagactgaaaaaggggtgtgtgtgtgtgtgtgtgtttatgtatgtatgtatgtgtgtgtgaggaaaagatggagatattaaaaattagtaaatgaatgtgtataagacattagtattcagagaatgaacttgtatttattttgtgccatttgttttcattacacagaaaaaagtcaggtggtttaaatccttaaaagggtagtattgaaaaatggcactaagaatgaaattatgacctatttttttaatagctatgaagatactaattatgggtgaagatttctttttaaatctgttttgattattgtaggcttctgtgtcacataccactcttgtaggtgtcctcaataatccccttttcccacaaaatacacagggtgtattatctttctctttattcacccccactttgctgaactgaagttaattacatagcctttcttctaacctccttagtaatgaaccttcacataaagtgtatttacagcgtctgtggtagccagcccttcctcctctactttctaggaggggatagccaataactaggaatttaatgacagatttttttttctttgaaataaatggccagagtttctccattttagaattttgttgtcctccttaatcatctgcttacctagtcattactcaatctgcagaaacttcataaaggaaaagtgctgcattgtttttacaaataacagtttgtagggaaaatatgacaaacctcaactatgggagttgtccacaatacaaaattttgaaaaaacattacatagtgataatatcatacttggttgttaggcttgttgcttccccacatcagaggcatctaatgatttatcttttgtaattgctgtgaacttttttaaataagccatttagtgtgaaattgtcatgtatcaaatggctattggaaatggactttactcaattttaattccactgtaaataaggacggagtcattcctacaaggctctcttcagagaaatagattaaaagtccaatttccaggtattattagtatagttatgccgctgggccacatcctcaacaacagctgatccctcttgtataaatatgttaactgtgcagaacagttatgttatgggacaaatataatggtcattatggtcagattggttgatgccacaccagtcaaggtagagtctgatagggcagtatcttaataaccctacccatgacttaactgttggatttgaaaggaaaacgtaggatttgctcttgtccccttacccgccacaaaattttgataatttgtttaaaagggagaggcagaggaaaagactagaagcataaatagctgctttaggtttgccagaggcacatagcttaacattag

SEQ ID NO: 20706 - DNA, 1700 bp, Homo sapiens
ggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgcct

SEQ ID NO: 20707 - DNA, 1031 bp, Homo sapiens
ggcggatcacttgaggttgggagttcaagaccagcctcacaaacaaggagaaaccccctctctactaaaaaaaaatatatatatacaaaattatctgagcatggtggcgcatgcctgtaatcccagctactcgggaggctgaggcaggagaatcgcttgaacccgggagggggatgttgcggtgagccgagatcgtgccattgcgctccagcctgggcaacaagagtgaaactccatgctgggggtaaaaataaataaataaataaaaataaaaaagaggtgtggtttagaggttagaactacttgcctgaatggttaaactaattaaacatcaattttaattagtcaaatttgatgaatgctttgttcaaaaaatttgggcacctcattgaggagtcagtggattaccaagaaatacttggtgttttttaaataatgatgagctgttatgagaagtattattttatctgtagcatgtgtcttgcatgtccttgcaatttgtgaagacaaaattattctggcaatttgatttcaggtaataatctacatgacacttaagaattataagagccagccgggctggcacagtggctcgcgcctgtgatcccagcattttaggaggccgaggtgggcggatcacctgaggtcaggagttcaagaccatcctggccaacatggtgaaaccccatctctactaaaaatacaaaaattagctgggcgtggtggcgggcacctgtaatcccagctactcgggaggttgagacaggagaagcgctggaacccgagaggcggaggttgcagtgagccgagatcaggccactgcactccagcctgggtaacagagcgaaactcagtctcaaaaaaacaaaagagttacaggatccaggctcacgcctgaggcaggaggaccagcctgggcaacagactccatctctaccaaagaaaaaaagaaaaattagctgggtgtgatggcatgcggctatagttgagaggctgaggtgggaggataacttgagcctgggagtttgagg

SEQ ID NO: 20708 - DNA, 1987 bp, Homo sapiens
agtaacaggaagggaaattgcattcacttcttagttcagcatttctgataatgctgatttctttctttacttttctttttttttttttgagacggagtcttgctctttcgcccaggctggggtgcagtggcacgatctcggctcactgcaacctccgtctacggggttcaagtgattctcctgccttagcctgctcagtagctgggattacaggcgtgcaccaccatgcgttactaatttttgtatttttagtagagacggggtttcaccatgttggccaggctggtatcgaactccttacctcgtgatccacctgcctcggcctcccaaagtgctgagattacagatgtgagcccctccgcaccaggaatatgctgatttatttctttgctagaagcttggcttgcttcatagctagttttataggtacatcatacatccctatttccccctcagaagtcatgatcaaactcactactctagagctcacatttaagggtaataacattttatcataaatcatttttaaatgtatagtatttgagtaaaaccttaagctgcagtaaagaagtatcttcaacttgggtgtttgcaaatagttgttttgccttctttattctaaaatatgtatgtttgctttgtttttaaagtagtgttgttactgtgactctgaagtgtattctcaaaaaaaggggaaagtgcagggataggttgagtttccagtggggaagaaaaaaggaaatgttacttataggtggttaacatgaaaagttggattaactttttcttttctttcttttttcttatttattttttaataatagacacagggtctccctatgtttcccaggctggtccctcaagtgatcctcctgctttggcctcccaaagtactgggattacaggcgtgagccactatacctggccaattttttttttcagcgtatgactaaatatagatttatctttgcagtagacaaaatgaatatcaagttattactatatacataattcttcaggaatttatttgctacaaaatatgaaatttctgtgctttaaaataaaaaatattggttgtattggatcaatttttttttttgcagtaggtcaaccaagagaaggcttgtatttggacttttaaaaaataggccattctgaaatccagaaattcgtaagataataaagaacatttaactgttcctcgttgtttgaaactaatggaataagaaattatattggagtgataagtgtgatttctgtgactagaatttccgatcgtcatctttttttttttttttttctccaggttagattgattatagttctcccctttttagacctctcaggagaaagggaattttcctgcctttctttggataggtgtctgcgcagagatttgatggacataccatacaactaagcttggacaattggcacctttaaactcccagatttggtttaatcactgtaatatcttgaatgggattttatctggataattatcttattcatcctgaattattaattgatcccagtatatggatctgacaaattttcaaaaagctgagagtactgtaaaaaatattttttaaaagtgccaggcttggccaggcgcggtggctcacacctgtaatcccagcactttgggaggccgagccgggtggatcacaagatcagaagttcgagaccaccctggctaacacggtgaaaccccgtctctactaaaaatacaaaaaattagccaggcgtggtggcaggcacctgtagtcccagttactcgggaagctgaggcaagagaatggcgtgaacccgggaggcggagcttgcagtgagctgagatcgcgccactgtactccagcctgggcgactcaaaaaaaaaagtgccagacttggtggctgaggtggaaggattgcttgagcccaatagaccagcctgagcaacatagcaagaccccatctctacaaatggcatgtgtctgtggtccca

SEQ ID NO: 20709 - DNA, 1048 bp, Homo sapiens
gtcttctctggcctcagactttggtttgaatcttcgctgagttctacctcttgctttgcttagcagtaggttgcatttcctagtctgtaaaatggggctgacaggtgtcttctcatagagatgtgaaataatataaagctacagctcatagcatagtgtctagcatacagtaaatagttcttaaatgttaggtattagtgtaatttacatgttgtgatttttttttttaatcctttttttcccctcccctaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagtta

SEQ ID NO: 20710 - DNA, 1032 bp, Homo sapiens
tctcctgcctcagcctcccaagtagctgggattacaggcgtgcaccaccatgcctggccaattttgtatttttagtagagacggggtttcaccatgttggtcaggctggtcctgaactcctgacctcaaatgatccacccaccttggcctcccaaagtgctgggattataggcattagccactgcacccggcctgtatatctgtttctaatgacttgacctcaagatgcttttatgaacatttcataaaaaggtagataactaatagcaccattttgttacagtggaaaactatttgaatcacctataatagaattgactttttatggtagttgaaggtttttttttcttttcttcttgaaagagggtctcactttgtcactcaagctagaaggcagttgtgccatctcagtgcatgttcactgcagcctcgacctcctgggttcaagctatcctcctccctcagctcccccagctgggagtataggcacatgccccacgcccagctaatttttgtatttgtagtagagacagggtttctccatgttgcccaggctggtcttgaactccagcagtctgcctgccttggccctcccaaagtgctatgtttacagacatgatccactggcagttgaagacttttaattaaacctgaataccataacactaaaaaattggattctttttattgttgttttgttagtaaatattttctcattgcatcttttgagtcaaggcagtattacatagtgataggaaaccatggattgcagatagactggcggtcagatttccagttctgtcactttgacttgggcaatttacttcatctctcttaaagtctttttatctaaatgtaaaatgaagaaagtatgttttataaaggttggaaacattggtacgtagatattttggtttcacgtattaacaatatccaatatctgggaaatgtcaaaatgaaatttaagaatactttagaaaaagttgacaagtgttagatatttgtctgatagatgccttggaaactgctgat

SEQ ID NO: 20711 - DNA, 1133 bp, Homo sapiens
acccagctccccggtcacgagtttctctgccacaggaacctcgtctcctgccaggttcgctcacgactccgcctctgaggctttcacttgggccttttccttctagcagctcattttctacaaaaaaaaaaaaaaaatccaaaaaccttgttccattcccctcccgacccagcacttaccttctgagcttgggtagtgtctttgaggtgagggattttaaaaaatgttaggatggggaagagtgcgagctttttgacccctctttcttgtccttaagggtgaacccaagtggctcatccatgaggttagactactaccatcttgcctcggatgaggcttctctccgtgttaaaaagaaaggtgtttttcgtattttaaaatcgatattgatccccaaactaatcttaataaacgagaaattgagggtaaaagtcatgtaagaaagtatttcacgagaagtgagtttaatagtttataacccacgcagattttaaaaaataagggctctttataaatcgaagagaaatgaagcgtaagaaagcgtatgttaaacccagcgtatcaaatttgatagaaggaattgttgagagctggagaaatactaagtgcttttttattgcagattgtaacttgaagactgaaattagaatgtcagattttccattttgggacttcgtagggacccgatagtatgcaatagaagtgaacacatacgcacgagttaggtgttttaatcctaaagatttggaacagtttaaaaactgttagggactatataactagattttttagcattagatcttgttcaaaagatgagaaaatactaccatattatggctgcataaggcaatattactgttgagattgaaaaattgtatctcatcggtcaggttaatatactcttgccagacttctctctacatgtggaagcaaccgctgaaccattcaaggtggtattcctccaaatatttcttgtcttggaaggggtggataaagaggaggaaactggaattagcagttttgacagaatgtaaacagtttggggcgagtgtatgatttggtcacagtactgttgctttgacatgcataatgctaataactaagaaaacattacaatatttttgaaatttatc

SEQ ID NO: 20712 - DNA, 1041 bp, Homo sapiens
ctccagcctgggtgacagagtgagactccgtcttaaaaaaaaaaaaaacagaaacatggttactatggttttgtataccagaacttatctgtatcagttaggactgtatgttacaaatggtagaaaatccaactagaactgatttaacagcaaaaacaacaacaacaaaaaagactttattattgctcatatgccagtgaaacagtttcttgcttcttcttgaaagaaacttgatccagggttcaaatgacatcttcttccttggtgatgactccatttctgggcaggctatcctttcatggtgccaagctggctgctaataggtcctgaagctatgtacttccatccagtagaaaagagactcaatttccctgatagctggaaaaagttccaaaaatttaatcttattagcattgaatatccttagttgggtcatatgattacgttcctgttcctgaaccaatctgggagtgagaggagttaaaggaatacgagatatagtgattggcttaagttgtcatccaagagttgcatgtgtagaggaggaaagtgaaagagaaagggagatgtatttcgtcaaccattactttaaaatatgccttccatgggagaaatgccataatcatcaaccacaatatttatggagctcctaattttagaaacagcttgaagatcattagactgattttgactgtgtctctttgctacaaggaaatttatttatttatttattttattttttagagataggatctcactctgtcacccaggctggagtgcagtgatgcaatcatagcctcaagggatcctcccaccacagtctcctgagtagctggagctactcagaactagaatattaggagtggagctggagctggtcttgaaaactgtactctggtttacaaggaagtttattaagaaaaaaagattgggaggctgaggcgggcctcccagacatgtgaggtcaggagtttgagaccagcctggacaatatggcgaaaccctatctctactaaaaaaacacaaaaattgggcctggca

SEQ ID NO: 20713 - DNA, 1033 bp, Homo sapiens
tctttttttaagaaagcattatgcaaaaagtcacttttaagggcatttaaaaatttttaagtaaagccattctttggcttttttggactatttgtggatactttgtttacattttgaatattaaaatgtgcatcatcttgtcggccatgcagtcctgcaggcatcagtgccctggctgtcctgtgagtcctcatgcagagcagggccatcatggtcagcccttgtgagtaagtgggtatacgctgaagctgacttccgtctgtgtcctgccctcccatccagcactctctatggaaatagttgtcatttcctcagtgatggtgtgtcttatagtgatggttgtaatggtgaatggctagtgtcattttgtttaattttgttttgctttttgatggtggataagatgaaattttagctgtttcagcatcaatccaacttaaaagcatcttggactttgttttcccttccaaactaaaagatcaaggcatgtattagacacaagcatatttgctgcctcaactcctctgacacccatattaggaaaaggcctgccaccaaagcaggaagctgcacactcctaacccttctcccagggtgtggggtcccttgacgtcatgaagagctattgcaaggtgcttctgtacttttccagcctggaaatggagggtgactggccctggctcctgctatgagaagataaccagcctcattttctcagtgccccagaggtctaggataggatttctaaactggaatcatccttaatcaccttgaagatcccttaagaggcatttgactggtgctgccgtctgtgtcctcaaagcaatgctggtggcagcgtcctgtgtacacatgcagagctaatacccaaactaaaaactgggtaactggccctgaagtgcttcccaatcagtaagcccacagggaaatgtttgatttttatgttctgttggattttggtttgcttggcatatctaaaggtgcctttacttttctttttttttttttttctttctgctttgttttgtaggac

SEQ ID NO: 20714 - DNA, 1048 bp, Homo sapiens
tgctgccccaacatgtacctcattgtccactcgtaagaattcaaagaatgattcttctgtggcagacctagcaccaaaagggaaaagtgatgaagcccccccagaacattcatttgtcctcaaggaaccagaaatgagcaaaggcaaagggaaatacagtgggtctgaggctggctcactgtcccattctgagcagaatgccactgttccagctcccagggtgctggagtttgaccacttgccagatcctcaggagggcccagggtcagatactggaacacagcaggaaggagtcctgaaggatctgaggactgtgattccataccaggagtctgaaacacaagcagtccctcttccccttcccaagagggtagaaatcattgaatatacccacatagttacatcacccaatcacactgggccagggagtgaaatagccaccagtgagaagagcggagagcaagggctgaggaaagtgaacatggaaaaatctgtcactgtgctctgcacactggatgaaaatctaaacaggactctggaccccaaccaggtttctctgcacccccaagtgctacctctgcctcattcttcctcccctgagcacaacagacccactgaccatccaacctccatcctgagtagccctgaagacagaggcagcagcctgtccacagccctggagacagcagcaccttttgtcagtcatacaacccatttactgtctgccagtttggattacctgcatccccagactatggttcacctggagggcttcacagagcagagcagcactacagatgagccctctgcagaacaggttagctgggaagaaagtcaggagagccctctctccagtggcagtgaggtgccatataaggactcccagctaagtagcgcagacctaagtttaattagcaaacttggtgacaacactggggagttacaggagaaaatggacccattgcctgtagcctgtcgactcccacatagctctagtagtgaaaacataaagagtctcagccacagccccggtgtggtgaaggagcgt

SEQ ID NO: 20715 - DNA, 1047 bp, Homo sapiens
gattctttggagtaaaatatgaggcatattttcagaatactatcaaggatacgattttataactacataaactgaaaatggaatttagatgttgaacatggtgaataactttttgcttaataattccctggtgcccaggtatgcccaggaaccctgctgtatcatttctctaataaataaatataacctcttagttttttagctgtcttcattatttttgtatttaatttcagtctatggaataaacaagttttaagtaagaaaaaacagtgctgggaattggatttagcctgagtagtagagcacatattctcccttggtttccttgcagggtacggtatatcttgaatgtcactcgagagatagataacttcttcccaggagtctttgagtatcataacattcgggtatatgatgaagaggcaacggatctcctggcgtactggaatgacacttacaaattcatctctaaagcaaagtgagtaatagtcctgcacaatgttgtgatctctgttcctcttgccccaccacacatggctgggtcctgagggctatagacaacttactgatggtactcaggaaaaaggaactaaggaaaggaggagactgaaatctttttaatcctaggcaaaagactagtgactcactttaagtaaagtaaacccctaggagaaagtaacctcatgttggctatttccattgagcacagaattaaagaaaatagacttaaactgcagcaaaagatacagaaatgagagaaggaagaaattctgaatgaaattaagttgccagtggggagttttaaaagttatatcatagaaattatttcagatagatagaatactggtcctccccgctgaagataaggagacaaactttggaaatcttttcctactctcttactttatttttatgatactctaaatgatgaaatttttctgtggcccttctgttgatgtcttccttaaattagttggctcttctagtgagagtattttgtattaacttagtgtttggtattaatgtcaacactgcctttttgttttt

SEQ ID NO: 20716 - DNA, 1026 bp, Homo sapiens
aagtaaaaagctgccatttttcccttagctgatgcctactaagtttcttattgaagttcattcactttaggaggtcagctaatcccaataagaaaagagaaaataaggtctgaaatttgccatgctaactcattgtggaaagagataagaccagctgagactcagaggtagtgatggttgctggctgcctgttttctcagccataagcctcctggttatctttaccattagtggataaatactccctactttttccccacatgaaaagtatttcataattggccaaatgaacttggaacaggacttaagccaaatgattatacaaagaattccggggggtggggaggggaatctggttgcttaatttaaaatttgaagttaaataaaacttggaaaacttaataagaaagtctagagttcttcaaggcagagactgtatcttagtcttgcttatagcttactatctacctagctcagagctgtataacaagagggtgctcagtaaatgtgaatgaatgataggtatgttcacacatatttgaacactgtgacttggctgatggcagataaggagagaaaatcaattagcaaactgtgttgggaattcagagacctcagttctaatcctgtatctgccatttgccttatttggaaatgcccctgaagcataaggaccccataattcaacaagattaataacattgcatctgctttatatacaagagtctccttaagatttctttaggagtgggacaatgttttttacaagcttctcaagtcatcaagctttaaaaattctgtaattctggccaggcatagtagctcacgcctgtaatcccagcactttgggaggttgaggcaggtggaccacttgaggtcaggagttcaagaccagcctggctaacatggtgaaaccctgtctctactaaaaatacaaaaaattagctaggtgtgatggcaggcacctgtaatcccagctactcaggtggctgaggcaggagaattgcttgaacccgggaggtggcg

SEQ ID NO: 20717 - DNA, 1060 bp, Homo sapiens
atggtgaaaccccgtctctaccaaaaatagaaaaattagctgggcatggtggcagacgcctgcaaaaccctgctactcacaggctgaggcaggagaatagcttgaaactggcaggcggaggttgcaacgagctgagatcgcgccactgcactccagcctgggcaagaagaacaaaacaatgtctcaaaaaaaaaaaaaaaaaaaaaggagggggattgtttcgtgtctattgctttgcagcctcattattttcatttcagcatattgagaacatcctgccattgtccccaaatgcatttctttcatatccttttaactggttgtttgttttccataagactgattcatattcaatccgattgttgaacattttgattatgtccagttttttgcagttataaacaaaacctcacctaatgaacatccttatgcttcaatctttgcccatgtccctaaaagacatatcctaagggtcaattctgggattgctaggacaaaggacatacatatttctagggcttttgatacagattgctggtttgctcaccagttggaccagtctacactcccatcaacagttgtagtaattcatatttctaatgcttctgaaattataaataaaagtttttaaaaatatgattctttcagttcacctgagctacttgaagacccagaaaaattgattcttacttgtctttgttatcaagaccctgtttcatacctaagtactggtgaaacatgctctagtttgtgagctatttgagtagaactaatggaaagatgaaataatagtacatcaatagttacaatgaagaaactaattatcccagagagtttttgagcatatgggtagtgtttgtgaatttaagtttgttccccacattgtcagtttattctaaaattatcaccattttagacttaaagaattttaaagccaaaagataagcaaacagacttgcttaggtcctgtagcaaattaattcagaccttgaacaacatttcattgtgctgtttaggaagtgttaagtatattgagattttccatattactgtgttacta

SEQ ID NO: 20718 - DNA, 1076 bp, Homo sapiens
ctcagtattagccaattataagctttctttaaaagttgtaacaatttaggtttccagggtagaagaagtagaattatttgattttttttggtaatgaactaaactatttaaattgttgtatatgtttgtttgaggatggtacctgcctcatttcaggacattttggatatcacgtgagataattattcacaagaaataacaataaaaattccagttatggttgttacttttatcatctgtacttaatatttatccatcaaaatttacatggatattcgtgatccataacaggatatttcaagtcctgagcgttctaattgtggactttatattgattgtcttctgtagtgactgcggaaaagtttatgctacatatggctttatctgtttgcaacttaagcaacactttaagcatacttcatcaccccagcaaaaagctggtcaggtttatgagcttggcatcttattggtgcatttttgtctctgctgttctctgaattttgtgtcataaaaaccagttagtctccatgagggctaaattgaatgagagtttttttcctctgattttaaataaatatcacttacaacagagctcttgggagatgccatttcttcaggactctcctctgacccacgtcccttttaagttactctttctcttaatgttaatatacacagttctcatgaacatcaaaagttttaatttcccataattgtatcatctctcttttttcctttttttttttttttttttttttttgagacagagtctcactctgtcgcccaggctggagtgcagtggtatgatcttggctcactgcaacctccgcctcccgggttcaagggattctcctgcctcagcctccctagtagctgggattacaggcgtccaccaccacacccggctaatttttgtttttttttagtagaggcggagtttcgctatgttggcaaagctggtgttgaactcctgacctcaggtgatctgcctacctcagcctcccaaagtgctaggattacaggcatgagacattgcacctggcctcatctatttttagggggagctttagtttgaa

SEQ ID NO: 20719 - DNA, 1033 bp, Homo sapiens
ttcttactattgctaatttacaaagatttttcagttaggtatagttgaattttactgactgcttttttatatctacggaataatattttcccctttactgctaatgtaatgacacattgaattattgaagttgaatcatccttacataactgaactacaccctttttgcgttattcatttaacatattgctaggcttggtttacaaatatttaaggttttgcatttagggatctaaatatttattgaatctttgctgtcttcgtccagcttatgtctgatttacagaatgatttgggtagtttttcatttttttctgtgctctgaaacagctctgtagtaggattatctgtattttaaagcttagaaccaagaagttttattccaagtattttttattttatgaattttttttaccactcacatttttaaatttccatgtttgcattgaataaatataattatcatctgtgatgctcttaaaatctagatcttgtcttctacagaaatgggcaagcataactgaataattgataattgagtaattgaaaccaggcattcatttatggtttaagggctttttttttctctttttggtggataaagagactaatattaatatttaagagaggtacgagatgcctctttgattttaaattaatactgactttttgtggttatttttgatccttagagaatatagccttaaaatttagtatttttaagaaagtgatcaaattggtttacatctagtgaatcttctgggtgttatggccttcaaatgtgaaagaacagttaatgatcccctgtcaaagtataaagatgcatttgtgtttttattattggtggtaactttctgtggctttatccacccttgtgattgtttaaaatcagcagagcagtaattaacctataactgaggggtataaaaaaagagctctcaactttggctttcttggaatcatgcttagccaagttaactgagaagtaaatctgcacaatgaagatgaacaggaatggtaaggtagtgatgtg

SEQ ID NO: 20720 - DNA, 1027 bp, Homo sapiens
cttgaacccaggaggcagaggttgccgtgagccaagttcatgctgttgcactccagcccgggtgactgagcaagactccgtctcaaaaaatttaaaaaaggcagataattttttactgaacatttactatctaagggacactgttttgagcagtggatatattatttcattctctcttcttaacaactttatgagttagatattatcctcaattacagaagagaggcacagagaggttaacttgtctgagattatccagccaggatgcatacacaggcagtcagactccagagtccctgctcttaaatacctctctatttacaattccccttattgctatggaggtgtagcatctttttatgtgtaactgatctttttggttttttttttttctgtgatttgagtgtgcttctgaccatttttctattgatatttggcttttttcttttttatgttctctatatattctgagtatgtggcaaaaatactttctcctagcctattgcttgacttttaactttgcgtcccatataaaagttttacatttttatatagtcaaatctgttgtattttatcttatgatttcaagattttgcatgttgctttttaaaaacctcttgccattcatcctcaggattctcaaagtgttattttatattttttctggcatgtttacatttttaaatatttaactctttaaaacatctggaatttatttttatttatagtgtgagggaaaaatctagcttaaccttttttttccaattggatagttattctaataccaaatttaccattatttacattcttacttcactaatttgaaatgctacatatatattaaattcttacagatgcttggagtacacttctgtactcttaagttctgttcatgtttttctgttcatatgccagtactcattttacttattacacctttagtagacaaatgtatgccagtgctttacctccttgttggtatttttcagtgtcctaactatttttattttattttccagataaatct

SEQ ID NO: 20721 - DNA, 2262 bp, Homo sapiens
gccccctgggttcaagcgattcttttgcctcagcctcccgagtagctgggattacaggcatgcaccaccacgcctggctaattttttttctttctttttttagtagagacggggtttccccatgttggtcaggctggtctccaactcctgacctcaggtgatccgcctgcctcggcctcccaaagtgctgggattacaggcatgagccaccgcgcccagcctctatctctttgaaaataaaatttagctggcgcggtggctcacccctgtaatcccagcactttgggaggccgaggcgggtggatcacaagctcaggagatcgagaccgtcctggctaacacgatgaaaccccgtctctactaaaaacacaaaaaattagccgggtgcggtggcgggtgcctgtagtcccagccactcagcaggctgaggcaggagaatggcgtgaacccaggaggcggagcttgcagttagccgaaatcgtgccactgcactccagcctgggcgaaagagcgagactccatctcaaaaaaaaaaaagaaaaagaaaagaaaattaaaaaaagtgaatagaccaaagtgagatcctatggactctcctaggaaggaaactttatgactttcggagtgtgggttttgggcatctattttggtaatttcataggctcttattactttcaactgtgttatatataataggtgaaattatggaatagctggggtattactgtattttattggtaattatgttatcattattagattaaggtctacccttgccgctatataaaactcaccaaatatggtattattttttacctgtcaatgaagaacattaataaatgatcaaaatcattccagaaataaactgtagttactattatactgttaagtgttaattctactagaaaaaaatatatatgagcaactcagagaatcatttggtcaaacttcaggagtcttggattagactgatgagaatgatcataaaaagttcataccctttaagagtctgtacgtgcattttagtaaaacaaaaagctgaacttctgaaaaatatggaagcctgtattattttttagagagctattatccagtccctgggaagtagtcactaagcaaggagccaaggtgttagtgttatcattatatactaaacaagtggccatttttgtgtcctaagaagctcagggaagaataaaaattgttagataaaattctggcaaagactaccatttaaaatattcccggctgggtgcagtggctcacgcctataatctcaattctttgggaggccgaagcaggtggatcccttgagcccaggagtttaagaccagcctgagcaacacagggagaccctgtctttacaaaaaattagctgggcatggtggtgcgtgcctgtagtgccagctacttgggaggctgaggtgggaggatggtgtgagccagagaggcagaggttgcagtgagccgagatggtgccacttcacttcagcctgggcaacagagcaaaaccctgtctcaaaaataaataaataaaaataaaataaaatattcccattatgaaaacctctgatcaaaaaagtcttgtcttgaaactaaggcactgaaacattgcttgatttgctgttgaggttatcttaagctttttatatacttgacctaaaatatttttatttatttacttggttcatatatgaacttgacttcctagaagcacatgagtgctttctaaggctcagcgtcagcagtagaggagcatattggatgttcatccaaaatgtaccttttcatgaaatcaaaaggtagaaagtcttattttttgtattagtaatagtactaatgctctttcagttccactttgtagttgtacaaggggtttcacatgaacttatctccaaacttaagcttgcatcagaatcacctggagggcttggtaaaacacaaattgctacccacagtccccagagtttctgattctgtaagtctaggatgtggctggagaatttgcatttctaacaagttcctagatgatgctgatgatgatggcctaaggaccctaccttaattaaagtattcctctgaggcagattgggcaagtcatcgtccacattttatagcataacaaactagagaatcaaaatgctgaagtgatttgcacaaggctacatggcttgatggtagaactgaaactagaacaagcatttcttgtctctgaatccagagctcctgtagtgctgcactcacaatcctgatacacacatc

SEQ ID NO: 20722 - DNA, 1027 bp, Homo sapiens
atgatctcggctcactgcaacctctggcgcccccaaccccggccccccaccccaccccccacccctgccactgggttcaagcaattctctctctctctcttttttttttttttttgtagagacagcatctcactttgttgcccaggctgatctcatactcccaggctcaagtgatcctcctgccttggcctcccaaagtgctgggattgcaggagtgcgctaccgtgcccagccacttcttttttctttaaagagacttgctataatattcacttcttctaaactgtatttattagtattactttagaggtcatgtttatttagcatttatagtgctgcacagcttatcatcattaaaaaaattattaggaatcattctgagtaaactactaaactttatgaacttaaatatatccactgttagcacctaataaagaagttcttaatttgaggtccatggtcacctagaggtctatggattggcttcagaaagtcaaactccttgagattatatgaaaatgttgagtaaataaatatattttaaaatcagattctcaaagtgatctgtgatctcaaaaaagattaagaagctctttcctaaagggaagtgttatttctaagacctgattctgtaaacctcaagtgctgtgagtatttccctgtggtacatagcaataactagtgggagcagctaaacaattcagatttagggtcctaagtgaagactgactcaaaagattttgtatttgggggagggagtaccttgatacatgagtacacttagcccagtggttctctcgtcactgctgagaaccctctcaaaagagctttttgccctttctcatttgctgccctcaggtttgctgtgggtttagaaaccacgaaacaagccaggcagggtggctcacgcctgtaatcccagcactttgagaggctgaggcagatggatcacgaggtcaggagttcgagaccagcctggccagcatggtgaaaccccatctctactaaaaatacaaaaaaagtagcc

SEQ ID NO: 20723 - DNA, 2054 bp, Homo sapiens
tgaagatgatgaactccaagatccagaccttccgttaactcttcacttgccacctggtgctttcctattaccagatatctcagaaacttagataactctttacagcatgagttttcagtatttcaagtccctcaaggtgctttggcaacaggcttaagttttatagaagaatcaactaacgagtaattctggttttaggcatagaccttataatttggattgattatttcattactagtatcttgaaaattgccaaactttccaatgggaaaagagcataaatatttatataaaacaaaggcttattattttcttgattatagcatgttgagtcttaaagtcacttcttcctaattttaatctaattggttagtgaagtttttagaaattattattaatttctgactccagaattctaaggcagcttcagtgatatatattttagtctagtattcaaaaatgctgaaaatgctgatacctgaaaatatttgctgtagcataatgagactggaaaggtaaaataaaaggaagctaacttctattgaatgcctgcaccatgccagccccatttgtgagcacaacatgcaggagagagagagcgcagtcatattttacaaagagctggtccctggtcaggtgaaaggcactgctcagtgaattggaaggaacatggtaagggcttaaaactgtaaaggcgtcagggaatacaatttgaaggtaaaagccctagatcaaatgtcataaaacctgggttcctgaatgacattatttataaacgaggtcatctgcttagaccttaaatgttactgtatctgtaaagtgaagatatgatctctactctgccgtctcaaccatggctgcactttggaatcacctggggagctttgaaaaatacgtctaaatcccaccttcaagagattccaattttattaaggtgcagcctgggcattgagatttttaaacccaccacaagtaattcctatgtgcagctaaggctgtgaatctttgaattgggggatggctaagaaagccctctatagatttacttacaaacattagtagatgttatcgacaatctaaattgttttttgtttgtttgaccattacttcaactgtttaaaaaaaaaaaatcttgccgggagccctggctcacgcctgtaatcccagcactttgggaggccgagacgggcggatcaccggaggtcaggagtttgagaccagcctggccaacacattgaaaccccatctctacgaaaaatacaaaaattagccaggcgtggtggcgcaaacctgtaatgccagctactcgggaggctgaggctggagaatcgcttgaacctgggaggcggaggttgcagtgaaccaagatcgcaccattgcattccagcctgggcgacaatagcagaaactccatctcaaaaaaaaatatatatatatatatacacacacacacacacacacacacacacatatgtatgtgagtgtaatctctgaatttccaaatcacataggaagtctctgataaatatttgttgcacttgtgaatttatggcctttacattttttaagatctttcaaaaacgggtttgaggtacaatgtatagagccaatctttaagaggcaggacttttctgttgaaacatcctcctttagagaaatgcaagcctttctcgtccacccttgagtagcttcactcccttaccgaggcagcagtgtcttggggccgccggatgccctaaaggctgtgacgcgcgctgcgggatccgcgcgggcgtcccgagatctggggcggggcgccggccgggcctaccctctccgctctcaggacccgcccgtcccgccccggacgcgggtgggggcgaactgctggcgacgcccgtcagtccggactctaccgccgagccctggggcttcggcggctgcctccgcgcgacccggcgggcccgcctccgccgccgggtgcacgcgcagcctgcgcctcgtgccggagcagagcagaggccaggatgcggagttgtgcactttgagccggccccatgaccctgagcacgttg

SEQ ID NO: 20724 - DNA, 1051 bp, Homo sapiens
aagaagacctgatttttggctaacacggtgaaaccccgtctctactaaaaatacaaaaaattattcgggcatggtggtgggcgcctgtagtcccagctacttgggaagctgaggcagaagaatggcgtgaactcgggaggtggagcttgcagtgagccgagatcacgccactgcactccagcctgggcaacagagcgagactccgtctcaaaaaaaaaaaaaaaaagacctgattttagttccgtctcacctcacactatggtagccctcaatttcctcattttgtaaaatgaggataacatctgcccatctatccttttaggttgctgtgaggtggactgaatagaatctggaaaaaaaaaaaccacatcttttctcagttaattgatgtactagctgaagaatgataaatactgccccctttctactaaggactgaggagttaatttttgcatacttgttggttttatctaatccagagagaaaaaacaacttccaatgttgtggtaaattcttgaacatatttgacatggttgttgaaaagtgtataattgtgtaagtgtctgattttgcatgttcacctgatttcagagaagaaagacatagaaagtgaaatatggccagggaagttgatacacgaaggcttagagagataatgatgctgctctgccagggcctggaaacttgaccatcctaaacaaactgcatagtactaaattgcttgtgaaagggctgaatcaatcctgctgtgatttgaacttttggctcctgaaagtctagagcaggcttgaaaataaaaataaaacccttacctacttactaggttgtgtttcaggccctctactgaattctgtgtgtgaaggaggtatctatccaaagaacaagaggcagcaagagagagatgaaaggcagtgaaaaggagtcttaagggctactccttatttagtgaggcagtgctcccagggagaaagaacttccatcattaatgtactgattctttaaggaaatatttactagagcataatgtgtgtgtgaaagaaagatgatatat

SEQ ID NO: 20725 - DNA, 1041 bp, Homo sapiens
tctcaaaaaaaaaaatttccttcttgttcactacaagttatttgttttggatgaaaaagtaaaaggctattaggaaaggtttattatgaacacaattcagaactgctgagtttagtataaggtcaagtttttgttttttgtctcttctgatcttatgtttatgagtttaaacagtataaactttaggaactccttatatacttggtttttcttaccttgaaacctgtatgtatatgctccttatgcatatgtttatgtcttaaatatattttaaaggaaacagacactatggaaagattcctattataacccaaatggctgggcgtggtggctcacgcctgtaatcccaacactttgggaggccaaggcaggtggatcacctgaggtcaggagttcaagaccagcctgaccaacatggagaaaccccatgcctactaaaaattagccaagtgtggtggcacatgcctgtaatcccagctacttgggaggctgagacaggagaattgcttgaacccaggaggtggaggttgtggtgagccgagatcgtgccattgcactccagcctgagcaacaagagcaaaactccatctaaaaataaataaataaaaaaaataacccaaatgatctctcaaactgccaatatcttcatatcactttaacaaaattcatatttaataatctcaaaaggcgatgtgtaaaccatctgatggagaaatcttacaaagtgaaattaaggagcatttaataaaactaagatgttgaagattagtattatttgtagaatattggtcttcagaaaagagagtcaaaatgtttgccatctattcatgaggtgcttagaaaacaagatttctgaaaaacaaaagatttcccaggtaaaattaaaatgttttaaaaaatgtaattaaacaaaaaatgtatatgagttttaaatatatattttctattctactgtgtaatgacaaggaataggaccccttgtcttttcttttctacattgtaatattatttctatggatagaaactcagttctgatttaat

SEQ ID NO: 20726 - DNA, 1103 bp, Homo sapiens
cggagtttgcagtgagccgagatcgtgccactgcactccagcctgggcgacagagcgagactcctctcaaaaataaaaaataaaaaaagggaggaaaagtggggaaaaaagtaggtccattgtaaatatgagctgataatttaatcctcatcttttttatctttaaaaaaatgtttagaccgggcgcagtggctcacacctgtaatcccagcactttgggaggctgacgcaggtggatcacgaggtcaggagctcgagacctgcctggccaacatggtgaaaccccgtctctactaaaaatacaaaaattacctgggcctggaggcgcgcgcttgtaatccctgctacttgggaagctgaggcaggagaatcgcttgaacccgggaggcggaagttgcagtgagccaagatcgcactccaacctggagacagcaagaccctatctcaaaaaaaaaaaaaaaaaattgaaacaatctcatacttacagagaaattacaaatacaatacaaggaactttttttctgagccatttggcaataaaatgctctatcacctcactcttctttaagaaatagagtgatgatgttaacatttcatggagaaactgaatattgattgcacttatgacaggaaatatacattagaaagagaaacagagggtttttttgttgttgttgctgtttgagatggagtctcgctctgtcacccaggctggaatgcaatggcacaatctaggctcactgcaacctccgcctcccaggttcaggcaattctcctgcctcagcctcccaaatagctgggattacagacacgtgccatcatgcccggctaatttttgtatttttagtagagatgagatttcaccactttggccagactggtctcgaacaactgacctcaggtgatccggcggcctcccaaagtgctgggattacaggcgtgagctactgtgcccggccagagttgtttttttgttttgttgttgttgtttttaaacaaaagtagagctttccatttattagaaagtggctgtaactgatcacattgaagctgttcatcttttttttttttttttttttttttttttttgagacagagtctca

SEQ ID NO: 20727 - DNA, 1035 bp, Homo sapiens
ccaatcagcactcccaattcaatggccccctacccaacaaattatcctttataccaaaactctgatccaggccaggcgcggtggctcatgcctgtaatcacagcgctttggaagcccaagacgggaagatcaactgaggtcaggggttccagaccagcctggccaacatggtgaaaccctgtctctactaaaaatacaaaaattagccaggtgtagtggcgcatgcctgtaatcacagcactttgggaggccaaggcgggcagatcacctgaggtcaggagttcgagaccagcctggccaacatggcgaaaccccgtctcaactaaaaatacaaaaattagccaggcgtggtggcgcatgcctgtaatcccagctacttgggaggctgaggcaggagaatcgcttgaacccaggaagcagaggttgcagtgagcggagatcgcaccactgcactccagcctgggcgacagaatgagactccgtctcagaaaaaaaaacaaaaaacaactctgatcctcaagttttcaggaagactgatttgagtagtaataaaactctggtctcgcacaaaaaaagaaaaaatgtataacatgacttccagaaggagtctggcagtattatacagcatgaggggaggggaggcaagaaaactatcaagaaagctgttgcagtaattcaggcaaatggctagttcctgtacgagagcagcatgaggacagggattatgtattttactttggtatccaattagcatgtagttggcactcagtaaatgcttagtgaatgaacaggaatagaagaatattgattactgtactagaaataatactagttaagaaagggaactctgtcagaaaccatatgaagagtttgactttggatatatgaaacaacggggcattattcaagtagaaacagtttgaaggcagttaaaagaaaacatagggccggcatggtggctcgtgcctataatcccagcactttgggaggctgaggtgggcagatcatctgaggtcaggagttcaagacaagcct

SEQ ID NO: 20728 - DNA, 1092 bp, Homo sapiens
acaaagaaaataagggagaaaataactcaagctggtgctgataaagtcagcaaaaggccagatgctgcagccttataaactaagtcaaaaatcttgatcttggctaggtgcggtggctcacacctctaatcccagcactttgggaggccgaggcggaagggtcaccaggtcaggagatcaagaccatcctggctaacacagtgaaaccccatctctactaaaaatacaaaaaattagccaggtgaggtggcgggcacctgtagtcccagctactcgggaggctgaggcaggagaatggcatgaacctaggaggcggagcttgcagtgaaccgagattgcaccactgcactccagcctgggcgatagagcgagactctgtctcaaaaaaaaaaaaaaaaaaaatcttgatctttatttcttggacaacaaaaagccactgaagagttttcagctggggagtgaccaggttgagattttttaaaaatatttgcctgtctttgctatggagaatgggcttctatatgagcacaactatttccccagcaatcagtacaatgtctagcacataggaggtactctgtacatattggttaaaagaagaataaatgagtgataggtaacgtatacacaataaatggaagctaaagtcataccctgaagaaagaggtcaggcaaggaaatgtgaatacagcagcgaaggaagaacccaggctcccttcttccctctctcctctctccatatatatatgtacagacacacacacacacacacacaagccatcgacagttggggcttcatatccctgtgatttagtttggttaactcacttgtcagggaatggagctcttaataaaagggaagttggcagaatagtagtatggtgttatggtgtggtggtaaggaatgtatatgaccctagttaagttacttttcttctgtcttaatttcttcatccaaggaatggaaatgataaatagtatacctaccttggagggaggattagtgtgaagattaaatgagataatggttgcagagcacttcgactaaggcctggcacattgttagcctttaataaacagccactattacag

SEQ ID NO: 20729 - DNA, 1024 bp, Homo sapiens
ggatgcctggaagaaggaaccagtcaatttatcctgatttaaattttcaaattgactcagttaaattcagtaaccacagattgtatccctaatactagacaatttgcaaatctgtaccatttatcacgaaaaaagcctatgtaaaatactatgagtggattaaatccaaatcatcacctctccagaaaaagctatttcaaacattctgtggctgatattaagtttttgcgatcctctttatgtgcaaagtatataactatagtgttgtatttcccattgtacttaattaattttttgcttcccagtttattggtgtaaacactggattctagaaaacaattgtttccccccagtaaagccttcaaagacgaagattatgggccaggcacagtggctcatgcctgtagcactttgggaggcccaggtgggcggatcatgaggtcaggagttcaagaccagcctggctaacatagtgaaacctcatctctactaaaaatacaaagccgagcatggtggcgggtgcctgtagtcccagctacttgggaggctaaggcaggagaatctcttgaacccggcagtggaaggttgcagtgagccgagatcgcaccactgcactctagcctggacagcacagcaagaccgtctcaagaaaaaaaaaagaagaagattatggtggtgggcagaataatggcctccagtagagtcctcattctaatcagctgtgaacctgtaaatatgttatcttaacatagtaaacgagaaattaaggttgctgatcatatataactttaaaataggaagattaccctggattatcggggcaggatgcaacataatcagtcacaaaggctgttaaagtagaagagggacacccaaaactataaaaaccctagaagacaacctaggcagtaccattctggacataggaacaggcaaagattttatgacacagatgccaaaagcaattgcaaagaagtaaaagttgactagttgactctaattaaactaaagagcttctgcacag

SEQ ID NO: 20730 - DNA, 1065 bp, Homo sapiens
ggggtcttattcacaagggtctctgctaatctcttgccctgggcagggtaattcttccctatgacttggcagttccccgatctttcatttcttccttgatgctctcctattttgggtctctagtctcttgcttttgttagttagggctaaattcttgtcctgaatcttccctttggcctaaagcttagagacccaaggtgtttctctttggcctccataaagacacaaagcatcctaggcaagggacactacaaggggacagccttgtggctatctctgaagccctacctcaaagttgagcttccgctcaccagcaagctgctctttaagttatggttggcttggatttcgggcaaccaacactcttgattgtaggaggcattccttgattactgaagtccctagattactaagatcctcctttagcttttgggagtttctcaccccagtggttctcatgacacctcccaattatggtttagtaggtaagaccccttgtattgaccatctctctagaatctctgtccgttgaagcaatttctgaattcatctccaaaatccttttcctaagatggaaactagtttagagaaatgttcatttctttgagaaacatctctttttagacactctcactcctctgttctctggctctggggcattgctattttatggctagaatcttttgaaacacttctactcttatccctttacttatttcctgacattgctcaacctgtaatcagctctgagctacctctattagcattctataaagtcccacttttctaggttattttccatgatgctggatgagagggactgaaaagtctgccaatttttctccccatccaagggaacggggaggattctgcaggcccatgaccaatattcgacagggcttcttccaagaatttcctggtgggaactgagtttttttttttttttttgaggtggagtcttgctctgtcgaccagcctggagtgcagtggcacgatctcagctcactgcaacctctgcctcctgggttcaagcaattctcctgcctcagcctcccaagtggctgg

SEQ ID NO: 20731 - DNA, 1032 bp, Homo sapiens
cctgtacccacttaaccttttgtaaatatcattattctcttttgggagggagggagatttctttctttgttaatgtagtctctaggaatagggatatacactctttttaatattactattttgattcttgaatgggagccaagagttcatgttgatgttatactgtgctgttatggccactgagtaatattaataatagtcaccaattccatgggattgtaaaacaaattgaaagctgtaaactctccattttcaagaattagagctggagttagtttaaaaacaaacatgtgcataatacaaaagaaacaatttaaccctttaataactttgaaaacaaagagcaatcataatgtctaatagacaactgctttccaccagtgtttttccatttaacaaaatcaatcaggcttattaaaggatttggctgaaataagagttccctatgttgtattaaggacagtaactcatttcagtgttctacaatgtaattattcatctgttgttgaacatttgagctgatatatgtaatataagaaaaaatagggaatatttttgtataaatatttatacacctctctatttctttaaattctgtaatcgactaataggtcatgaacatctttaagatttttgacacaatgtcatattactttcagaaaaattttactattttacactcccagccattagtatgtgagagttcctctttcacttttcccaggtttggaaacatttataatctcttatctttgccagtctgaaagatgaaagtggagcttgttttattttgcattttttattaattaagtagggcatgtttatttttatgatttattttcttatttattttaaaaaatcaaatgaatcagaaagcactaatataaatagaacagtgtatctttattccacactgacatgaaaaagaattgcctacaaatggctgcaagagagtatattttcaaatcttgttgtcttgagagattagatgtaaacttacaattctgctatgaatatctcaagctctaaaca

SEQ ID NO: 20732 - DNA, 1050 bp, Homo sapiens
tcgcaggcaacctaagcaaaaatggacaaatgggatcacatcaaggtaaaaagcttttgcacagcaaagaaagcaatcaacaaagtgaagagacaacccacaaaatggaagaaaatatatgcaaactacccatctgacgagggattaataaccagaacacatgaggagctccaaacaactctataggaaaaaaaatctaataatccaattttgttcttgacacctttcccaaaaatgagttcactatagatgtgtggatttctttctggattctctattctgttccattggtctatgtgtctattttcatggcagtagcatgctgttttggttactattcctttgtagtataatttgaagtcaggtaatatgattcctcctttttttttttttttctttttaccttaggatagctttggctattctgggtcttttatcgttctgtataaattttagggtttttcctatttctgtgaatgtcactggtattttgatagaaattacattgaatgtgtagattgctttgtgtatgtactgtgaacattttcacagtattgattcttccaatccatgaacatggaatatctttccttttttttttttttttttggtgtcctcttcaatttttttcatcagtggtttatagttttcattataagcatgtgtacaaattcgtagttacaaattataattctatgactgaaataactagggagcagtacatagattaaatgttaggcaaggccttcatgatggagttataccgagtgaggtttgaagaataagtaggagccaggcatggggtaaaagaaaaagagtcatttaaacaaaaggcatattcaaagccccaaggtgggagagagtttggcatgtttgaggaggttgaagggagggcaatgtggccggatcataatgtagtggggctgaatgaggaaactatggagaagtagataaggatgaaatcatgtgaggctttacagactgtagtaagaagttttgatttttttccccaagaactatgggaatacaactgaaaggttttcaacatgg

SEQ ID NO: 20733 - DNA, 1516 bp, Homo sapiens
ggataatggatggatggatggataatcgaatgaatgactagaaggctgttcatcctagcagcatgtgtatacagtatattgagttgtctttgcaattggtttgctcttttttttatttgagtctcatgagcaaaatataacaatagatttttgaaaacatcttttatgtttttaacattctagtctcttacatctttaggtgtcaaaatttagtatgcccaacattaaatttgtggcattgctttcaccagcttaatttcatgagctttggctgggatttggaaacattgcatcttgttttgatgattttctgattggctggaagcctcaaatggatgtcacatgctgttagagcagactttgcaaagaaaaagacagttgatcttctttgtttcaggtggtctgttccctcagtttaggttttgtttgatttggggagtatttattaactttagggatgagttgcattttctttctaatatccatttgttcacaaaaacacctagtaggtattcagttcatattggaatgaatgagaaaatgagcagcacatcaattgtaacaaatgtaccactttggtcggagatgttgataatgggggaggctatatgcatgtgtggaggcaggggatatataggaaatctgtctaccttctgttcaattttgctgtgaacctaaaagcgctctaaaaaataaagtttattaaaaaaaaaaaaaaaaacagcagaaagcactgttcctgagaagtggaaacagcatgagcctctgaataagaaaaacctatttgaatactgattctacctctcacaattatcactcaccttggatagataacatggctgagtccgtgtatatccataatatggaaatgataatacttaaactatattacagattttcaatattcttagtttaaattaggtcaacattctgatttttttgttgggaaaatatggtcatcatatttcagctcttggactttttaccatggaattttaaaaccatatacttctggacacattttaaaaagtaaaatgtacagacatgagatgtgaggggaaatcatgtaatttagccaccaatttgtgcagtttgtataattatgacaaataacacaatgctgtctgtatttgttaagttttcctgtgattgacttcagaatatcaatgaatcttaaaccagactttttctgttattcatttgctgctttgagcttgtttctctgcctatccattttttatatagctcagaaaattaaacaattgagatcttgagtttcatattataccattaatttgcttattacaatcataacatagtatatttagtagggcacagctggattttcttttatttgcatatgccttatggtaatactatgactagtaactcattatttaatatggaatatctactgtagtggaaatctagaagaaatatgagtgctgaataaggtagtaagggagatttgtagtctatacttatttgatctttgtttccatctatttctccaatt

SEQ ID NO: 20734 - DNA, 1048 bp, Homo sapiens
atgtatgtcatcttttgagaattgtctgtttatgtcctttgcccactttttaaatggggttgtttgtttgttttcttttaaatttgtttaagtttcttgtagactctggatattaacctttatcagatggatagattgcaaaaatgttctcccattttataggttgtctgtttgctctgattatagtttattttggagtgcagaagcactttaatttagttagatcccatttgtcagtttttgcttgtgttgcacttgcttttggcgtttttgtcatgaaatctttgtccatgcctatatcctgaatggtattgcctagattttcttctagggtttttatagttttgggttttacatttaagtctttaatccatcttgagttaatttttgcatgtggtgtaaggaaggggtccaatttcaatttcctgcatatggctagccagttcttccagcaccatttattaactaggaagtcctttcctcattgcttgtttttgtcaggttaagttcagatggttgtgttacgggatctttgggtgtcaatttttggaaacctctgtggccagttatgcctttgcctgagttcttgtccatccaggaagaatgaggtagaatgaggtatgcagacaaatgaagggtgaagaagacgaagaagagctttatttaggtttacaactgctcagaggagacccgcagtgggtagctcccctctgtaggcaggcaggtcatccatcgagtgttcagctctcatcagagaggaggccctggagagggtagttcttctctgcaggcaggtcatttggtgatctctgcaggtctctgaaactctcagcagagagggtagctcctttctgcagttagtcatccagttcagttgtctgctcagctctggctgagcccagggttttatgggcctcagaggtgaggaagtgcatgcagattggcccatgggcagtcctgagaaaggcaccagtttccactctggtccatgggactggcagcccagcccccagcccacaggccctccctggcctgagggagggacctt

SEQ ID NO: 20735 - DNA, 1048 bp, Homo sapiens
ctttttttttttttatttgagacggtctcgttctgtcgctcaggctggagtgcagtggcacgatcttggctcactgcaacctccgcctcccgggttcaagtgattcttctgcctcagcctcccgagtagctgggactacaggcacaggccaccacacctggctaatttttgtatttttagtagagatagggtttcgccatgttggccaagctggtcttgaactcctgacctcaagtgatctgcccacctcagcctcccaaagtgttgggattacaggcgtgagccacagtgcccagtcaaaagaaacattattaagcaagaacttaaggcacagggctacaaatagcatgatatatgctgggaaccacaggcagtacagtgctgatgccatgtaaagtgcagaaaataaggctggagaagtaaagataatttcttctgaattttaacatctgcacccttatttttaccttgaatacagttggcttttctttaaagtgactgtgcaaatttgtgattgtagacactgggttcagcactaaataggcatcacaataaccattggaagtagtactattattgttctcaatttacagatgaagaaactgagtctcagggaggtgtctagactcccccagctagaaatggcagagctgggatttgaactttgtcagagtcagaaagcaactactaaattccacccccctgcccttaggtgttaccttctcagtgtcaatcaaagtactgtttgattgattgattgattatttgagacaggatctccatctgtcacccagcctggaatgcagtggtacaaacacagctcactccagcctcaacctcctgggctcaagtgggattcttctgcctcagcctcctatgtacctgggatcacagatgctcacgccaccatgcccagctaattttttttattttttgtagagatggggatctcactttgttgcctaggctggtctcaaactcatgggctcaagcagtcctcccacctcagcctcccaaagtgccgggattacaggcatgagccatatgc

SEQ ID NO: 20736 - DNA, 1046 bp, Homo sapiens
gtgaccggctacaattttcaagtctacaatatattattattgactgtagaaaccatattgtacaatagctcttcataacttactcctcctgtctaatggaaactttgtaccctttgaccatcatctcctccccattctcccaccaatccccaatctggtgtgaattttctgaattgatacctatattgatccagggttaaataaacaaagtataatactataataatattttagttttctgtagtgccctatacttttcagagtggtttttggggtgtgtgtgtttgtgatctaatttaattctcaagtagccccaaaaattatgcaggacaggtaccacagtttaaagacttggctgaaagtgacaaaacttgtgggtgtaataactgcatagaagtaagttccttggctcctggtttatatctctttccatgatgtgataagagaaacagcatatgcggtttctgttccagagacttgactgccagttgagtaaaggtgcaagatatgaggcacaatcaagaactcacactctctttggagatcatttatattgcaaccttgactacctagaacagaatcatctaagtttgtgcaaaccattttaggtgacagctttgtttgaagcctattaactcttactttatacataaatcttataaatgtggatattaagtttccttattcttagattaccaaaagcaacataataatggaaaattacaggtgctgctaaaggcaggttccctatagtgctgggaaaggatagctgttggtttcaccacaagggaaaaggaaaaaaaaaacccacaagtacctggcataataaaaaaattgagcaattcttgcctaattaatatagggacagatagccctctaggacccagtagttcctgagagctactattatacgttcctaatgatgattctgaatcatcataagaaggcttactcttgttttaaatcttgatttaagcgatcaggattgagtgtggtatatttttagatagatgtccatctaagtttcaccaaagttttgacattta

SEQ ID NO: 20737 - DNA, 1033 bp, Homo sapiens
ttggtagtatcaggttgcaaaaaaaggtatttaataaacactgtaccactttccactgtaaaaaaatcatcaggttacccttaatatttgtatgttaactgaggtgtgagctttgatatcctgaaatttgctggcttgtcatttcagtataatttcctgaatttcaaagttttgttgtgtatggttgtggtttcttcttttctgagctttaattgcattttgtgtgatgaaattgacaactatatcttaataagtgattttatttcaaaggttatatatcttgtgttgtttcagagagcagaactgggattcttggttcagggaggcagatttccagtgattgtaaggaagaatttgtaacagtggagtgcactgccttgcaaaatagtgagtgcacattgctggaaatattcaagcaaaggctggagaacattttgcctgggaggtggtataaagaattcctgcagtgggggacttctaagactatttctaatctaagattttgtgatttgagaatacttgtacttcaaagctggtaaaacattttagggtcatctgaagacaagtatcataggaataaatctttaatataatttattcttatgtgtagtactttatgctagtttttggaaagtcattaacataccatcaaaccttcttaattcactccactagtaaactctttggtttgtggttactaggcctgattttgaagaaatcgattgaaagttagtagagtcatgcaaataaactagaaatcagtactatagtaacatttattttccttgggcactgttgaaaatagcttatgctatgataatatatgtatatcaagttgtcatcatactaatttacttgaagtgaatgattagtatacagtaagaccgtgtacacttgatatgacttcattagccaaaacttgagttactttagaatcttgaggtatgttaatagtcacttttgacataggtaattaaattgatcatgtaataagctcagttgttgagcaaaatcactaatatttctatatcta

SEQ ID NO: 20738 - DNA, 1104 bp, Homo sapiens
atcaaaatcccactttctatctgagtggaaatcgttgggcgttcctaaaaagccatcctctatgagaaagacactttaaaaaaataattgactattgcggaaatgtgttcagtgcatttgggagtgtaatgaaagattttccagagcccccgtttgctatgttactttggtaactttgtattttgtcattgtgacaagtgggactaatttgcatgcatactttatagcattcctcctggtcatttatgacaatgaaggttaatttgtaaactaaatcatataggattccttgactgttcaccattctctattttagggttacttataaatagttgttacttgtaggaagttgagtaaatatcttgatagagaaatctgctaaaaaaaagaattaatgaggtttaaaaaatttttgaaaacaggtacatgcaactcccaagtgtgtctctcacactaactagaacatgcaaggacctctctcacatgtattttgccttttgtttctttgtatttaacaatgtgagtgtagtgcttatgcaaaaatattccccaatattttggacattatttatttaaattttaatcagcagtgatttaaatgaattcagaaactggttggttccaccagctcaaaagagatcagttttctaagaagttacttcaaacgcttttttcattattttttaaagttttcttgcctaaatgacaatgtaaacttgtcagcttctgatgtggagaatttatgtttaatcatctcctttttttcctgcatactcttgtgacacatagagaatggactcccactgagagactaagttctgcatgttccatattctttctgaagagctacagctagagccttatttatttggagctgttgagccccttcagtttcttctgaattccttttacaaccaaaagccagttttccccatgatcgtactccctttattttgtactatcattctttttacagctatgaccatgagttagtgtttggtgtctccttgaagaacatgaataaagcggagaggctgacttttggtgagtcacttatgacccacgccatgaccttcactgctgtctcagagaaggtatgaccct

SEQ ID NO: 20739 - DNA, 1078 bp, Homo sapiens
tgcagttttcacatcaccagtgcatccagatcccctctactagaaatatatagcatatagaagagaggtgacatacaggtaaatgtaaggtaaagacgaactaataggcactagtgactttcataaaacactatagttaactagagttttcttcttgttacaaaattatttttgtttaatgtagaatatttgtaaataccaagtaaatatttttcttgtatatttgtcaagttttgtgtgtgtgtgtgtgtttaatagtgtttaatatgcattgataccttatacattgttatgtaagctacctatctttttcacttaccaatatattataaacatattttcatattagtaaaaaggttatacccaatacaagtcaaagtttttccctcagaattttccctcagaaaagagataatttccctgtatttaagaccttaaaagacttttctaatggcgctctcagttaatttattttgaagtagagtacaatttggagaaggcattactctgaaaaatggattctttatttgatacgtaaagagtgtttttgtgttaaagatattaaacctttgcatatatattgctaataataattaccacctttcttgttttgtttttaatctttctgctctttctgatttactctttctgaattgtccagatcgtgtcatgagttcattggtgggaaatacagttggagcagtgcagtctatgtgaaccctcataatttcttgatgtgctttcttgtttcagggcgatgctggatcttttcttgtctgaatgttatgaggcttccattcatgaaaaagttaaatattgaagaatttgagtttagccaatcttacctgtttttttgggacaaggtatgggacagatctggcaagattctttttgtattgatatcagccttggtagggactgcctcttcttttgtagcttttccagttatagcctgccctttcataataggtgagacaccttttattctgacttccagagtatcaaaagttgactctttcaaaggcagaactgtttttggttggtaggtggccatttttttgcaatgaaataagtttac

SEQ ID NO: 20740 - DNA, 1043 bp, Homo sapiens
tctgttcgcaggattgttttaaagtatactgacaaaactttgagactgtaagtgacctgagatatacattatccttacttgagaatagtaatttttcaatacgcgttaaagatcattacacatgagccaagacaaatgagctggcctacttactttgtatataaatgtgtaaactcctcaagaattccaataatgaactccaataaggaaattagttcaacgtctttatggccttggtgacaaatggttacagacaatcagagcatttttttcctatccactaatggtcaagaaaaaagcagacagatcctcactatcttagagaactaagtgagaaagttggtcgatgaagaggacttcatccagagaggaagggatgtagcttacagggaagatgctgcaggaggctgaggaaagtgaggctagagcagtaaaacagatctgacaacctggtgaagataaaaaagtgacctgacaaaaatgaacggagcagagtgccaaatagagggccctttccatgctaatcttgcataatgccctcaaccagccttagcataactgagtttctatttagcttgccatattgtgggggggggtgtggtggcacaatttaagttgcagtaagttgtgtaacaaactcacaatagggccctgcagaaatatatatatatatataaaatatatatatataatatataatatatataaaatatataaaatatatatataatataaatatataaaatatatatagaaatatatataaagatatataatatatacatatatatgtataaatatatatgtgtatatatatataaatatatatatatatatatatatatatatttttttttaggcagggtcttgctctgtcacccaggctggagtgcagtggtgtcatcttggctcactgcaacctctacctcctgggttcaagcgatacccccgcctcagcctccctaatagcggggactacaggaatgtgccatcacacctggtgaagatatatatagatatagatagatatatatctataccta

SEQ ID NO: 20741 - DNA, 1026 bp, Homo sapiens
caagtagctgggaccacctgcatgcacaccacacctggctaattttttatttttttctagagactgggtcttgctatgttgcccaggctggtctcaaattcctgggctcaagcaatcctcttgcctcggcctcccaaagtgctgggattacaggcgtgagccaccgcgcctggcctattaattagatttttatcaggttggaataagttcaagcaattatgcttgtacaatgattttattagataagagataacacttgtgtgatttattatgtcaaaattatgcaggaatatactaaaatcttttgtaatttgtgggactgatcatgataccctgttaatggaatcttttattttattgaacttgaccatggcccctaagagtagtctcccatttccatgttttatttaacgtgtctgtattgaagatatccctcaagagattctaacagttttcaatatctttgctttgaaaaagagtggacagctggttttgaggggtacagtctgagcagtcgaagaaatatagcacttcggaacgattctgaatcatcgggtgttctctactccagagctccgacttatttctgtgggcagacattaacattcaggcaagtagatattaaaacatctcacctgcctcaggaagcagagtgaagtgcatagagcatacataagctttgaattcaaaacatcctgagtttattccgtcatttataggcagtgttactgtgggaaggcttctttatttcctgtagctgtagttttctcatctgtattcacagggttattacgtagattaactgggaaatgtatataaaatgcttgttatttaatatgtttatatctcttttcctcttggtaagtagaggtaagtagagtatctctcaaaagtcaatcttaggctgggcatagtggttcacacctgtaaccccagcactttggtaggccgaggcaggtggatcacctgaggtcgggagttcgagaccaacctgagcaacatggagaaaccccatctctactaaaa

SEQ ID NO: 20742 - DNA, 1035 bp, Homo sapiens
gcgtggcagcgcatgcctgtagtcctagctactcgggaggctgaggcaggagaattgcttgaacccgggaggcggaggttgcagttagccgagattgcaccactgcactccagcctgggtgacagagtgagactccctctcaaaaaaaagaaaagaataaaataggtgagagttctttcctttgggattcagagcccagtgagagagagatacatgctaagagatcaagaccttattggagcatagaggaggaagttcttaactttgtctggaatagtgtgggatagctttctgtaggaagagttccacagaggcttgaagcaattcatccagcagacataggaaaaagaggaggtaacagcatgattccaagcagaagtaacattatcataagtggagtgaatggcatattcaaggattagttgaagcattttaagcagcagagtgacaggatcagatgtgcatttaaaaaaaaaatgaccctgcctatttggagactatgttagagattgtaagactagagggaaaagagactgattaaaaagttattagaggccgaggccaggctaacacctataaccccagcactttgggatgtcaagatgggaggatcacttgaggtcaggagtttgagactaacctggccaacatggtaaaaccccatctctactaaaaatacaaaatttagccagacgtggtggtgggcacctgtaattccagttactcgggaggctgaggcaggagaatcacttgaacctgggagacaaaggttgcagtcagccaagatcacaacactacactccagcctgggcaacagagtgagactccgtctcaaaataaaaaaaaattattagaaactgggcacggtggttcatgcttgtaatcccagcactttgggaggctgaggcgggtggatcacttgagcccaggagttcaagaccagcctgggcaagataatgagaccccatctcaaaaaaaaagttattagaaagtaatccaggtaggaatggtaaaggcggtggctggtaaagatga

SEQ ID NO: 20743 - DNA, 1099 bp, Homo sapiens
tctgttgcccagctggagtgcagtggcgcaatcttggatccctgcaacctccatctcccaggttcaagcaattctcctgcctcagcctcgcaagtagctgggattacaggcccgcactaccacgtccagctaatttttgtatttttagtagatacagggtttcactacgttggccaggctggtcttgaactcctgacttcaaatgatctgccctcctcggcctcccaaagtgctgggattacaggcatgaggcactgcgcccggctgaaataactattattatgctcatttgacaaataagaaaattgaggcatagaatacttaattaacttaaccaaattgacatagtttgtgaatgatgaaaccaagatttggcttattctatctgacttgaagggcagttctgtgtacttctgtctgtttgtgcaaatgaatcacatttggtttatcaatgaatggaagatgtatatatacaatggaatgccattcaaccttaaaagagaaggaaattctgtcatttgtgacagcatggatgaacctgaaggacactatgctaagtgaaataagccagatacagaaataaacatactgcacgatctcatatgtagaatctaaaaaggtcgaagtcatagaagcagaaagtagaatggtgcttgccagggatggagttggggatggggagatgttggtcaaagggtacagagtttcagttatttaatatgtgtaaattctagagagctcaagtacaggatagggacaatagttaataatagtgtaatgtatacttggaatgtgttaggagagatcataagtgttctcaccacacacagaggtaaccatgtgaagagatggacatgttaattagcttaactatagttaacagttcactatgtatatgtgtatcaaaatatcacaccttaaatataatttcagttaatcttttttttactaaattgaagaagatggttatacagtgcttttagattcatgtgaattatacctttggattagccttttttaaagattctgattttgagtattttgttatttctttttagatcaaagaaagtgcatcacagacaagggatgttctcaaaca

SEQ ID NO: 20744 - DNA, 1044 bp, Homo sapiens
tttaagaagagaaactggccccagccaagtgctgtggctcatgcctgtaatcccagcactttgggaggctgaggcaggcggatcacaaggtcaggagatcgggaccatcctggctaactcagtgaaaccctgtctctactaaaaatgcaaaaaattagctgggtgtggtggtacacgcctgtagacccaattacttgggaggctgaggcaggagaatcccttgaacccaggaggcagaggttgcagcaaaccgagatcgtgccactgcactccagcctgggtgacagagccagattccatctcaaaaaaaaaaaaaaaaaaaaagaaaagaagagaaattatgctgtacttattttgttattttgtgtcttctaaagtttcttgctgtaacaatttatatctagtggtatatcaaaaagttattaactaatttgttacaccaggatattttccatgtgttatgtattatatttacttttgagaaatggttaaagctatgggcttacactgaatagaatatataggcatatctactttgaaaaagaataatatgaagctgggtgaggtggctcatgcctataatcccagcactttgggagcccaagaggggcggatcacttgagcccaggagttcaataccaggctgggcaacatagtgagatccccgtctctacaaaaaattaaaaaagttagctgtggtggtgcacgcctgtggttccagctactcaggaggctcagggcggaagacggctcgagtccaggagattaagctggagtgagccatgctgcactgccactgcactccagcctgggcaacagaatgagacactgtctcaaaaaaaaaaaaaaaaaaaaagaaagaaaagaaaagaaaaaagaaaaagaatacgttaaaatgttaaactcattagaagaaaaaactgataaggataaatattacataatttcaccttggtttccttgaaatatttgtgtatttaccagaataggatctgtaactacaaaaccgtgactatggagcatggaaaccaaactaaaacttct

SEQ ID NO: 20745 - DNA, 1051 bp, Homo sapiens
tctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattctgtgcctctcaggttaatgtgttaaacagtaacatggggcttggtgcagtggcttatgccgataatcccagcactgtgggaggctgaggcaggaggactgcttgtgcccaggagctcaagagcagcctgggcaacatagcaagaccacataatttttaaacatttttcattaaaaaaaagaaacagtaagatgccaaattgacaaaacaagaaacaaagttatctccctttaaaagcaaatactatctatactaaacatttgcattattatcatattgttaaaatagggaataatggttttcctaggtggtacttattataagaataaagctggccacgcatggtggctcacgcctgtaatcccagcactttgggaggctgaggcgggtggatcacctgaagtcaggagttttgagactggcctgaccaaagtggagaaaccctgtctctactaaaaaaaaaatacagaat

SEQ ID NO: 20746 - DNA, 1101 bp, Homo sapiens
gaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggtatattcttcatgtctgctatactgcctaatatttgagaacctactctagaaagcactcttctgggcattgggttgggaagtggctaagacagggttcttcaggtttagttggcaagtatatgatcactaccaaataatgagatgtacagatagtaaattggcagttgagaggagagaaaacaatgggctgtgactgttgtggaaagtttactggaagaactcaatttaggtcttaaaagagagatcctttggatgggagaggagggcattgtaggtagaaagaacagttgatgctgagaagcaggtctaggcaaggcttatttaagaggagtgtcgttggagataccaggctgtgtctaagggtgatgttaggattaatgagaaattaaggagcaaagataggttatggccagtgagtgactttagaacattataccagtctttccggcagaatttaaaattattttctgtaccttttctcctttaaaaagcattttatcttgaatcatgcaagtctataggtaagattaaaaaaaaaaaaaaaaagcggctggctcacacctgtaatcccagcactttgggaggccaaagcgggcggatcacaaggtcaagagatccagacaatcctggccaatgtggtgaaagcccatctctactaaaaatacaaaatttagctgggcatggtggcgtgggcctgtagtcccagctactcgggaggctgaggcaggagaatctcttgaacctgggaggcagaggttgcagtgagctgacatcacgccagtgcactccagcctggctacagagcaagactctgtctcaaaaaaaaaaaaaaaacaccattctaaaagcaatt

SEQ ID NO: 20747 - DNA, 1043 bp, Homo sapiens
cctcccacctcagcctcttgagtagctgggactgcaggtgcacaccaccatgcctggttaatttaaatttttttttgtagagactggtcttgctatgttgccagggctggtctcttaaacagttgggctcaaacaatcctcctacctcaacctcccaaagtgctggtattataggcatgagccattgtgcctggccagagtttttaaaaacatattcagaatattaatatcttgtttctcatttgttgcaaataattttacccccagccttgtttgtggtgattttttttttttgagacagagtcttgctctgtggtccaggctggagtgcagtggtgtggtcttactgcaacctctgcctcctaggttcaaacagttctccctgccaaagcctcccaagtagctgggattataggcaccttttgtggcgatttttgatgcccagaggtattttgtgtgtgtatgtgtgatgtctgtttttaaaatgctttggaagctcttcctggtgctgagaacaactctttttccccaagcagttaattttgccaacactatttgggcagttatgtttctctctgctgatttgtgatgttacctttattatatattaaatttctatgagtattagagtctactttagaacatttttattttaagcttttgtactgttttctttttctttctggttttttttttttttagaccaagtctcactctgtcgcccaggctggagtgctgtggggcaatctctgctcactgcaccctccacctcccgggctcaagtgattctcctgcctcagcctcccgagtagctgggattatgggtgtgtgccaccacgcctggctaatttttgtatttttagtagagatggggtttcaccatgttggccaggatagccttgaactgacctcaagtgatctgcctgcctcggcctcccaaagtgctggaattacaggagtgagccaccgcggccagcccctgttttcttgtcatttgttttaaaataagaaaaaaattcctctttttcctgtcccttaagtcc

SEQ ID NO: 20748 - DNA, 1026 bp, Homo sapiens
caaaacaacaacaacaacaaaaacaaaaaacccaaaacaaaacaaacataatagctgtattgaaggcagccagcatacatgtgaaaaaatgttcaagatgactaacttttagagaaatgcaaatcaaaaccacaatgagataccatctcactagtcagaatggctattaaaaagtcataaaattatagatattggcaaggctgcagggtaaaccttatatactgttggtgggaatgtaaattagttcagccactgtggaaatcagctggagatttctggaagaacttaaaacagatctgccatttatctcagcaatcccattactagatatatacccaaaggaaaacaaataattctaccaaaaagacatgtactcgtatgttcatcacagcactattcacaatagtaaggacatggaatcaacctaggtgcttatcaacagttgattggaaaaaaaacaatgtggtaaatatactctatggaatactatgcagccataaagaacaacaaaatcatgttcttggcagtagcgtggatacagctggaggtcattgtcctcagcaagttatcacaggaacagaaaaccaaataccacatgttctcacttgcaattatagctaaacattgggtacacgtggatataaagacagaaatagtagacactacaggatagggggaaggagggtaggaggaatggaggaaagggctgaaaagctacctatcgattactgtgctccttacccaggtaacagggtcagtctatcccaaacctcagtgtcacgcaatatacacacataacaaacctgcacatgtactcccctgaatctaaaataaaagttgaaattaaaacaatacatggctgatgggccaggcactgtggctcacacctgtaatcccagtgctttaggaggctgaggtgggagaattgcttgagtccaggagtttgaggctgcagtgagctatgattgtgccaccacactccagcctgggcaacagagggagagcctgtctcaaaaaataaaaaaa

SEQ ID NO: 20749 - DNA, 1017 bp, Homo sapiens
tgcccaccaccatgcccagctaatttttgtatttttagtagagacagggttttgccatgttggccaggctggtcttgaactcctggcctcaagtgatccgcctgcctccgtctttaaagtgctgggattgcaaatgtgcgccaccatgcctcgcttttgctgctcatttgtacgtacctctgggacatgaatgaagatcagatagttcagcctagattaattagttcttgtgttgtgggtcttagacagcagagacatgacctgggtagctgtgggtctaactgtgtgggctgttaattacttacttaactaaaagatgattgatgataactacatgaaatatttcccaatagaaaggaactaaaattcacagaagagtgttgctctgagtgacttggtcagaaggctggctgtgttctggagtgccattcctgctgggcaatgagaattctgtcacaatgaggactgtttgggaatgaatccctattttacatgttgattatcttaggaggaacctgcctttttaactagttttcagagcataggactaaactgtcattttatagcataaaaaaattgatacataatattttacatatttatagggtacatgcgatgttttgttatatgctgttctctaactaacattttttaaactgggagtaggtttgtctgccattgtggatttcctgggcagagtggagtgaaggtgccaaaagccaagaagacactgaggcagtctttaaggtataggctccgtgttccaagtcttgtggtgtggggaatggcagaaggttccctggttggtcagctctagtgttgcaggtgcgcctaaagcactatggagtggcctcaggtggttctgggaaaatctgttttggtatctataagttttctcacatagcttctttcttttttcttttaaattgtagaaagctctcttagctgtcataggtgccgactcagtaaccctgaagaataagtacctggattgggcttatcgaagtggtggctaca

SEQ ID NO: 20750 - DNA, 1074 bp, Homo sapiens
agaggtcaggagtttgagaccagcttgaccaacatggtgaaaccccgtctctactaaaaatacaaaattagttgggcgtggtagtgcatgcctgtaatcccagctacttgggaggctgagccaggagactcgcttgaacctgggaggcggaggttgcagtgagccaagatcccacaattgcactccagcctgggtgacaagcaaaactccatctcaaaaaaaaaaaaaaattaatatcatattacgttaaaaaaaaatttcctggcccagtgtagtagctcacactttgggatcccagtactttgggaggccaaggcaggtggatcccttgagctcaggggtttgagaccaccctaggcaacacggtgaaaccctgtctctacaaaaaataagctaggtgtggtggtgcatgcctgtggtcctacctactctggaggctgaggtgggaagatcacctgagtctgggaggttgaggctggagtgaactgtgatcctgccactccactcctgtctgggtcacagagtgagaccgtgtctcagaaaaaaagtatcttcctgattgagttctttgattcacttactgggggaaatagtttattcaataaaaaaaaaaaatctagccaggcacggtggcttaagcctgtaatcccggcactttgggaggccgagatgcatggatcacctgaggtcgagagtttgagaccagcctgaccaacatggagaaaccacgtttctactaaaaatacaaaattagtcgggcgtggtggcgcatacctgtaatcccagctactcgggaggctgaggcaggagaatcacttgaagccgggaggtggaggttgcagtgagccaagattgtgccattgcactccagcctgggaaacaagagcaaaattccatctcaaaaaaaaaaaaaaaatctaaagcttatataaaattctaaattctattttcctggcatttatccataaaatgagagttatactcatatgtttatagttgagtgctggtaattttattctttttatttctttattatatttttatttatttatgtttttaattatagagatgagg

SEQ ID NO: 20751 - DNA, 1095 bp, Homo sapiens
taaaccaaagctgacttaacctgtgcttccttcttaatcaccttagtgtgttaagccctcgcccccaactctgtcctcccctccccaataacacaaatccaattatgttctgagtgcatgaatcatttagtaaagggggccccagcctgcccacaaaaagaggtctctgtaatggatggtcagtgcattttattgaatcagcacagtacaaaaataaataaaaataagggaaggggaattaaattacagccaaactgagcttcatgactttgtcagattataaaccacacatactcacaaacacactacacatacatacaaaatgagacaaatataaattaatattaacaatacccacagtttggtcaaagaatagctacagaagaaattgcactaaaaaaccaacatacatcacacgtgtgtaattagcagtttcaaatatacagctatgaataattctgagtgaaaaaaatggcacattttcttttcattgcaagtttaactgttggaacaaaactaagttctaataactgcatggaaagaatatatcaaccctccaggtttacaagaaaaagagaaaaaccaaatcctgaactattattcctgtggcttgttctgtgcatgggtgtaattttcacagccatctgttctaagattatttttcttaagacacaaaatgctcctggtttgcatgcacaatatcaccgtaaaagcaacaattaaagaataaaggtttttttgtaggtttttttttattgttgatctaaaagtagtcttcatagcagcatggcaaatgggttctttgcttgcacactcaagtatatcagttgttcctttacacaatactgatgaccagtgcaaggggagagaacacgacaggcttcacactgagggaactagagagttcttcccttagtccccaccacttccgaaatgtccacctcctccgaagaataaaaaaataaatacggagaaagagaaggaaacagacacgcaactggaatcctgtggatgcaacgtaactgcacagttcgcagccaggttccgccagctgagggtgatacacacatgcgccctcctcctgagacttggcac

SEQ ID NO: 20752 - DNA, 1057 bp, Homo sapiens
ttgaacttctgacttcatgattcccccacctcggcctcccaaagtgcggggattacaggcgtgagccaccgcgcctggcctaatttttttatttttagtagagaagagttttcaccatgttagtcaggctggtcttgaactcctgacttcatgatctgcctgccttggcctcccaaagtgctgagattatgggcgtgcgccaccgcacctggccctgagatttatttatttaatccaggttggctggctagggttctatggaccaagaagtactcaccacccacatctcagcaaattaatgttttcccgaaacattttaaattattgatcatgaatttcactagcatctatatttaaatattccttgacgctatggctactaaacacaggagcaatttgtatgaggaactgaaaattcctccttaacctcctcactgttcttttcagtttgttcctgattatgcgggaatttacaggccttcatcacatgaagtctgcctctacagaaagactgctttactcttcactatcatagcactcatgagtgctatgagagacaatatgcgttttttgagccttctcttccctattttaggtgtgtttctaaggagtaggttggttgtcatggttcaggatggaagaatactggagtaggcagcggagggaggcaggccatctggccctgagggaggggtctttaggaaatcagtagacagcctgctggccagaagattttagatgtgttcttgcttaaagctgaactcaaggtcggatcttttctcaaggcccagttctagacttctaaccttccaaactgaggtctgatcttttgggtaagccaatggaaacattgtgtgttatctctagattttgctgaacaaaggggcgcgattccccgccctatgttctcagcagctgagtcctaccattccctgattgatttccaccccctgccattcccaataccgcctgcaaagaagatgaactttgtcagtcacctttgaatatggtgcagtttgaattctggaatgcaggaataacagcagttcacgcgtat

SEQ ID NO: 20753 - DNA, 1052 bp, Homo sapiens
tggatagggaggggaaggaagtaggaattacaaagcagcacaagaaacctttggggagtaatggatagtttgagtgcagtgatggtttcacaggtataatatatatttcaaaacctgtcaaattgtataccttaaatatgtggagtttattgtatgtcagtgatgccttaataaagcatgccttaataaaagtgactagaatctggagtatagggagggatgttcaggtgagacagggccatgaattgtgtatagaagaaaacagcacgaacaaatacataaaggaactatttgaaaatacattgggctggacgtggttgcccatgcctgtagtcccagcactttgggagaccaaggcaggaggatcacttgagtccagcagtttgagatcagcctgagcaacatggtgagaccctgtctctacaaaaaaatttaaaaattacctgggtatagtggcacacacctgtagtcccagctactcaggctgaggcagggaaggattgcttcagcccaggaggctgaggctgtagtgagctgtgaccattccaccgcactctcgcctgggtgacagagcaagaccctatctcaaaaaaagaaaaagggaaaagaaaataaaaaataaaaaacattgccactgttctgaaaacagtgagtagtccagagtggcaagatcagagattgtgttgagaggagtggcaagaactaccagaaaggtatgtagatatgaccagattgtcaaggaacttgaagggaatgtaaatgagtctgaagttacgccaaagcaggaggaagtcatcaaggaaacatgtagagtgaaaaggggccaggatggacccctaggcaattcctacatgtaataaatgggaggtcaaaaggcaggaggagacttaggggaagtactctcccagaaagaagacaacaaggtcaaatgcctccgcattaaaggagacctagccctagagcagtccctttgatttggtgacctttgaaagcaccttttgtaaaagcattgagggtaaaagccaaattgcatgctaaaattaataaaaaga

SEQ ID NO: 20754 - DNA, 1031 bp, Homo sapiens
aggttgaaagctgagataggccaaaagctgggcctcttaaattaaacagcccagttgtgaatgcaaaggaaaagttcttgaaggaaattaaaagtgctactgcagtgaatacatgaataataagaaagtgaaacagtcttattgctgatacggagaaagtttgagtggtctggataaaagatcaaaccagccacaacattcccttaaaccaaagcctaatgcagagcaaggccctaaactctcttaaattctttgaaggctgagagaggtgaggaagctgcagacgaaaagtggaagctaacagaggttggttcatgagaattaagaaaagaagacatctccataacataaaagtgcaaggtgaagcagcaagtgatgatggagaagctgtggcaagttattcagaagatctagctaagataattgattaaggtggctacacgaaacaacagatttttcaatgcagacaaaatagccttacactggaagaagatgccatctaggacttccgtagctagagaggagaaggtcaatgcctagcttcagaggacaggctgactcttttgttaggagctaatgcagctagtgtctttaagttgaagccagtgctcactgactgttccaaaaatcccagggcccttaaaattacacaaaatctactctgcctgtgctctataaatgaaacacaaggcctggattacagcacatctgtttatagcatagtttgctgaatattttaagcccactgttgagacctgctgctcagaaaaaaaagattcctttcaaaacattactatgcattgacagtacatctagttatccaagagcactgacggaaatgtacaaggcttgattaatgttgttcccatgcctacaaacacagcatctattgtgcagcccgtggataaaggagtaatttcaactttcaagcctgattatttaagaaacacatttcatggccaggcacagtggctcacgcctataatcccaacacttttggaggccgaggtgggctgatcacctgaggtcag

SEQ ID NO: 20755 - DNA, 1042 bp, Homo sapiens
cgaggtcagcagatcgagaccatcctgggtaacacagtgaaaccccgtctctactaaaaatacaaaaaattagctgggcttggtggcgggcacctgtagtcccagctactcaggaggctgaggcaggagaatggcgtgaacctgggaggcggagcttgctgtgagccaagatcccgccacttcactccaacctgggcaacagaaggagactctgtctcaaaaaaaaaaaaaaaaaaaaaagtttagaatgtaaggaaaagacataaagaaggcatctctgcaataaatgtctataactcaaataagcaagcttattttcctgctaatatttatagcaaagtatagaaaattaaaggaattttaatttgttactcttaatttggataccagtactaatgaatgcaagagtttttgcctgggagattgaagtattttatctctatctgggtgcttatttagcaaattctgatctattaagtgccttctacaagtgacagaaatacgtgaacctggatgtagatttcatcagttgctttcttttcctagctagcatatgcatgctgaggtacatttctaggcgtatgtcctctatctttaatgtatgtaaggatttttaatttctttaaaatttataaatgtgaagagaagactatcaagatgctaggaattttttggtggattttttttttttaattcttggtgtttctatcttatgaattaagagtgaagtggaaatgagagataaaatctttcctcccagaccccagaaaagtcaggcttgaaattttgacttagagttttagtcatcaacttactatttactttttgggaaaaggttaatttgattttttctagctattttcctttattgtcaactatcgtatcattgccatgacattgaaattcacattgtattttataagcatgatgttgtggcacataatcttatttgtccctgagttaattatggaaatccaaaggttcgggagggaattaacttcagaccaattctttatcttccagataatttccctaaagtaca

SEQ ID NO: 20756 - DNA, 1063 bp, Homo sapiens
tttttagggatggtgtctcgttatgttgtccaggctggattcaaactccagggctcaaatgatcatcctgtatcagcctcccaagtagctgggactacaggcacatgccaccatgcccagctccaaaatgtattttttaattcattcttttgagaatgatccaaatagttttccatgcattttctctttgcagttgactggtctgagtgtctccaatggaaaggaccaacttgtagtgttccatacgaaagacaacaaagacctcattgtctgcctcttcagcaaacagccaacccatgagagtcgaattggagaacttgttggagtgctggtgaatcatttcaagaggtaaagtttgatttttgtaactaagacacgttttaaatctatgaaatctttaatcgtaattatcactgagcttgttttgtgccaattttaatgtattgagctatttttctccataaggacaacttaaatcatctgtttcgcagaaggtaaaattagcatcccagcttactttcaaggttaggaatgatcctctacttttccagcctccagctgaaccaacaatgagagatttccctaaatggtgatttttattccactgtcgatccaaatgcaattaaatccaaaagatagacaaattactttatattcttctcgtcatagcttctcatttaccccaagtataatcagtttgtgtgtccactatgaccataagcaaattagaaggcagatttgggatggtttgcaagtccatgaagactacaagaattcctgagagaggcagtgaccactgcagaaacatggagtcatgatggaacatggcataatctgagaacttcatagtaagccctgatgatacctggggcaggggggtgaacaatgatataataaatataaacagagagcaggtcctgagagtgatggggaccagtgaatggataattttaagcaggggagtgattttgtctggttatttattggagttgtttcagagattggatttctcttcccataaggggtcatggagtatttgggtgggtgtatctctccaaagtca

SEQ ID NO: 20757 - DNA, 1035 bp, Homo sapiens
atttatttggttatttcagtgggaattttccattttagttaaatctcattctatggaaacaagtttgagaacagccggccttgattattcgtctgatcaaaaggaagttctctgtttgcttccaacctccgtacttcaagctcctgtggcagaagagaggatataagcatcgtgcagggctagggtgccgccaagcgcataagagaacttgtacctgttttttcccaatcaggaacaggttatttttggtttaagctttcagttgcttagccaaaaaattttggagtcatccttaaatcctctctggcccccacatctaatccattgtcaaattctgtttgttcttccttcagaaatatgcagaaccaacacttacctccacctccacctccacctccctgatccaagccaccttactctagcatgtgtgtttcggaaatagccatctaacaggtcttcctgttcccagcctatagcaaccacaatgacccttttaaagcatgagtcaggtcatgtcccatctttgttccaaaccttccgatggcttctcatctcattcagaggaaaggccaaagtcctcatcatggtctcatggctttgtggattctgaccctgactctcccagctccttacactgctcctctgacgcaccaagcaagctcacatcccggagcctttgcacttgctgtgttctcttctcttcctagaacactctggtgcaggtctccgtatgaccagctccctcacggcctgtaggtctctgctcatctatccttatcagtggtgcctgcccagaccaccctatataaaccaccctatataaaccacacccactctgcattccttccatcttccacactcccggtcctccttgccttaccttcaccatcctacatactatatgtctactcatatatttgctatctgtcacttctctccagaagacaagcagctagcagaaaggacctttgttttgcttattactgtgcccccactgcctacaacagcactgggagtttagcaggcacctagaaa

SEQ ID NO: 20758 - DNA, 1019 bp, Homo sapiens
ccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaggagacttagactcccacacattaataatgggagactttaacaccccactgtcaacattagacagatcaacgagacagaaagtcaacaaggatacccaggaattgaactcagctctgcaccaagcggacctaatagacatctacagaactctccaacccaaatcaacagaatatacatttttttcagcaccacaccacacctattccaaaattgaccacatagttggaagtaaagctctcctcagcaaatgtaaaagaacaggaattataacaaacttctctcagaccacagtgcaatcaaactagaactcaggattaagaatcccactcaaagccgctcaactacatggaaactgaacaacctgctcctgaatgactactgggtacataacgaaatgaaggcagaaataaagatgttctttgaaaccaacgagaacaaagacacaacataccagaatctctgggatgcattcaaagcagtgtgtagagggaaatttatagcactaaatgcccacaagagaaagcaggaaagatccaaaattgacaccctaacatcacaattaaaagaactagaaaagcaagagcaagcacattcaaaagctagcagaaggcaagaaataactaaaatcagagcagaactgaaggaaatagagacataaaaaacccttcgaaaaatcaatgaatccaggagctggttttttgaaaagagcaacaaaattgatagaccactagcaagactaataaagaaaaaaagagagaagaatcaaatagacacaataaaaaatgataaaggggatatcaccaccaa

SEQ ID NO: 20759 - DNA, 1027 bp, Homo sapiens
tggtctttactgaatgtgtatcacttttgcaccattatgaagtcaaaaaaatcaaaccatcataagttagggatcatctgcacaagacattcctgccttttggtcactgttgatttgtccaaggatgggcatctgactcaagctggaccaaccacagttcttccccaggactttatatttgaaatgaaatcatctttctctctgttttggtggctgaaattcagaatgtgtatgttttggaattgttgggagtcaagttctgagggttgaagagtagaaaagagtagagaagaatgaggggaaagaaagacgagagagtaagagagggagagaataagaatgaattatagccaaaaggcaaaaacatttccttagttctttacaagcagtgattcctaaccttttttatgtcatgacacacatagcaaatggtaatataaatactgcccattgaaggagatggacaaggctgtgcttatggctggcggacacacctgtaatctgaacccaggtaaaaagctgtactctgcagtgttctgagaggtcatacttgtaaatcactcccacgttgagaaaagctctgttccagaatctggttctaattatcttggtcctaacccttgggtcgtatgagatacccttgcaaccttcctttagatgccatttcctccaggctgcttcctgaactccccagatcctctccagtgtgcgccagtaacaccctgggctttttgttgtaattatctaattatttatctgtataatctgttgtatatgaaccccaggaggataagaactacatctctcttttcatctttatagccctagtgcctccagtggggtaaacatctcctgaatgaaggaattatgctctgcccacataaaaagatggaacaagaaaattgtaattgaaacaagatcttttgtgtaaatattctttctttctaaaaggagacggctttgaatggcagccctggaaaggaaagtgaatgagaactatgtctttttggcattatgtgtctggtag

SEQ ID NO: 20760 - DNA, 1022 bp, Homo sapiens
ttcccttggttttgcccttcttgtgctggtttcatcctcagctggtggaaggtcgttgcaacagttctgtgcatctcacccaggcacagtaatgtcctgaggaaggagagtgagctctctgcttgtgttgtgctccttgcttaggaagccccccagaagacttccttacatgtcacattagttagcatttggtcacatgcccattattaaacctgccactggtaagaggaatgtggttatcatgatggaatagtcaggcgctgatgatagatttctcatttcctgcagcatgtggctgtatggaagggagtggatacctgaacaaagtcaggcttttttaggaaagaaggaattttaggggcagaataggatattggataggcaaccaaaagtgcctcctctacacagttttacaagctatgtagacagaataggatttattcagaaaagaatgctcaatatgttgagggtacttgaaaccatgtcatttaaggaatgactgaaggaacaagacaggacatgaacaccaacctcaaatacttgcgtatgaattgattatgtttattctgggagaccccaaaagacagaattcatgccagtgggtaaaagtgaagagatgtagatttatctttctgctccttttcttcctcttcttctcttcctcctgaagaatttggtcctaaagccattgggttggggcacagcaaggtaggcatccatcccaggggaaggggagccacaggggcccagattagagtttggagccaagttgagtaaagagggggccaatgcatgaggacctgagtatggaaaaagagcatccgtgctggcatggtcttggtgacagcagtgggagataagtgataaacagggagattgacaaacaagtaaatatgttgaggataatggagtcaggtttctcatggtcataaaagagagctccaaatatggaaaggggaaaagtacagtcaaccctttgtagttagattggaatcagaagttttcaatatacagctagacag

SEQ ID NO: 20761 - DNA, 1707 bp, Homo sapiens
attgctttgctgtgtttggctggaaaggcaagtaggccaaactgagttctaagtaggtaaggtgctactctaaaacatattactgcccttggtatttgaattgtttgtgtggttgaacaaaccaaacatgatgagtgcatttttccacacagtgtgcaatttatgactgcttgttgacttgtggtaggcagctgctattggcagaatctgttactgtttgcatctccacctctcaggttcctattttatctgaaactcttactgaaaagaaacctcttcttcaacttcttgatttaccctaggctggggttcccaaatccagctttgtgtcatgatcacccagcttttaaaatacgcagattccccggactctgtcttctggagatggtgatttattaagcctccttagtgcccaggtgagtctcatatgcagccaggctcggagccactgtcctaggctaacgtttttcactccacagttgtgttctattaaaactaaatggactatcactgtaatgtgagctgactgacatattaacaaatgtattacaacttatccaaatagtcagtgttcttagttctgttttggttattaaatcaatttaatcgttgataatcacactttattctttatccttacaacaagttttccattttttcacccgatggttatggttatccagttttagctacaatgtatgtatttttctgtcctcagattatccataaaaactgtataatcccaccctccttgttaataccttgatttatttcctttacagtcttttctagacatataaaaaatgtacatattcaaaactttggcatcttcctgcttatacaacatatagttttgtaaactgttttctcacatagcatggtatcttaaatgcttttccatgccattaaggtgcctttgaaagtatggtggcagccacgttgtctttattcttttctggatatgcaggagcaacccagatagacacggttcttgttctcatagaactgataaaccagcaaggggaatatactaaaccagtaaacaaacaaaaggataactacaaatagtaataagtgctatgaagagaaagagcagagttcccccataggggaaatggaaatgacgtgtccaagtatgtgggtgtgtcacagggaaggcactttatggggaagatagctttaagcaagatcagaaggatgcggaatatgtgcctgttgggggagaggtggggagcgggggaacaatcagatagggaagagagagaagacagagacataacttttattgattatttatttattgagacaaggtctggctctattgcccaggctggagtgcagtggcacaatctcagctcactgcaacctccacctcctgggctcaagctattctcctatctcagcctcccgagtagcggggactacaggcgtgtaccactatgcccagctaatttttatattttttgtagagacggggttttgccatgttgcccaggctggtctcaaacttgtgagctcaggtgatccacacctgccttggcctcccagtgttggaattacaggtgtgaaccgtggcacctggccgagacatatttttagataggctcagtttctgaaactgaaaggtatccagtgaggctagagtctttgggcagagtggggcaggcaaagtaggggcaggtgaagatggagcactcatcagggacc

SEQ ID NO: 20762 - DNA, 1030 bp, Homo sapiens
atttttttttttttttgtatttttagtagagatggggttttgctatgttggtcaggctggtctcaaactcctgagctcaagtgatccgcccgcctcagcctcccaaagttttgagattacaggcatgagccaccgaacccagccaagatctcttgaatagaacaatgttttccaaactttagttttgagcatttgtgggaaaagagaatcaaaagtatgcttccaatagggaatcatggaaagagcacaggctctgagacgtaaatgaccaagttcaaatctcagcttcagctgagcatacttctcttaccataggcttccctaagcctcatttccttatatgtaaaatgatcgccttttagggttattgagatgaaatcacatgttcagcaagtgcctggtatataattctcactcaactaatgctaactcttcctgaatccttcccgaatggcctcacctccctaccctgaccccataactgctagagagctagatattttcatctcttccttgtcatttcttcctccctcactaagacaaagttttgtcttttttgtttgttttgattttgtttggggggcaaggatgaaagtttgcaatggcgcaaactagggaattcagattacctagcagagagtgcaagaacacgaaatagacaaatctggaccttaatcttgtctttgttcctttactaccacctgtgtgactttggacaagtgacttagcttctttgagcctcagttttttcatctataaagatgatgtgttcttgtgaaattatagcacatttaaaatatgtgtcaaatacctatggtggtggctgaagcatagtagatactcagtgggtacccctctgtctctgctccattccctggtccagccctgtgaaccaaaaatgcccttgctattcccaattcactctgtaactatcaccctatgcattctcataatcacattccctccaggtatcactatttaatttctagaaatcgttttagactctttggaaaatgaaatatattcatat

SEQ ID NO: 20763 - DNA, 1086 bp, Homo sapiens
ttcaagaccagatgtgagaaatctttcccaatcccccaaaacaggtcaatgtcacattctcatgtgctctcaggatacatggacatttattcataacagagaatttatcatattcatattcctcaccaacctatggaatcctcaaaggcagatagcctgttcagaggtagatccaggttttctggtgctttgaacctcataatgcttgggggcaaccacctttaagaaaaagaatgtaaatcatgaatgcagaataaaatgcaaggctttggaaggggaaggtgcaagtgagtggctgtgaagcaaacctacctttaatccttttgcgttttctgtgatgctacagaatttgcccttccccatgtttaatacatcttaaaatgaattaactgagtactcaaatgttggctgattggtcttcaaccaatggaattatttcttttttttctttctttttttttttttttagcagacaatcttctcaaaatactgtactttaatagaacttaactgtgtgttggggcagtgagttatagattagaagaaaggcaggaaacagacacacacatactcaccacaccacccctgtattctttctctgtggctgtttggtcatttggaaaatttggtgggacaaagggtgtctcttgcttgccagggaaaaaaacccatagataccctgggtggtcttcaagtaaatgtaaacctgccattggttcagggctctagttagaaatagctctagttagatttataggagaggtgaatggcacactaaatctttttggcttccatgtgaaattctttggcaacctcttttgaaggcctttggaaaaggacagtttgctctctgcctgttttgtacattggcttcatattgggacaaaaatgggaatttgggttttggagctgccatttggagtgaatcaccctgccgcctggtttcctttcctactccgtgacagatttccgagactatttttattcagggtcatttcttgaccctggagacttctgctgaatttagttcccaaatagagccagatgtgggtggaatcaagcacttagaagttgctactggttcat

SEQ ID NO: 20764 - DNA, 1086 bp, Homo sapiens
aagttacttaacctctctgtgcctcagtcttcccgtctgtaggattggggttgtcctgagggttaaatgaattattaataatatgtgtatacatacttcaaagattagtgcctggcaaatccatattagtaaaactgttttaagttttcccaagtgcacataaaatagataaaggggtaagttacatagcaatttcatagattaaggttgttttaaattaagagattctactcctctcccccacaggaaataagttgtgtgctttgagaaatgcctttataattttgtcactctcagttataatcatttcagtttttcagacattggtacatttattatgtacatactgtatacaagaccatgtagtaacagttgaatatgaagcctttcattttaacctccatctttcacctccagcaaatacatgggcttagccagagcttttgcagaattttcagaatttgaaattgaaggcatagagtctaacagggctacattagtttgtaggactactcctctgtaatagaattaaaactcttgtggtttttaaaaagtaaattgagggaaggcacttagaatttctgcttttttttttaaagcattaagtctcttaagtgtgaagtttgaatctcaaaatagattactaaggtgagcctaacaactcctatgtgtacagaagagaatgctgcaatttatttatatttatatttatattttttagagatgggcccttagagttgctatgttgagcagactgttcttgaattcctggcctcaagcaatcctcccatcttggcctcccaaagcactaggattataggtgtgagccaccatgcccggccgaatgctgcaatttaattctactgtgtgcaaggtactctaggagataagctaggagtatccaaagaactacaagatgtgctgcttacctctcgaagaggtgacatctcaatgaagacctggagaaaggtggaattttctattgatttaaagaatagttcaagaaaacaacatcaggaggctgagacagaaggattgcttgagcccaggagttcaaagctgccgtgagctatgatcacaccactg

SEQ ID NO: 20765 - DNA, 1033 bp, Homo sapiens
gactttggacatcttagcaatcttggagacttatttgaggaaggagaagagacatcagtgggcggaacactagcaccttggttccttcattcattcattcatcaatttgctatttcgtagcaggtcctgtgctgggtgctagggatacagaaatgaacaaacacagtcctggctctggagttgctcacagtctttgcaagacacacttgtaacaaggtgtgataaggactttgatgtttggaggtactaggggccctgggagcccagaagaagggcatatagctgaggctggttttctaagtgatgagatgatggctagtgaaagcttcctagaagaggtgacctctgagctgaggtatcataagaagcagctcttccaccagaggttctcaagtttgtttggtagaatccacctgggggcttccaaaaaacctgatgcctggggccacccagacctatcaaattggaatctctgctggtaattctgctgtgcagccagcactgagcgctgctgaattagaggaagaaaggtggagcaggcattccaggttgatggggaaggggataagagctaagacaagggatgacatgaaggtgggaaagaggcaggcatgtttagggggctgcaagccagaccacagggactgtgaagcagtggacagatgaagcaggaagagctatgagggctgcaaattgggggagcttgggcagaccctgcaacccaggtcccagctgtcttgggcaggaagcctccatgctggtaggccaccccatgtcctgcacccatcctgctgtgctagccacctcggtaaggggcaggaatttaaggaatacttccgttcccatcgctgcctttctgtggagctgtcagctgcgctgccagctgtgtgcagagccccaccacttggaagagcactggatcagtcataaagagcccatggcactcagagggagctcagggcttccagagcagcatggaggcctcatggggtagaccgagtgtgtctcatggcctgtcagagaccctgggtcc

SEQ ID NO: 20766 - DNA, 1026 bp, Homo sapiens
gtggtggctcgtgcctatagtcctagctactcaggaagctaaggcaggaggatcacttgagcctgggagttcaaggctgagatgagctatgatcacaccactgcactccagcctgggcgtcagagcgagaccttgtctcggaaaaacaacccaccaaccaaccaaccaaacaaaaatagtgatggggttgaaaagccctgatctagactgagatccctttgttcagggccacattttattcatctttgaatccctaggaactctcatagagtaggttctcaataaatgtcacatatacaaatgagagggagtgaatggaagcaagtgggtctaagccaccttgggaaataactctacttaatccagtgcctcttctacttctaaattatccccaaaagagcaaaagcattttccctcagataccctctgcggatggtcacatggaggaagggcagtctcctagaatacggaaaccatacagtacaataataacaggcaacacttagtgagtgcttactgtatggctcaggtgctatactaaaagcattgacatgcgtttaactcatttaatcttaggagacaggaactattactctccttggattatattaatagttgaggaaactaagagtgaagtgacttgcccaaggtcaccttgtcaaaaagcggtggatcacagggcactttgtaactgttgtttcccattgggatttctgagaactgaaatcatcattcttccccccatcagagaccactaaggagtacacactttattgctggcgaaatagggtaaggcagagtattgtgggagtgtgtggagaaaatctgaggataacaccctgcaacaaagaggacttcccagcctagcaagggattgtgaaaagcactggactgctttaaccttgacagcaaacttccctcatcttaattcttgctattttggggatcctgtcatgttttgcacattttattattaaatatagaaaatatattggactaggaaatcaagttacatctagtcttagt

SEQ ID NO: 20767 - DNA, 1085 bp, Homo sapiens
aaattgaaggaggagcaattttgatgaatacgagaaagaattttttgatcatcaaagtggggaaatgtttgaatgactgcccaagagagtgttgaatttctgactgtttcagttgtctattgtgtgacaaattacccgaagacttttggtggcataacatgacaaccattttattgcctatgattttgtgggttagtaattcaggaaaggaggacatatttttttttgtcccatatgatgctgattgagctggaggatccaagaaggctgcacatgtctgtacctttggagctagctgttggctgggatatcttggttctctgtgagttctctttcttggtctctcatcacttataaacctatatcgagtggccgagcgcagtggctcatgcctgtaatctcagcactttgggaggccgaggtgagtggatcacctgaggtcgggagttccagaccagcctgaccaacatggtgaaaccccgtctctactaaaaatacaaaaattagctgggtatggtggtgggcacctgtaatcccacctacttgggaggccgaggcaggagaattgcttgaacatgggaggcggaggttgcagtgagccaagattgtgccattgcactccaacctgggtgacagagcgagaccgtctcaaaaaaaaaaaaaaaaaaaaattctagctcgagcttcttttacatggtggctgggccataatggaagctgcaggatctcataagacctaggcctggcagtcatacatcatcacttttgccccattctttttgtcagagtaagtcacaattatagcccagatacaagaggaggggacattgacttcacctctaaaggatagagggtaaaaatcacattgcaaaagggcatgcaatgtgattgggattattactaccaactttattttttgaaacagagtctcgctctgtcacccaggctggagtgcagtggcgcaatctcggctcactgcaacctttgcctcccgggttcaagtgattctcttgcctcagcctcctgagtagctgggattacagttgcttgccaccacgcctggctaatttttgtatttttagtag

SEQ ID NO: 20768 - DNA, 1088 bp, Homo sapiens
tttgttcccatattcctttctgaattaataggaagaacctccctcatctctaattctactaggctactactctatctccctcctgcttttcatcgccaaacttttgagtccttcacctaatcagactatgatatctctaggtagtcgtcaccctccaaattacgtttctgctccttataattccaacaaattgcccacgttctctttcacctcagaccttagcatatgtaagcgttcttttacacaccttccccaagcttaatctggccaactggtttcagcctagaagtcacctcttccatgaagcctcttcttacttaccagggttgagtactcaggagaacctggtatttactccaatcatagtatgtattgagaatcagggtctgctttgctagaattgtatccatggtacgttgcacatagtaggttctcagtaagggtagaatgagcaagagcctgtactgtactttctcaactctgatcctctcatcaactcttttttttttcttctgagaggaatcttgctctgtcacccaggctgcagtgcagtggtgtgatcttagctcactgcaacctctgccttcctggttcaagcgattctcctgccttagcctcctgagttgctgggactacaggtacgtgccaccacgcccagctaatttttgtatttttagtagagacagtgtttcaccatgttggcgaggatggtctcgatctcttgacctcatggtccacctgccttggcctcccaaagtgctgggtttacaggtgtgagccaccgcgcccggccttgttcattctttttatgctcacatctttaaatgtgctaaaccctgttgattttgttggagtactgtttgatgtgtggcttttcttcattcccactgtcattgccttaatttaccagaggtcaaaactggacgtttaaagtcaggctgggcacggtggctcacgcctgtaatcccagcactttgggaggccgaggtgggcagatcacctgaggtcaggagtttgagaccagcctggctaacatggtgaaaccccatctctactaaaaacaaaaaattagctgggcgtggtggcac

SEQ ID NO: 20769 - DNA, 1030 bp, Homo sapiens
tctcatgaccaagccagttgacataactctgcttggtaccatctaataggaacaccttttttttttttggagacagagtctcactctgtcactcagactggcgtgcagtggcgtaatcatggctcactgcagccttgacctcctaggcttaggtgactctcccttctcagcctcctgagtagctgggacctcaggcatgtgcaaccacacccagctagtttttgtattttctgtagagatgaggttttgccatgttgttcgtcatgaactgggctcaagcaatcctcctgccttggcttccccaagttctgagattacagatgtgagccaccgcgccaggccggaacacctcttaagggttgtggaaaaggcgtttttagtgaccagcatttaagaagacaaaacaaacagcaacaataacaaaaaagggcacaatttcttttctaattacatgtgcattgttatttaaatacagtcacacccatctctatgagcgtcatgcctaagactttctgagaacacctctgtaaacctaagaagttgttagggggactaattccaccttgattttttattcttgtcatagaacctttaatactgccatggttttaatgatagaggcttttataccaaacttgtactagtcatagtgtttatgtttttggaggaaagatttaacctctataccttagaatctcataacttgttaatacaataacagaattaaggtattagagtttaatgagaacgcatagtttaaattactattggtgaagtctcaagtgaggagctgcttcattgttgtttggtaatggttactggtttaatgatgattactggttatttttgtttcacttctggttattggtaatggttatttggtgtttgtgtaagaaagattttggcaattgtaaagatagtctttttttttttttttaattgagatgggggtctcactcttgtcaaccatgctggagtgccatggaatgatttcagctcgatgcaaccttgcctcctgggctcacgcaat

SEQ ID NO: 20770 - DNA, 1014 bp, Homo sapiens
agctccgtgtattcaagacactgctggttgaaagaaaaaaaagcaatacattccagctccacctttttctaaccatgtagttttgggtaaattacttaatatgtagatcctcattgataacatgggaataatagtactcagtttgctgggttgtgaggattgaaaataatacttgtaaagtgacagagtctgatatgtatacgtgatcttattgttattatttctgaggcgtcgtctcgcccttgttgcccaggctggagtgcaatggcgcgaccttggctcactgcaacctctgtcttccgagtagctgggattaccggcacccgccaccattcctggctaattttttgtatttttagtagacatggggtttcaccatgttggccaggctggtctcgaactcctgacgtcaggtgatccacccacctcagcctcccaaagtgctgggattacaggcatgagccaccacgcctggctcatgatcttattttccttacgatattccttgtttgaaaatacaaattgttcagaaaaactaggagttctcaatagaacctaaagcctaagaaaattgtgtcactagacaccatttaaaagaaggattagaacttaatattatgttcatgactaggcatcgtagcccacgctggctaaccatcccctgggccgccctgctgcttggcggtttactaaccacagctacatgcatgcgctcactaaatcctcacgccaacctgcgtttctgggatgagaaaaccagagttcgtaaaggttaggtaccttgctgaaaggtgcatgggtgaaaggcagggatggatcctcgctgagtcattctcattctaccacagccttcctcagcagcttcctgactttcctgaggggaagtagctagtcctagcggtttagactgggcagtgctagagtgagtgggacaagcatgggtttttaggtcccacagacccggcttctaatacctcccagttgtgggacgctgaataagctcgtaacccctag

SEQ ID NO: 20771 - DNA, 1081 bp, Homo sapiens
gcacgggaatccagacacatgtctgcctgataccaaacccattttttcccatctgcacgctgccttctgctgtaaatatgtaaatgtttccacaaaattctttttcatactttgccctgatagcagcaggggctgcacatcccaacctcttttcagcttagctcaccataaaaagcgggatcagagatctacttctcagctctttctgatttcccccagggaagttacaaaagaatgacaaaaacttggagaaggcagatatcattagtattaaagagaactggaggtttagggggaaataaagctgaataaaaaacagcagggctggctgagcgtggtggctcacgcctgtcatctcagcgctctgggaggctgaggtgggtggatcatttgaaatcagaagttcgagaccagcttggccaacatggcgaaaccccatttctactaaaaatacaaaaattagccgggcgtggtggcgggtgcctgtagttccagctactcagaaggctgaggcaggagaatcgcttgaacccgggtggtggaagttgcagtgagccaagatcacactactgcactccagtctgggtgacggaacaagactccatctcaaaaaaacaaaacaaaacagggcctatgcatccctgagatgtgaagcagggggagataagggatttagatgtatatcctactaggtttttgctgtgttctgccatgcagttgtctgggcaggatttatttatattttaatttatttcaggggccatgctaatcatctttgtattgttccaattttagtgtatgtgctgctgaagcaagcactgggtaaggtttaaactgtctagttctgtgtgctggggtttggcattggagaaggctctgtgatgcatagaccttaaattagagttaggtatattattaatccaaagtgatcctgaatgctttctatcatttttttcttgtcctattgcactggctaaactgacttttagtactacacagaatagaagcaacaataacaatcatccttgtcttgttcctaactttagtggactatttacaatattttactgagttagatgcc

SEQ ID NO: 20772 - DNA, 1046 bp, Homo sapiens
gtatcattaaggctgcaagtaacaaaacctaggcttaaagaagtgtaaatactagggacacttatttatatttatttcttttatgtttcaagacagagtcttgctctggagtgcagtggcacaatcacggctcactgtaccctctacctcccaagctcaagtgatcctcccacttcagtctcccaagtagctgggactacaggtgtgtgccaccacacccatctaagttttgtattttttgtagagacggggtctctgtacgttgcccaggctggtcttgaactcctgggctcaggtgatctacccgccttgacctcccaaagtgctagggattacagtcatgagccaccatgcctggcagggacacttattatctctgataacaggaagtctgaggtttgttaatttagtggctcattgtcaaatggcgtagagcctttgcatccttctgctctgttcttttatgttggttttgtcttcaagcttgttccccttatgaaagcctggctgcagccattttgagcatcaatccagacgtgacaatatctacaggcaggagaaggatcgcctcctgtgtgtcctttaaagaacaaggtgttaacatgccaggaactgtggctcctgactgtaatcccagtaatttgggaagccaaagtaggaggatcgcctgaggccaggagttccagaccagcctgggcaacatagcaagaccctatctctataaaataaaataataaaaattaagaaaacaaggtgttaaaagacaaaattaaagcaaatatagttttgcagattgtaattgacttttatttgcaattctagaattgggctgccctcagaaccaggacaggttcagagaattccagagctgcaacatagtctgaaagcatttatggtcagaaaacagaaatgagatacaaagacaactaattggttacagctctgcctttgccttatttgaaaatggtttgaatagttggctgcctggaacccactgaagctgatgatgtgattggctgagcctcagcaatctgttacaaaagtat

SEQ ID NO: 20773 - DNA, 1047 bp, Homo sapiens
ttcttggttagagagcctgttgtgtaattaatcagttatgtcttggctgcaggaaaggagggtccgagttacactcagaaagtaatgacatttagaggtgatgaatgcaacagggatagaatcatggaggattgggaaggagtggcaaactggcaccagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccagggggccactaccagtcagttggagttggtattcaaggtggagtctggttgccgtctctgccctgttcccattatgtagtgagttcaggtacttaatacctaactgaggaccctaggactgcagtttgagatcatctggggccaggcacagtggctcacacctataatggtagcactttgggagcctgaggcgggaggatcacttgagcccaggagtttaacagtttaaaatcagcctgggcaacatgatgagacatcgtttctacaaaaaaattttttaaattagctaggcattgtgatgtgcacctgtggtccctgctacttgggagcctgaggcaggagaatcgcttgaaccttggaggttgtggctgcagtgagccctgatcgcaccactacaccccagcctgggtaacagagcaagaccctgtctcaaggaaaaaaaaaatcatctggcccatcctgttacttaacagagaaggtacctgaggctcaaaaaggatgactgacagtcctagtggcagaatggaggtgggatctggaacccacaacttgattcctaggactcttttttttttaattcccacattggctggg

SEQ ID NO: 20774 - DNA, 1095 bp, Homo sapiens
acaaactttagaacatataatagttgaacaagctgggagtggtggcccacacctgtaatcctaatgactccagaggctgagacgggaggattgcttgagcctagcagttggaggttgcagtgagctatgatcataccactgtaccttagcctggtcagcagagctagaccccgtctttaaaaaaaaatgttgaacaaatacttacctcagaagtcatagctggttatgacccaccagcttgttgagacatgaagctgagtagtgcttacctcacttttagagatgagaagagtgaaggccggagaagtgaagtgagttgaccaaagttgaccaaatatttagggcaagaactaaccttatagcccaaacctctcaattccagatcagaagactgtattttttactgtaggaccattagatgatatatcttctattattgcataataagttaccaaaaccttagtggcttaagacatagtatttcttatctcacagtttctaggggttaagaatctgagactaggagcggtggctcacgcctaaaatcccaatgctttggaaggccaaggcaggaggatcacttgagcccaggagttcaggaccagcctgggcagcatagcaagaccctgtcttaaaaaaaaaaaaaagaaaaagaaagaagaaaagaaaaagaaccagaatcaggatataagaagtaagggagaagagaaaagaagcatcaaaaacagtttaagtccagggaaaccaggaggattctcctgcttgtgtaaagacagaaaattatggttagaaagatggcacaggctaggcttggtggctcatgcctgtaatcctggcattttgggaggccaaagtggccagatcacttgaggccggatttcgagaccagcctggccaacacggtaaaaccccgtctctgctaaaaatacaaaaattagcacccgtagtgtgcacccaatgtgtgcacccatagtcacagctacttaggaagctgaggcatgagaatcgtttgaaccgaggaggcagaggttgcagttagctgagatcatgccactgcactccagcctgggtgacagagcaagacttagggaattt

SEQ ID NO: 20775 - DNA, 1095 bp, Homo sapiens; identical to SEQ ID NO: 20774

SEQ ID NO: 20776 - DNA, 1023 bp, Homo sapiens
aagcaatcctacctctgtctcccaaagtgttgagatgacaggtatgagccaccatgcctggccaggcatcagtatttttttgaagctcccaggtgaatccaatgtgcagacaactttgggtactgctgacataggcattttttaaaaaactcccctgattttattttatttaattaattaattttatttttttgagacggaatcttgctctgtcgcccaggctggggtgcagtggcgcgatctcggctcactgcaagctccacctcccgggttcatgccattctcctgcttcagcctcccaagtagctgggactacaggcgcccgccaccacgcccagctaattttttgtatttttagtagagacggagtttcaccgtgttagccgggatggtctcgatctcctgacctcgtgatccacccgcctcggcctcccaaagtgctaggattacaggcgagagccactgcgtccagccaactcccctgattttaatgtgcaggcaggattgagactaactactctagtctaatggttctgaaacttgagcaggcttcaaaatcacttggaggccttgttgaaactcaagtttcaagtgtgggctgcattcccagagtttctgattcagtaggtcttggggagcggagctgtgaatttgcatttctagctagtccttaaaggttgctgatgcacctggtctggggaccacactggggttcctctgatctcaatgggaagaatggaatcaggagtggtagaggctggatacttattaaacagagatggggtgagcacaattatctcaagaagccacagggctagagtggtaaccagagtgttttgactggcaggaacctgtgggtataatcatggggagtccctggaattaaaatggttgggggccaggcacggtggctcatgcctataatcccagcactttgggaggccaaggcgagtgggtcacctgaggtcaggagtttgagaccagcctggccaacatggcgaaaccccatctctactaaaaata

SEQ ID NO: 20777 - DNA, 1066 bp, Homo sapiens
agtgtggtgcttgctttccctggttgggggtctgagtctgtgatccatcaagcactggctaagggcctgctgggtgcttggtatgtgcagatgatacatacacgaatgaggcaaggcccctgcccttaaggcctctagttgggtgtaggggaaaatcaagtgaatacaagagagctgtaagcaccgagggaggcaacggtaaggagggagtggtgaacaggaagccgattggccttgggcttagggagtttataaatccaacagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggtacattatttcatttattcgtcacaaccaccaatgagcatgttactgtttaaatcatcattctaggccgggcgcagtggctcacgcctgtgatcacagcactttgggaggctgaggtgggcggatcatgaggtcaggaaatcgagactgtcctggctaacacggtaaaaccccgtctctactaaaagtacaaaatattagctgggcgtggtggcgggcgcctgtagtcccagctactcggaaggctgaggcaggagaatagcatgaacccgggaagcggagcttgcagtgagcggagatcgcaccactgcactccagcctgggcaacagggcaagactccatctcaaaaaaataaaataaaataaaataaaataaaaataaatcatcattctataggtgaagaaattgggactcaggttaaatgacttgttcaagattgtgcagttagcaaacggcagaccagttatttgagttcatgcttgtcacactcctaagtctaagaacgcggctcttaactcatctgcccggctgtctccctggaggcgggaggccattgtgaaagcagggttatagacagtggggtagaggtgtgcagggtggaagggtggcagaggccaagcag

SEQ ID NO: 20778 - DNA, 1104 bp, Homo sapiens
tttcaatgcccttgacttcccagcctactcacaatcatgggcactgaattgcagagtctaaaaaccaatggctttggaaggggaacattatagtgatgttgaaaaatacattcgtttgcattcctagtgggccccagagtggcttaatccttaaacctcccagaagcatgcattctggaattgatgcttcttgacccaggcagaaggaaagctagccagatgagtcatgtgggcataggggtgttcccaacctccaaagccctggttccctggctttggacttctctccacccccaaggcccctcttttcccagggctcactttgtagggcttgcaccacttccccaccccagctgtgttggctgcacggacactgaggcagtaacacgtgttaggctttagctccatcagcttgacagtagtgcccaaaatcttgttgaagatccatggacgattctttgcctcgggcaactcattctcctgtgtcttggccacctcctgtaacaggagctggtagaaactgaccggctgcttgcccaaggcgtaggtccaggaaatctaggggaagagagagccccgaggcttcctcagatatgtcctgtccttcctgtcccttcaccctcccaactggggtcaggacgtcccatgcccatcccctgctcctgctggggcccaggcaggtcagatggaaggtgcaaggtactgcagcactgagtgtggaacccctgccccgaagcatgtactactctcctgggcagccccacccactttagggtacaccctcattccatatttcttatacgccaggggtcctcaacccttgggccaccaactgatagcagtccatggcctgttaggaactggatagcacagcaggaggagattggtgggcgagcaagcgaagcttcatctgtatttacagctgctccccacggctcagggtaccacctgagctctgcctcctgtcagatcagcagaggcattagattcccataggcacgtgaaccctattgtgaattgtatgggagggatctaagttgaatgctccttatgagaatctaatgcctgatgatctgtcattgtctcccatcacccccaaatggg

SEQ ID NO: 20779 - DNA, 1001 bp, Homo sapiens
cagatgtgtagaagttattgagtcttggagcaaggggctgagtgatcaattaccttatggctcttacagagaggaaaccaacaccccaagagatgccccacaaaaactagcagctgagccaggactagggttcaggatttctcacctctggtccaggttctccgcatcctactccatttcctagaaaatattttatgctcctggctcacatcagtaatcccagcactttgggaggctgaggtgggtggatcacatgaggccaggagttcgagagagtctggccaacatggtgaaaccccatctctatcaaaaatacaaaaattagaatccccgccccgcggtggggcgcgggaaatgtggcgtacggaagacccactccccggcgccgctcgtgtggggcccaagtccttctgatcgaggcccgcgacctcagatcagacgtggcgacccgctgaatttaagcatatttgtcagcggaggaaaagaaactaaccaggattccctcagtaatggcgagtgaacagggaagagcccagcgccgaatccccgccccgcggtggggcgcgggaaatgtggcgtacggaaaaatacaaaaattagccaggtgtggtggtgcacgtctgtaatcctaggtacttgggaggctgaggcacaagaattgcttaaacccaggagaaagaggttggagtgaggagctgagatcatgccactgtactccagcctgggcaacaaagcaagaatctgtctcaaaaaaagcaatcatgctcctaatggggcctggctctcctctatccctcatcgatgtcttcaattcccatgtattttataatacatagaaagagagagagatcatgttgcagacatactaagttataataatatttctaagcctccatctggaatttttttggggggggcgggggtgggagagacagagtcttgctctgtcgcccaggctgaagtgcaatggcacatgatctcagctcactgcaacctccacc

SEQ ID NO: 20780 - DNA, 1050 bp, Homo sapiens
agacctggtcatcaatgtaggagaagtgactcttggagaagaaaacagaaaaaagctgcagaaaattcagagagaccaagagaaggagagagttatgcgggctgcatgtgctttattaaactcaggaggaggagtgattcgaatggccaagaaggttgagcatcccgtggagatgggactggatttagaacagtctttgagagagcttattcagtcttcagatctgcaggctttctttgagaccaagcaacaaggaaggtgtttttacatttttgttaaatcttggagcagtggccctttccctgaagatcgctctgtcaagccccgcctttgcagcctcagttcttcattataccgtagatctgagacctctgtgcgttccatggactcaagagaggcattctgtttcctgaagaccaaaaggaagccaaaaatcttggaagaaggaccttttcacaaaattcacaagggtgtataccaagagctccctaactcggatcctgctgacccaaactcggatcctgctgacctaattttccaaaaagactatcttgaatatggtgaaatcctgccttttcctgagtctcagttagtagagtttaaacagttctctacaaaacacttccaagaatatgtaaaaaggacaattccagaatacgtccctgcatttgcaaacactggaggaggctatctttttattggagtggatgataagagtagggaagtcctgggatgtgcaaaagaaaatgttgaccctgactctttgagaaggaaaatagaacaagccatatacaaactaccttgtgttcatttttgccaaccccaacgcccgataaccttcacactcaaaattgtgaatgtgttaaaaaggggagagctctatggctatgcttgcatgatcagagtaaatcccttctgctgtgcagtgttctcagaagctcccaattcatggatagtggaggacaagtacgtctgcagcctgacaaccgagaaatgggtaggcatgatgacagacacagatccaggtaagagggagaaagctcctccctc

SEQ ID NO: 20781 - DNA, 1025 bp, Homo sapiens
acaaaaaaataagaaccacccagaagcatacagaaaattgggcactacttgacaatttgacattgcaaagttttcccaggctaattcctcaccttttagggagtttgctgagcaaactaggtaagccttcttggcaggggagaaatgcacagatgctacccactgagcccctcgcttgggggtggttgtccctgcatgtccacatcagagtcactgctccatcaggggtcctgcaggactagatcctggggcatggggagaaatggggacagctaataaatggaaaccgtacagctaataaatggaaaccatacagctaataaatggaaaccatacagctaataaatggaaaccgtacagctaataaatggcagagctgagatttgaacctaggaaaactgagtcttaatccttgaactctgttacctctgtctacataggtttctgtatacatagccttcaggactgcttttggtggaaagagatagcaggtggtgctaattcactgtgttggtgggaactctggctacactgaaaggtttgaaaaagttatcctgtaaactgactagaatcaggtgcttttgtttctgaagtgcttttgtaagtgtactgagtttcttttctgaattcttaatttcttattgacttagtttaattttatttaggatttcaaatttatatgggacaatatctctaccttacaaaaaatgtgcaagtgatgctgattataattcctttaatcctaaggaaagagcttgagatagagctccctaagccttttttgcctgcaaaagaatctaagcagatggtggggttgctgtttaaatacaattgccaaccaaaaactataatctattggctttgacaataaagtttatggggcagagaaaatatttaactttgaaatccctgtacatcgaaaggaatattttacaaataacttgacaaagatgtttcaatggtcttggaatgcagaatggaattttgagaaatagaaatttgtaggcaagggtctaaactaggca

SEQ ID NO: 20782 - DNA, 1033 bp, Homo sapiens
attttccaatttattggcatacagttgctcatagtagccactaatgatcctttgaatttctgcagtatcagttgtattgtctcctttttcatctctgatttcatttatttgggtattctcctttttttctcaggtagcctggtaaaggtttgtcaattttgtttatcttttcaaacaatcaacaggtggtgaagccagccaagctgtgttcttttcttcagagtggcaagttcccccaggccctaggtgggttcacagatgctatccaggagccagggactggagtaagaaaaccttagaagtctacctggtgttccattctactgggactgagctggccctcaaatcatgagacacagtccttcccattcttccctcctttttccacaggcagaggagatgaccctgtggccaacacaaccacgggttcacagggagtactgttagctattgctgatattcacttaaagcccaagggctctttagtcaactggtggtgaatgctaccaggtctgggactcactcttcaggacagtggactcccctctggcccaggttgggtccagaaatgctgtccaagggcctacttgttgctctacccctgtggctaagctggtacctacggtgcaagacaaagtcccctttacttttccctctgcttttctcaagcagaaagagtctctgcctgtatgcaccacagctggggttgtgctgagtctcacctgaagccagcagagtctcacccaagacccacggcatattacctgggtatcgttgctgattattcagggaccaagggctctttagtcagcaggtgatagatcctgccaggactgggtctttccctttaaggcagcagtttctcttctggcccagagtgtgtctagaaatgttgtccaggagatagggtctggaatgggtgtctcatgaccctgaccaatgtgctatcctactgtgtctgagctgacatccaagatgcaagacagaagtcctctttagtcttctctcttctctcctcaaatggaaggaaggg

SEQ ID NO: 20783 - DNA, 1791 bp, Homo sapiens
gcaggaaacataggagtgcagatgtctcttggatatactgatttcctttcttttgggtcaatacttaggagtagaattgctgaattgtgtggtagctttatttttagttttctgaggaacttccaaactgttctccataatagttgtactaatttacattcccaccaacactgtttgagggttcccttttcttcacatccttgccagcgtttgttattgcccgtcttttggataaaagccattttaacttggatgagatggtatctcattgtagtttggatttgcatttttctgatgatcagtgatgttgagcaccttttcacatgcctatttgccatttgtcttcttttgagaaatgactattcaaatcttttgcccatttttcaataggattattagatttttttccctatagagttgttggagctcctgatatgttctggttattactcccttgttggatggttaatttgcaaatatttcctcccattttgtgggttgtcttttcactttgttgattgcgttctttgctgtgcagaagctttttaacttgatgtgatcccatttgtccatttttgctttagttgcctgtgcttgtggggtattgctcaatgaatttttgctcagatcaatgtcctggagatcttacccaatgtttacttgtagtagtttcacagtgtgaagtcttagatttgagtctttaacccattttcgtttgatttttatatgtgacaagagttaggagtctagtttcattgttctgcggatagatatccagttttcccagtgccatttattgaagagaatgtcttttccctagtgtatgttcttggcatctttgtgaaaaatgagttcactttaggtgtgtgtatttgtgtctgggttctctattctgttccattggtctatgtgtctgtttttaatgtcagtatcatgctattttggttcctgtagctctgtagtataatttgaggtcaggtaatgtgattcctccagttttgttctttttgcttccgataactttggctattataggtcttttgtggttctatataaattttaggattgttttttctatttctgtgaagaatgtcattgatattttaatagagattgcagtgaatctgtagattgctttgggaagtatggatattttaacaatattgattcttccaatccatgaacatgggtatatttcccctttccatattttggctcttcaatttctttcatcatgattttatagtttttattgtagagatctttcatttatttggttaattcctaggtatttaattttatttgtggctattgtaagtgggattactttatatctttttcagattgttcactattggtatatagagatgctactgatttttgtatgtttattttgtatcctgcaactttactgaatttgtttatcagttctaatagttatctggtatagtctttaggtttttttcaaatgtaagatcatatcacctgcaaacaaggacaatttgacttcttcctttccaatttagatgccctttatttctttctcttgtctaattgctctagctaggatttctatgttgaataacaatggtgaaagtgaggatccttatagtgttccagatcttagaggaaaggctttcagtgtttccctactcagtatgctactagctgtaggtctgtcatacatggattttattatgttgtggtatgttccttctatacccagttttttgaggagttttccatgaagggataatgagttttattaagtgctttctcagcatcagttga

SEQ ID NO: 20784 - DNA, 1023 bp, Homo sapiens
tggagtggagtgggggtatctgtgcttttctcccctgtccgggggcccagctagtttgctcagcaggttccctaaaaagcggactatggaggactggcgggcggggcgggggtgggtaatgggggtagaaggcattaggggcggggcgggcctgacctgtgcacctgctcccgctggaagttggaagagcccctggccagccagccgcggtttctgcggggcgcggagcaggaaccgaagcctagaaggccactgagtgcaccttggtggctcccagggctgcagatctcaggtttcagagttattggtattttaaacttgagaaactagttctacagctgtctatgtgaccgaccaaccactctaaactattttccttaatatagaaactaaaaggcagaattagaattgccattgccctgcggggagatttataatctagaggggggagaaatgagaaaaatgtctccctctggacaagatctgtagaatacacgtgctaccccagaaggacaaagagctctaagttttagttttccaagagggcacatctgtcgcagcccatttccctttcttttctttttttttaaattaatttttaatttctgtgggtacatagtagatgtatatgtttatgggttacatgagatattttaagacaggcatgtaatgtttaataatcacatcacggtaaatgggggtatccatcgcctcaagcatttatcctttgtgttaccaacaatccaattatgctcattagtttttattttattttattttatttttgtaggtacatagtggatgtgtatatttatggggtacatgagatgttttgatacagacatgcaatgtgaaataagcacaccatggagaatggggtattcatcccctcaagcatttaccctttgagttgcaaacaatccagttacattctttaagttatttaaaaacgtacaattgttatcattgactataataactgttgtgttatcaaatagtaggtcttattcattctaatttttt

SEQ ID NO: 20785 - DNA, 1135 bp, Homo sapiens
gttaatttagaccttatgttgtagagacaaaaaatctaatcaatgtccttttatctttttgtaatataaattctttggtatatacattctggatttctaattgggccaaattatggacatttgttttaatttagttacttatgttatatccatatctatatgtacacatacaatctattccttaagtctatattgaaatattatatcgaaggcctgaccagagtgtccgccatggagtcgcagaaagaggcgcgaccccgtcgcgcgaccgcctggggcctcaaggtctcagacgccaaactacaaggagcagcgggagggcggcgcagtgctggcgacggctgccctgggaacagaggcggacgacgctagtgcgggcgggctgtgggagctgcaggtggagccgaggagctgaggcctgcgtgcagccgctgcaagccggcctcagaaagtgtgtttttgtccatttctcccagcgcaccctttgcatatctctacctacttgtgcataattcagcatccagcagaggaagacaaaatgttgcggacagttcctctaccagcagcatgcctcccccaggacaagcgcaaagtgaagactggtcgtcgcttcagtgaagaaagagatcctgaactttcaactgtttgccggaagtttggtacattaatgttatatccaggggctaatataagaagctgctaatctggaagaatttatattagattctcctgtttatccttctacaatcatcgtcattgatggtacacggagccaggctaaggacattttctgtaagaattccttgttctgacacccccaaacaggtgcagttaaaaacgagcatttctagtcagtatgtaattcggatacagccaattaatagatgtctttctacactggagtgtgcacctgttgctctttccatcttggagaaaaataattacatacaagagactttgcttcgccctcttgaagctttatgctctttccagatttagcatggtgcccaaattggccccagcaagcaacgccttctgaaaaaatggattatatcctaaaccaatgccaaagaacaaacacaaactcaggaaaatggaactattaaagaatagtgttaaaatttagtacagttgt

SEQ ID NO: 20786 - DNA, 1054 bp, Homo sapiens
ctcatgttggtggctgaccccctgttcccatcccacaggaatgccgcctcaatcgacccagcagcgcagcccagctccagacacgcattgagactgccctggcaggcagcccctgcctgggccacaataagctcagccgggagcccagcttcattgtggtgcattatgcggggcctgtgcggtaccacacagcaggcctggtggagaagaacaaggtacgggctgggccatgccctgtggggcctgcgagaaacgagatgctgggtctttgctatgcagacatagtagtttcccatcgtgagtcctttctctcctgaacctcctcccagaatccagaatcaccatcttgggcccacctgtctgaggtctccactaatcaagcatgacctgcctggagataacccatgttagactgggtctccaggtctctggttgtccaatggaccttctcttggactcaggccctgtcctacctggaagccccgtcatctgcggcttgggtgggcagtggatggccctgagcagaagctccacctgccctcactgctgctcttgccatttcccaataggaccctatcccacctgagctgaccaggctcctgcagcaatcccaggaccccctgctcatggggctgtttcctactaaccccaaagagaagacccaggaggaaccccctggccagagcagggcccctgtgttgaccgtggtgtccaagttcaaggtgggtctgatgtgctgatgggaggtgcttggttcaaactccacggtctcacaaatatttattgagcacctgccaggatcggtgctgtttgttggggagcagtggcaagtcaagtagatgtggtcccagtcccctggagtttatacttcagtgtggaagacagaaacagtagacaaataggctatcaggtataatatgatgggaagtctaggggcctatgggggcactatgcagcctctcaccccctgccactggggtgctcatgggaagaggatcagctacatgagcttctttgacctggctcatctccagctgtctagcttcctgttcta

SEQ ID NO: 20787 - DNA, 1114 bp, Homo sapiens
acaagcccaggataagtggacaacactgggagtcggggcaggagtgctttgggggtgggcatgaccctctgccacagcccttctgcctggtgggcatggcagtcttctggagcaagttgtggccggaagaccagtagcacatggaggcaccctgcctgggaccatataggaatggtgggtggggtccctgtgtcaggtctgagggtggtggttttttcttttttttttttttttttgagatggagttttactctagttgcccagtctagagtgcagtggcacaatctcagctcactgcaacctcctcttcccgggttcaagtgattctcctacctcagcctccgagtagctgggattacaggcatgtgccaccacacccagctaattttgtgtgtgtgtgtgtgtgtgtgtgtgtgtgtgtgtgtgtgtgtgtttatttttagtagagatggaggttcaccatattggtcaggctggtcttaaacttctgacttcaagtgatccacctgcctcagcctcccagagtgctggaattacaagcgtgtgccaccatgcctagctgggtctgagggttttgaagttgctgggccttggtggggtgaggggagcttctgtctatagccccagggggcttgtcggtgtggaacattgagtacaaaggcaaaggggcacccatcggacacagaccaaggtcacagtgcctccagcaggctgggctctcagaagcctgacagtgggaaagggctcaaggaagcagagacaagcctccagcaggcacacagaagcagccctgcccccagtcaccagtctattcctagagagcagggggcagaaatgtagaggatgggtgggcatggaggcccacaggctgccccaggagacatctgaagtcagcctgggttctcatcccacctttcccctcaggaagcacgtgtcctcagtctcatctctatcataggcagtggcgtagcacataccttacaggttgttgaaaagttgcaatgaggcgatgcatgtaacttgtatagaattgtgtctggcagagatgggcacttgggccatgattgggagctgcccttctgctgtcgtgattgtactcagcagaacggccctt

SEQ ID NO: 20788 - DNA, 1439 bp, Homo sapiens
tcacccattttgtcagcaacacactggtggagaagagagctctggtgggcactgttctctcaggcaggctcagaagtgggcgggagcatagatacagctcccacagggctgtttctgccacagacatggacgtctcgctgcctaatgaagttctatgctgtggtggccacctcacctgcatcttgggagagccacaagattgcagagaggatagaacagaggatcctgaactccaaccctgtcatggaagcttttggtgagcttgggctcctttgcacagtatctcagtcccatttcctctgggattttccaccttccagggagagggacagtgctttgagaccctctcttgggtgggggtggaggatgagtgtatccttcactgcctcagatccccaacctctccctggtactccttagcatcattctaacagaggtcatgtcattcagtcctcttcctcgctccagcctaggcacacataacagtcgtgctggagaagacctggtggcttagctcgtccaaattctgtctttctatccagtttcctgatggttcaatgaagggtacttgttaagggatacaaggtgattagtgtttgtgttggcactggaacccagatgtgccttcctgtctaaagtcagtagtgacagctgattgtttttgacctttcccttcaaagaaaggtccctgactgcctaggcttgctcattccaatttcttgccaggaatttcttctaactcccctgaatcccacttgctaaagcatgagggcccattttctagtcctgtcccctatgacatgaaaaccaacaaaggggcctttaggtgacttgagcacgggaacatgacctccagagacctgcagccaccttggcttatgaggactctgcaaacccaggggagtgaaataaacataggtgtgatctgtagggaatgcgtgtacactgaggaataacaacagcagtcgctttgggaagttcatccagctccagctgaacaggtaatagctgctgttgccctggctagtgggaggatgggactggggaggttgaaagtggctggggcagtatctggcctgggccacccctatgggcaaaaaccctgctcctcctggtgcatgccctttacctcaggtgtgagctctgagggtgatctttgcacctggagaactatagctcctctccccttggggaaccctggggcagtgcgcttattcaggcctgggttcctcctggcttttactcttgttcagggacttcaagctaaattgccacctctttggaccatatccctgagcttgaggctgagacttcgactcctgtcttggggtagagcaaagtgatgtgcagaggccttggccctgcccacctgagctagatgcaggggaatattccaggacacccaaggacattctgagtggtccccacccctcagtgcc

SEQ ID NO: 20789 - DNA, 1107 bp, Homo sapiens
aaatatgaatttgaggggaacacaattcagtctgtggcataccttaagaagctagaggggaacagaataaacccaaagtatgcagaagaagggaaaaagtaaagatgaataaaatagaaaaattaatgaaataaaagacttttctctgaaaagatgaataaaatgataactcactgggtgcagtggctcacgcctgtaatccagcactttgggaggccaaggtgggtggatcacctgaggtcagaagttagagaccagcctgaccaacatggtgaaagcccgtctctactaaaaatacaaaaattagctgggcatggtggcgagcgcctgtagtcccagctcctcaggaggctgaggcaggagaatcacttgaaccccggaggcagaggttgcagtgagccgagatcgtgccactgcactccatcctgggtgacagcaagactttgcctctaaagaagacaaacaaacaaaaaaatgataactctccagtcagacttataaaaagagaaaaaagatgtaaatcaccagtatcaggaatgaaggagtagacatcaatatagatcttacagattaagataatattttgaataactttatgccaagaaattatacaatttagatgaaatggagaaatattttgagaaacgcaaactgctgaagatcacacaagaagaaaaagaacctgaatagcccctatttctgaaagaaattgaagtcatagttaaaagccctcccacagagaaagctgtaggccctggtggcttcacttgtgaattctaccaaacatttaaggaagaaatgttaccagttctacataaagtctttcagaagatagaaatatctctgatcccaaagaaaaatctaaagaatctacaaagtaagttgccaccttactgcaactaaaaagttgtagagcgtttagtgaggtgataggatacaaggtcaatatgtaaagacagtgtatttctatgtcctagccacaaacaattagaagttaaaatgaaagtatacctcacttcagctgattaagaacaagagtatgaattaaaattagactgcttggggccaggtgcggtggctcacacctgtaatcccactttgggaggc

SEQ ID NO: 20790 - DNA, 1065 bp, Homo sapiens
aataaatattacataaaaatgaacaaagataagaatgaccataggaatcttgacaaaaactgtaagcccacagataaaagtgacacctttaaggtgctgaaagaaaaaaatctgtcaacttagaattctgttatcagcaaaaatatttttcaacaatgaaagtgaaataaagactttaagacaaatagaagttgagggaattcattgcctgcagacttgcactgcaagaagtgataaattctttagtgcaaaagaatatgaaaaccagataaatatttggatctacacaaaggggtaagtttcagcatcacagatgtaaaatcttttttttttttttgtctctttagaagataatcactataaggcacaaatggtaacaatgcttatatgatagaatggaatcattaaaatgccaaatttaatcaaaggcaataagaaaaaagggaactaagatcacatgggacaatttaaaaaaataagatggtagatttaaacccaggcatagtgacaattacgataaatataagtggtctactcgtggataagttcaaactaaatggatgggaaaaaatataacatcctaacattcataaaggaaagctgaagtggttacattagaacaagcaatgttgctaaggataagatgagacatttcataatgataaatgggtgaattcatcaagaaaacagttctaaacaggtgtgtacctaattacagtttcaaaatacatgaagtaaaatctgctctcattgaaaggaaaaatatataaaatcaaaactacattttgaggccaggcacaatggttcacacctgtaatcccagcactttgggaggccaaggctgatggattgcttaagttcaagaccagcctgggaaatgtggggaaaacccatatctacaaaaaaatacaaaaattagccaagcgtggtggcttgtgcctgtagtcccagtttactcacacagagcaagcaagactctgtctaaaaacaaaaaacaaaaagattaaaatgatacaaactatgttccttgagctgaatagaattgaattagaaataaacaacaaa

SEQ ID NO: 20791 - DNA, 1033 bp, Homo sapiens
cactactggaaacaaaagtcagctgctggggattccagcatagtggttaagaacacatcagaaaagtacgtagcttctgcaaagctctcagttcttccacttgtaaaatggaagggaagggaggaccaacacctgactcataggacttctgtgagagttaaatgagtcactgtacatatggcacctggtggcatgcttggcatgtggcagtgctcctccaaagtagctggggttcttgtgggaaaaagtttattggagtaaaccacctgaaccctctgggttgcgcatggtggcaagggcagtatattgggccaggtgttggggaggacagaagctcctggtatggccacgtggccttctgggtagcaaaaccacaacaggtgagacaggatgttgcatacagatgagtggggagttgcacagctagtcaaaggagactattggccaaggccttgccaccttcttgacaagcctcacccagctgcctcgccctttccacaacacttttaccttcatgaggaactctttggaccataaactccttctgccttcactcacatatgagaattgctgaacactgagaacttgccaggttctaggcttctggctgggcactgaggggtggcagggggatgaaaaatgcaacatgtagctttcagggggcacttagtctgctgagagacagataagaaaacaaagacagtaagttgcagggatgagggcttggacttgggttaggaggggatctctaggagctatatcaaggtggctagtgaagtggcttatgcccagcttctcaacgaagccttgtcccccagaattgctctggggaactgaagctgaacctggtccaagactcattcaaccagagagctaggtaaccctttattgagcagccactgtagccctgggctgggcctggtatattttcaaaaatttatttttaataaatagtaatgtagttacatagttcaaaaaatcaagcaatactacaaggcttataaagaaaaacagcaaacctgctccttgtctt

SEQ ID NO: 20792 - DNA, 1028 bp, Homo sapiens
gtatcttttcttcagggagctgctgggatttaatgattcttggctaattgcagaaagagggctgttacttaagtagatgtgtgtctgtgtgtgtggtttgactatatttgagcccgagtttgctaaaggcatctctgcctcagtcctgaggtgcctgcaggcccggtacatggcagacacattctacaccaatgctggctgcaccctggtagccttgaaccccttcaagcctgttcctcagctctactcgcccgagctaatgagagagtaccatgctgcgcctcagccccaggtaaggctctgccgctgcctgtggcctcagggctcctctacctcccgctaaacctctttgcagttacccctgtccttattcatctattcaccagcaatgtggtcattcagagtctgctagtgccacggcctgcccaataggagctggcagaattttgaaccatgaagaactgactacaggacagaaggtgcaaagtggggaataaataaatatttgtttaactgagtttggaacctaaaataagagacataagagaaaggatttttttttcttgtttgcggttttattaacaggaaaggatttataaaggtattatatatttgtttatttaacaaactacctttttattttttattattatttatttatttatttatttattttgagatggagtttcagtcttattgcccagactggagtgcaatggcatgatctgggctcagcgcaacctccacctcctgagttcaagcaattctcctgcttcagcctcctgagtagctgggattacaggcatatgccaccacacctggctaattttgtatttttagtaggcatattggtcaggctggtctcaaactcctgacatcaggtgatctacccaccttggcctcccaaagcgctggaattacaggtgtgagccactgtacccggccctatttattttgagactgagtctctccctgtcacccaggctggagcgcagtagtgcgatcttgactcaccgcaacctccgcct

SEQ ID NO: 20793 - DNA, 1043 bp, Homo sapiens
tgactgtcggagcagctgcaagacacaagagtcagcgacagatgccacagccccagcctttgtctgagcaagagaaaaatcacaccctccccttaagcccctggggcagctgaagctgggaggctttagtcatctcacccctcaactccatcgccaaccctggagagcaacaggggcctttttcttgtctcccaactttggggaatttgagcagtgatgggaaagatgcaggaaagtgaaggtttgggggagagatcccttgaacctgtctgcctaaactgcgtgacacactcccagaacccacttaggctgggggtggggtgtgttctgccacatcaacctagatcagctggaaaagggctgagctggcaggtggggatcaggcttctagtttcatctctgccacttctctgcggccacctacttactcttctgggccttgcttttctcagctgtaaaatgtggggaagcaatcactcaaatgacagatgcaatagtaacatggataactgtggattttagacacatatcaagccaaggagtgagaacgtgactggttgtgactatatctcacttgctactggtttgggctgagtctggaagagccagaggcctggtctccctgcaggaaataatccctggaaagtaagtagcctcttccaggctgctgggatcttttggactcatttgcaagctgtctctggagattggctacagaagtccaaggggaactccaagaggaactactgtggataaccaggctggggtgtgttggggcagatgcccaaattttctgcagtggaggacttagccagagtagggaccctgggaactgtcacccctttagagcaaatagtagaaaagctccaagggaagcctagaagtcacaaataggtgtcctattgatcttcatattggcaagctggtgtctacactgggacatgaactcccatccatttctatagtgggactttggctatcattgatatcacattggaacattgttaccaccacttttgtatatcattgactgccattgatcc

SEQ ID NO: 20794 - DNA, 1031 bp, Homo sapiens
attgcttctgccctctggcggattcgtagcaagccccacttctctggacctcagcttcctcatttgcaaaatgaaggtattggggattagaaaatgataccccacagtttggcactttgacacgctgagtactttgaactggaggacactggcgggacctcagaaacaaagtctctctctgaccttctcctggtcttttttctcctgctcccttttctcccccagggcaggccatggaaactagaatttctcttctccaagacgggtcatagaaactagaaatattactctaccccttcccctgcctttgtgtgtaggaggtggccataaagaaattctctgacctaccttgtctggtagtaggtcataagaccctcattccagaaggggtcctgccctataccagcgaggaaggaatgctatgcagagaggccaagaagaatctgaacagacaggccttgctgggctccccgactcagtctcttactgttaagtcacatcttttctgtctaatcacatttctatatggctgtccccttcttcattgaacctaaacgtaaaaatagacagttttctctgagtctttgggttttcatttctgaaggctcctgtgtcacatcaaactttgcttaaatacatttaatgcttttctcttattaacttggtttttgttatagaaattttggctgtgacccttatgatggggaggaaaggtatcatatcctttctaccccttcaaagatgctattatctccagaacatactgctaaggttctaggattcactttgtatgtcaatgtgtactaggcatggctacaggaccttccacaatcccacccctggcagactcttcagtttcatctcccatgattctaccacagttatcccactcccttgtactctacatatctctgcagttctaatttctctttagtttagcttcttgaacaaaccatccatccatccatccatgcagccatccatccactcaaccaaccaaccaaccaaccaatcagccagccagcaaacca

SEQ ID NO: 20795 - DNA, 1031 bp, Homo sapiens
acagttctgagccttaaccctgtagtttgcacacaagaacgagctccacctccccttcttcaggaggaatctgtgcggatagattggctggacttttcaatggttctgggttgcaggtgggcactgtatggctgggtatggagcggacagcccccaggagtcagagcctcagcccggctgccctggtggaaggtacaggtgttcagcaccttcagaaaagggcataaagtggtgggggacaattctcagtccaggaaaatgcattgaccattgctggctatttgcttacctagtaagaattggattcatttttgaccagattattcttctatgcttttttgcaataaatcaaatcccacatatctacaagtggtatgaagtcctgcaccccccaggaggcctgtccaggcatgtcttcagaggcagggtgggttacactcatttacctcccctctccccaccaaattatgacacaaacgagtatgtttcctctctagaaccctgtaatgcctcctcccccatccccagagctccttactgtaggtcttaccctggacaaggattttttcaagttggaggcacagaacatgagcaatctgacattcccacagcccctcaaacatgcaaggctactaaggcaggaggagtataaatgatggatattgaccaagacctgcttggacggagaccgccatattatctgttctcttcgttcacaaaacagccttcacttgtctcagaatttgatggacacatactgtgatgagcaggagcttcagatgcactctttacacattttgttgaaataaacctctacatttgtagaagagttacagtttgtcatttcaatccatgcccagccacctcatttcttgttctgctttcagcaggggctcagtgtggggcaagcccctccatggccctgtaacacctaaagccctttgtctcctgaacttgcataaagatgatgggtaggcagtaaaaagctggccttggccagccctgtcttatccgctgaatcaaggtcaaac

SEQ ID NO: 20796 - DNA, 1044 bp, Homo sapiens
gggggctgactcctgagcacagtgggtgctcagacgctctttggtttggcatgctctcatgttcccacaacccgatgccatggtgcattcttattgttcacacagctacccactcgctcttattctggatttccaagtgaaatgaatgctcaacagaggcccctgtgaggaccataggaaaaagcactattgacagggtcacttatttccactgacctcaaaacctggcctcaggctactgatgaataagtctcatacaccaaacttctcacacagggccaggcagggaggaggtaaggtagaacctggaaagtgttgcttggccctgctatgggcctggagctgagatgggattggctcacaggagcttggttcacaggggtctgatggccaccctagcccacatgtcctttggctattgtactctaaagcccttggaaaaaaaaatcacatcctttcttgggcttctgttggatagggcttagccttgtaagtgtaggtgtattgaaaatgtctttccaaaatatgagtgtaccttaggatttgtatgccatccctacacccatcaggctgtgtgtttcccagaagtctagaaggtcagaaatgggaggagcctccctagctggaggtgtctcccagcagctcccaaggtgagttattagtagggtatagtaatcagggctcacatccatcaggttgtgccctggtcactccttggccctgctgaaccattgtctaaggaggacttaacagctatccagtatgttagaaatgaaactttccaaacaggtcatttagatgttgtgagatagactaattactacataaaattagtgaggctgactagtgcctgagatacttatccactgatgcagacagaaagtgtctgttgaacattcattttaggacaggccactgttgtgatgtagaattattgatattttattgataaaatgttctgatacagatggatatgctgacaggtggcatacgggcccaggcctgtcatgatgttagcagcctagcatatcacacctgtttaaa

SEQ ID NO: 20797 - DNA, 1026 bp, Homo sapiens
ttggggatggggcgggtctcaagccaggatgacctagcaagggcaccagcatttgctcctggaatagtgggctgcataagtcactccatggatgggaagaaaaagctggaacttttatttctgtttatttttactaacaaaaagaaattaacctttattagtaattaatatatggattaatcatttacatcaaaaatgcattttatcagaatattggtagtatgtgctcaaaatatatttgtctgtctttctcattgctatgtgatcacaaacatttggtgactaccaggttagagtattgatggagggctgggtggctggtggtggcttgaagggtcctggcccacaaagaggggcactctggcctctgcctagaaagtgttgcctgaagcctctgctaatcgttctcaaggaggagctcccagatttgctgtcagttttaaagccagtgaattggggtgcttctaggattcacctttgtattaagtctgcccattttttttatgactgaaaagcttctttggataaatatttcaaatgtgcagttggggagcacagccttctccgacatttggttcaggttaaggtcagtctgtggcatcataattgagtgagacaattttgtcagtggctactggcagcttctagtggaagttggcattgaaagtcacgcaagtgtaaaataagagtttgtcctccagttaagagtggccggctaggtaaatggagtgtgtgtgtatgtgtgtggccaggagaggcctgcactgcctccctaccacattagtcactaatggacgtgtccagcctcagtaggcacaaggatgagaaggaagtttccccccaggcatgaagcaagtagataggcccttcagcttttccctagcatcctgctcccaagcggacagagcgtctgaagaaataggtcactgccgtctcttatcaatggagagaacagttgaccacgtgtgtacaagctcctggctggaattgaagcacagaagagaacctccaccccgtagctcagta

SEQ ID NO: 20798 - DNA, 1205 bp, Homo sapiens
cagtgagccgagatcgtgccactgcactccagcctgggcgacagagcaagactccgtctcaaaaaaaaaaaaaaaaaaaaaaagagctggatgccattggggaagtccctttacatttcagagctgtggttttcttacctgtaaaatagacaccctggcataaagttgagttgtcctaaggattggagatcatgtacctgaagcaactgggaaagcacgcagtaacgttgaagtattcagcttggcagcagtgttaacagctgaccagatgtaggtgtgtagatctgtattgtgcttggtgattatgatatgtgatcctgaaagatttgagtgcagtgagtggtaaatgctcaataaatggtgtgttagatatggtccatgtatatgtgcgtttagccatgtcagtggtcttgccatccctttgctccctgcagggctgtgactttacctattattgtattagttcttgaactcacagtaacaagagacacaactcttaaatcttaggcctgcctaggaaattgcatctgaatgggaactattggagacattgtcctggtcttagttatggaattgggactaagatagaacctttatcagccaggagcccaccatcatcacttagcctctcagaaattaaagggacactactactgaagcacgtgtcttctgcccaagtaagcgagaagagacagctaacagtgttcaaaagctttgggacccaaactgctgcatttgagtcttggctctgtcacttgctagctttgtgaccttggtaagtccataaattctcagtgcctcagtctcctcacctgtaaaatgggaataataagaataccagactcctaaggttgttgtgataataaattaatagatataaagcacttagaatggtgcccagtaccctataaatattagctttgattattgattgtatgcattggatagccaggaataagttttcttttccagcttgcctaatttttaaaactttccaatttcacaaaaaagttacaagaataatacaatgcttttttctcaaattcacctattgttaatatcccaatgctttattatttctgcatattcacatgtgtacatgtatttattctctcttgctccacacacatatgcattttctttgagccatttgaaagtaatctgtggacctcttgcctttttttttttttttttttctgagacag

SEQ ID NO: 20799 - DNA, 1514 bp, Homo sapiens
ctgtaacacagttggctgatgtgatgtagctccctgtaacacagttagagcctaaaaccagaactagatctactagaatatccctataacagaatgtcaaggttcctgaaaaagttattatccacctacttcccctctactttggggatgtccttggttattgtgaaaagaaatttcaagagctcagaaatgagttcattttttattgtggtaaaatatacataatatttatcactttaattatttgtaagtgtacaattcagtggcactaaatacattcacagtgttgtgtaactatcactggtatctacacccaaaacttcatcatcctcaacataaactctataccccttaaacaataagtacccattcctttctccctgctgcccttggtctgaaatgagtttttggcctgatatatagaccagggcaagttctgtcttaattttggtgctgatgcatccttttacacctcacgtaagacaaataagacttagggaagatagagatccctgtgaaggtaggagggggaggaacagtgcctttcatatttacatacaggtcagggtgttgtattatctcatgtaaagggacctaaactgagggcctcttgtcattcttcacatcccttggggagatgtttgcagttttggtttcaatactggctggggattatgcagggagggaaaataaacaattatgccatccctcagtgcacacaaacacacagccaggagccgactgcactgtgggtaaaatgactccaaaattgtgtgtaatgagtaggaaaagattagagacagctcttgctatgctgaaaattgacattagtgaagggaaaaaaaaaaaactctactagtcggcctaggaggtctaattcgagcagtaaagatataaataaataaataaaagcatgtcaagatggtattggtgctttttttcaatgagctctatctggccggaaggctattcagcataatgcaaaattaaattataaaaactggctgaatatttagatggaagagccatttggaagcagtttatttagacgaaccggcaatgacccacaacagggagacatcaagcgtgaaatttactagaaattagcaccagggtcccagcctcagcatgaatagcttgataggatgcaaatcccagtgatattaagctgcctcactgctggtgctacagggtcactctcagttggcttttcatgttatacttattattttttcctgggacaggttataaataacaataaaaaaaatttattgaaaactttaactggaatgaaagtctattttaaagtctctgattactaggatgttgaaatacagtgtcagccgatcataatgaactaaggagagacattatgtatatgtagcttgtgtatggctaatgtttaccttcagtttctaacagataatcttgcccaagccaataagatctgtttcattttcaagagtgtgggacactgtggaaacactctgccaccctgttcccttgtttgatac

SEQ ID NO: 20800 - DNA, 1002 bp, Homo sapiens
cacctgtaatcccagctactcaggaggctgaggcaggagaatcacttgaacctgggaggcagaggtggcagcgagccaagattgcaccattgcactccagcctgggcaaaaacagcaaaactccatctcagaaaaaaaaaaacaaaaaacttttgattgttcttctccctgacatttactaggtaagcaactttgggctttaatctatttagatgttagtttcctctttgtgaaatggaaggcataatacatttcccattttaaagtagaaaatcaggttggcgtggtaatcctataatccaagcactttgggaggccaaggaaggaggatggcttgaggccaggagttcaagaccaggctggccaatatagcaagaagcaagaccccctctacaaaataattaaaaaattagccaggtgtgggggtgcctgagatggggaaccgtggaacctttggcagtggcatccagggctgggaccatggccgtgaacagggcctgggccccacagagctcatggaggcaaggctgagggcaaggaatggatgaccaagttgggccacctggtcaaggacatgaagatcaagtccctggaggagatctatctcttctccctgcccatcaaggaatctgagatcactaactttttcgtggggacctctctcaaggatgaggttttgaagattatgccagtgcagaagcagacgcgtgcttgccagcacatcaggttcaagatgtttgttgccatcagggactacaatggccatgttggtctgggtgttaagtacttcagggaggtggccactgccatccatggggccatcatcctggccaagctcttcattgtccccatgcacagaggctactgggagaagaaggcccacaccattccttgcaaggtgacaggtggctgtggctctgtgctggtgcgcctcatccctgcacccggggcactggcatcatctcggccctggtgcccaagaagctgctgatgatggccagt

SEQ ID NO: 20801 - DNA, 1013 bp, Homo sapiens
aacgttaaactgtgaactactatgaactatctaaagctagtagttcacatagggtcacagataccacatataatagtgcttctctcaaaaatttaaaatatcttgtagtgcttctgggagttcatcatggtgccctgagacacaatatagttacggtgagattctgccaatttcttcatgcttatttctaaatattttgcattttttcttgctactctgaatgggattttcccctatgatattttttaactcttcatttctggaatctatgaatattgagtttgttacaggcaagtctggctgggtccttgaatatttatgactatatggaccttatacaaacaggcacacaaacacatatacaattaatgtagttaattaacccccttaagggacagtagcctcatttctgacataactttaggatagagtctagatacagaacaaaaggaagaactgggaaattattggatattaggagaggctaaaaatagaaaggcagcagaatctgggaagcagagatgcaaagtcacagaccaacagcaagggcaaagaaaaagaattgatggagggctggaaatgaagaagggagcaggaaaatatgggggcaggaggaagtattttaagagccactatggggtacttatttattatttcaatttataaaactgtgcccactgccaagccttctgggtacacgtggaacaataaataatatatgcccatctctacttccaactttgtatttttcctttcttttattagttgcattccccatctcccatttcccattatcagctatcactcctaatcccctgccaggaagacagatgagtgactcccactagatccacaggatgctttctggacaacttggtcagcatttcacttctacacacattccaccttcccctccagaggacatatccagggacccttgtgtatatacttgatatttatgaaggagtatgaatgggagttcagtattttgacctttgcttcatcctacctta

SEQ ID NO: 20802 - DNA, 1029 bp, Homo sapiens
taggggttcaaacataaaaaatgtagcaaagaacccattttttgataattatcccaagaatgcattttctagccttggcatcctttctctcagagtaacctatgaatagtgatataaagtcctattttgccctatactcttatactcttgtccatgcattatgattctttctgattttaactgtgctcctaatgtacagttataacaatgataataccagtaacaaacctaaaaagagagatatttttatttcaaccttaaatataatccctagaaagatttcattccattgaaggagtaatctttacctgtgttttcaccacaaataggctgggtagacctttggaaataataagcagtttgtttctattttgctcaatctttttcaaaaaatttcactatatatacaaggtgtgtggctatttcagtaatatgccagtggatgccaacagtagatgatttggtatcaagatggatgcaagcattggaccagatggagagtatcagacttgtaggagtctcaacaaatagcaaagtcaagaggactggggtggaaggatgcaaaacattttgacaagcatagatatatactcatcagcacacgaagttgaaacagaggtttctgccactgtatgtagcatctgcctagtgagcccctcagcagcaaagaaaagcttcattgtgctagacttaaattctgattcattgaacagtgtagtcttcaggaatggaaggcacccttgtgaacatggggctgagagcaaaatggttttaactaatgtaattaaaacacaaaatgagatttttggccacgtgaaagctagctgcagtgctgtgtgaaaccccttgccatgatctttctttcctgctttctttctgccctcattctgtgtttgagcgaatggagactcagggaatagtgaagtcccagagggacagagctctgttcttgctgaaattacaagcacagagctgcctgggcatgaacatgtagtgtttactctgccagtatgaatacaaatagtctta

SEQ ID NO: 20803 - DNA, 1067 bp, Homo sapiens
tttaaatcaaacagtgtgtactattttgtgtctagcttattttactcagcataatgtttttgaggttcagccatgttgcatagattatgtgtatgttccttttcatttttggatagtattccgtttcatggatttttttttttttttttgagacagggtctcactatcttgcccaagctagagtgcaatattgtaatcatagctgaccacagcctcgacctccttggctcaagcagtccttccacctcagcctcctaagtagctgggactaaaggcgtctaccaccatgcccagctagtttttaaatttttttagagacagggtcccacaatgttgcccaggcttgtctcaaactcctggattcatgggaccctcccaccttggcctcccaaagtgctgggattacaggtgtaagctgccatgcccagccccatttaatggatttatcgaaatttttacattcatttatcaaaatgtttatattcacagatatgttttggcaggtaaggtgactaactgggagctctgacatgttccaaggaaacaaggctttccagagtttccatcagatatagctttgactagcaaggggcacccccaaagggcaggcaatatcttgacactgttttcatttctatttcatttggggatgggtgactgccaactcagatattagatggttctttatgaattaatgggaggaatgatgagaatagaagtctctattgagtaggagagagtaaactaagaccacatgcttgtgatgatagtttacaacgatttgtgtgaggagttacatgtatatttcctaagtccatattcaaattatggatattaaaaaagactggctgggcatggtggctcacacctgtaatcccagcactttgggaggccgaggtgggcaaatcagctgaggttaggagtttgagaccagtctgaccaatatggagaaactccatctctactaaaaatacaaaattagctgggcgtggtggcgcatgcctgtaatcccagctactcgggaggctgagacaggagaattacttgaacccaggaggcagaggttg

SEQ ID NO: 20804 - DNA, 1092 bp, Homo sapiens
gataagattctaaatcaaacagttttacatctgttaataaaatgttaccttttgttcttgtaaaatttcatgagatttaaaaaaaagatctacatatctcccgagagagagttgttgttttatgactattgtgtgattcccactttaaaatgaaatgttttggattatttggaccttgaaggaagagctcactatatgagcagttatcataattagtagttctttttttctttttttttttaagatagttctgtttggtagtggaccaactattagttttcagaagggttggtttggatttttgttttaattacagtctatataattagttctcagcatgttgaggtaaaagagaattgtaccagcaagctcccaatttcttcatctcattaggtttttaacacgattattagtatcataatcagctatgatgttttttgttgcaggttttcacattctctgatttgcggggtgtcttgattggctaatttgggcaaattattttgattgtcttgatgatggttggctgattagaacacagcaagggcataatttcttcctgtgaaacgttgcattcttttgttttttggtaccagaatactaagagggtttttctttgtgtacattcaattatgatattcgcccatgacactagtagaatacttggaaagcaaatacattgatgatggaataagcatgaatgctttcagtggaaaaactggcagtatgaggatgagataggataaaagaatttactaaaactgtaggatcagacttttagatttcttcttttctgtgttttctgtgattctgtggtttttgagtgccaaaagagattactttttgtaagagtcttcagacttccatgtcactgaagaattgcttagtagttccacttttccattgcacagaggttcttgccatctcttgttctgaatgtttaatacttaaattgaggattttaccggggagttacaaatttactcagaagtttaaaaaaaaaaagttgtttatatgatctcatgacaacttttcttagctaaccttaatgaaagtggtttttctaattggtagtcattgcccacctctgcc

SEQ ID NO: 20805 - DNA, 1074 bp, Homo sapiens
gtataagtggctgtcttgaaactactggtgtctgttgacttctttttttttttttgagacagtctcattctgtcacccaggctggagtacagtgatgcaatctcggcaacctctgcctccttggttcaaacgattttcatgcctcattctctcaagtagctgggattacaggaatgtgccaccacacttggctcatttttttctatttttagtagagacagggttttgccatgttggccaggctggtctcaaactcccggcctcaagtgatctgcccatcttggccccacaaagtgttgggattacaggcgtgagccaccactcccagccttctgttgacttctaatatactagtcgcctatgcctagtggagatatgaatagttcctaaatttaaaggcctattaaatattgcttttaacaattttaaaagagagagtttttaaaaaatgccttcatgtaaggtaaggggggactgttgtatcaaaactgaaaggttacaatttgttagactgaattctagggatgctgtatctgatggtaggtaacatctacaatctaaacagtttaggacctgtgttttatgttttatggaaagtccttcttttctctctacctaatttcatttagcatctttatcaatattaatgtttacatttgaatacatgcccaacagtatgatttctataagcagaaattgtgtcatggcctacctttatgtaaatcagttctgaggtaatttagttgacttcatatcaccctttctcctccacaaagttctctttcagttttgtccaaatcaatataaaatttatttcgtaagacttagtcctaggagccagattgaaatttgttcacttgcaagtttgaaggtactaagctaagataaggatatccaaaaaggatgtttaactccaccaaagccttacaagggccgaatgggataaaatttagaatgaatggaaatctcatctatcttctgttttacatgtttttgctcctagaaagctaccctggttgaccatgggatccggcgccttactttcctggttgcacaaaaggtactgacatgtga

SEQ ID NO: 20806 - DNA, 1029 bp, Homo sapiens
gtataggatgaaaaatttgtagtggccaggtttgctggctcatgcctataatcctagcactttgggaggctgagataggaggatcacttgagctcaggagttcaagactagcctgggcaacatagtgggaccttgtctctatttcttaaaaaaagaaaaagaaaaaaaaaaagaaaacatgtaaatgatcattatggacatgaccaaatatttatctgttaatagacagtttatccttccttccttccttgcttatctcccttacatccccacagattcttattctacctaagtggataagctggctctaaacctacttacatgattgatttgggaccattcctttaaaaattagagatgttgggagtttttgctttttgacccatactgtgtagatggtgcataattcttataacaaagcagcagggggctctctgtaggagcttgagagttgctgatggagaaagcctggctttttgttgttattggtgttcttttcagttcgggcctttttctactgaaaacatggccgtcatcctgtgaagactcccaaagggattagaatgtagctacagaagcagttagattattttattagattaggaaatttgttaacagttgagagagattatactggtttctaaactctagaaacctggatgaatggaacctgaggtttctttggttgtagagttctctctgaactgagattcatgctaagaaactgtgcaggcggcccctttctttagcatcctttatatcgtaaaaggaaaactattctcattagcatctgcagttagttttctgttcagctgtacctccctctgttctagaacctgtgcctattttttctgtattgttgaggcccaagtgcattataactaaggatctcttgtaaaaataaaacccactctcctgagtgagaggcttaaggaatccaaacagcaaaggttcaggtttctgcactcagaggttgctcttgctgtcttatgaattcactctgtgatacaggtttgatgcaaagagcat

SEQ ID NO: 20807 - DNA, 1008 bp, Homo sapiens
gtatcaacatcttcatagctgtctagatggcaatgtacatatcttctagccaccttgatggtaagtagtcttcccctcactacttgtaacttatttttgatacggtccacatgaacatgctataaaccatgcttctgtatgagtaatgccatgcctatgaacccctgatttggtttagatggggagaatttatgatgctgatcagcacctttccttcctccacttaacctgactgcaaataattttgtccaatatgtaaataaagaagaaaagtctttctcagtgattccacattcactgaataagggtgatattaacaattgttaaacttaccctatgacattttttgggatatcaaaaagtgcagatatgactagaagaagctaccagttcattgctgatcctgggtttagtgcctacccggctaaataatagttaatgtcttgagggcattacacataaggtcacattcttttcgttttgaattgccttctaagatcaagttggactatgttggtttcttctgtcagtcaactgtgtaactttggctatgctttttttttttttttttaaattaaagatgtggtctcactgtgttgcctgggctgctgtcaaacttctgtgctcaaacggtctcggcctcccatcttggcctcccaaaatgctgggactacaggcatgagccactgtgcccagccttggctatgggtttaacgttttatcatgtttgttgtatttctgcaaattcgaactatttcctatagttagctaccatctaggtcaaaagtaaaagcaagaaataactgttttgtaccagtatggctgaataataattttcacttcgttttatgactctggacagttggaacagacctttggttggtggattgggatgccagatttttgcaagtgacctgtaatcccaaaatcagcaggttggctctttaaacaaacctttttatgttgactaaacacatctgctgacctagacaccatctaaaggtatcc

SEQ ID NO: 20808 - DNA, 1091 bp, Homo sapiens
gtgtgtgattaacagagaacttaaacaatgaatatataaatcttctcttccttcgaaacataatatggtctctcattctttattctctaacagggttttaagcccagctcaggaacagttcaggagctaaatttccgcagcaataagaatgtttggggatatttcagtgttgctgctgcagggggacttcatgaatttgctgattctcagtttggtcactgcttttcttggggagaaaacagagaagaggcaatttcgtgagtataatagcatttgattgcattttacaaaataaatttgtgctaatcttaagtgaaggtgtgagcatgggaataggaatcatctgctgtcaaagtaataatatgaacaacctttttgaagaaattttgaatatctttaattacacttgcattcatgttgtattaaattatgcagtgcttggcagatgtttttctgtttgttgttctgagccttttgaagtatttttcctttcaaatatttttgataaatgtataaaattgattgctttaaaggtatcttatttttccacaggaacagtattgttattgaggggaggtagattcttggccaagaactaggtatcaaataaatcatagacttttattttatttttttcttgtgagaagacttaaaatctattagcaattttcaagtacacaatctattgttatgagccatagtcaccatgatgtactcttatagttatttaaaataataaaattatactgctcatattatgaaaaggacataaagaaactgtctacattgctaatacaagagaccttagcatgctgtatataacagcttatgcaaatataactgctatatcataaatgttagataatattctattaatcataaacaatgaatattaaattaacagcacttttgcttgcctaaaacatagggctgaaggaggtaattttaacagcttagatcttttggaatatctatctaaaattgaaacttgaactagttcttttctgttttttaatggtttattgccttgtatcaaacatttaataccattccctttacctttgtactgtacatggagtaggtaattaata

SEQ ID NO: 20809 - DNA, 1084 bp, Homo sapiens
gaaaaaggaaacccagagatgtgagcctgacatatgaggctacttttcccctagatatatcttctagttcaagatagtagaaaggctgataagttttcaacagtcttaaaagactaagagggcttcctggggaggggtgccctggaaaacctcccacattttaggttaggatctttaaggactgactacatcatgggagaaagggtgaactggaaatagactagccctcacagggactaaatcttggcttcaaaacattcaacctctgatttaagcaagatgttttaggattgctagtgcttctagacacctgcaggaagcaaatgtaaatcctttccagagaaagataacatccagaacttaaaattatttctattaatttttcttacagcttatcaaccactcaattgaaaataggcatacaaaattagatgattgaaaaccaagaagaacaaaacagtagaaacagacccacagagggtttatataatgagattatcagacaaggactttaaagtaattctgcgtaatatattcaaggaaagtaaaggcaagattgagaattttggtagagaactggaaatcataaagaagaaacaaaagttctagaactgaaaatgcaataactaaaattaagaagtcaatatcaggggttcaagaccagcctggccaacatgatgaaaccccatctctactaaaaatacaaaaattagctgggcctggtggcacatgcctgtaatcccagctacttgggtggctgaggtgggagaatcacttgaacccaggagacagaggctgcagtgagctgagattgtgccactgcactccagtctgggtgacagagcaagacattgtcttaaaaaaaaaaaaaaagaagaagaagaagaagtcaatataggagtttaaaattatagcatattagatgcagttgaagagaatcagtaactggcactggagactgagatgggagaatcccttgagcccaggagtttgaggctgccttgagctatggtcatgccactgcattccagcctgggtgacaaaacaaaaaaatctagaaaaagataaataattaacgactggt

SEQ ID NO: 20810 - DNA, 1048 bp, Homo sapiens
tgggacaataggtgagagtctcactctgtcccccaggctggagtgcagtggcgcaatctcggctcactgcaacctctgcctcctgggttcaagcgactctcatgcctcagcctcccgagtggctgggattacaggtgcccaccaccaggcccagctaattttttttttttttttttagacggagtcttgctctgtcacccaggttggtgcagtggcgtgatctcagcttactgcaacctctgcctcccaggttcaagcgattctcctgcctcagcctccctcagcctcactctgtctgtggtgggactacaggcttgtgccaccatccccggctaattttttgtatttttagtagagatggggtttcaccatgttagccaggatggtctccatctcctgacctcgtgatccgcccacctcagcctcccaaaatgctaggattacaggcgtgagccactgcgcctggccaattttcacttttaaaatatagtattgttatattctgttgtattatctaacattgtttaataatttgcatgctttccttcctataatcaaagagaacaataagcctattttaattttgaagaaattctagcggaattttttttagtagaattttttttagaagggacttaaaatcttttagaaataagaacaagataatcaccattctgactggcatgagatgatatctcattatggttttgatttgcatttctctaatgatcactgatgttgaggttttttttaaaatatgtttgttggccgcataaatgtcttcttttgagaagtgtctgtctgttcctgtcctttaccagtgcatgtggggcttaatacctaggtgatgggttgataggtacagcaaaccaccatggcacacgtttacctatgtaacaaacctggatgtcctgcacatgtatcctggaacttacatttttaaaaaagaacaagataaaataaatttattattagtaaataatggtggatgcttgagttgaaatttgaaagctaaaataaatttataaatggtggaaatgaactttga

SEQ ID NO: 20811 - DNA, 1032 bp, Homo sapiens
acacagaatatcatgagcatctacttaagtaaaagctaaaaacaggaagatattacaagataacattcagctagtgtttatttctttaagagatctgtctgtggcaaatttgctttcatagtaatatatgtgtctcagtaagtagtctttctaggcaggatttttcttccctgcttaagggggttagacctccaaaatatttgtcagggtctcttttccttttaagggtttaacccacaatcttttctgtatccgttttgtaccagctccattcctattctcaagctttggtgcataaaaccttagtttaggtgtctatatataccactactttggcctgaaaattagaatcgtggctcacacttgattctaagttccctagtagtggcgtgtttcctttctacgtgcttactttcccacctgacctgcttttccccaccgtgcagtctgataattggtattatttgttttgattggatctcagaaattacctctttagaccgagctgtgctcctccctctggatttcatgagcccattattttcttggcttaattgtccttgtaaatttggtctttttgtcctgggctttccctgtcatgtgctcctggcagccaggagaggcagtggagcttttctccgttgactgtcagaagaaagtgactgttgttgaaaatgtttgctgcaactaaaggagagctgctaagatctactttctagttaaacaagcttttatatttctccccggctcctctcagttcccttgggaaatcaactaattgtgtgtgtaagctaagtgtgtggaggagagaagatgcaaaaaggaagagaaaggtggggaaagaaggaaattgggaacaattagacaaaaagactatagtttgaggccatcaggagtattctagtctgactgaagccaggcagaaggcacagtatctcttgtcctcctgggttttaagcagctgcaacaggaggaggaactgcggcttgtgtttacaaggccgaaatctgaagaaaaagcttccattctttt

SEQ ID NO: 20812 - DNA, 1048 bp, Homo sapiens
tatcaagatcacagggtgtaagatctatatagaaaagttaagtatatttctatatgctagctagaaatgaacaatccaaaaatgaaattaagaaaatattctgttcatgatagcattaaaaagaataaaataggaataaattgagcaaaaaaggtataagacttatacactaaaacttgtggaacattgctgacagaaattaaataaaatcagccaggtgtggtggctcacgcctgtaatcccaaacccagaggctgaggcggatggatcacctgaggtcaagagttccagaccggccgggtgtggtggctcacgcctgtaatcccagcactttgggaggctgaggtgggtggatcacctgaggtcaggagttcgagaccagtctggccaacatggttaaaccccatctctactaaaaatacaaatattagcctggcatggtggcagtcacctgtaatcccagctactcgggaggctgaggcgggagaatcgcttgaacccgggaggtggaggttgcagattgcagtgagccgagatcgcgccattgcactccagcctgggtcacaagagcgaaaccctgtctcaaaaaaaaaaaaaaaaagagttccagaccagcctgtccaacatggtgaaaccctgtctctaataaaaatacaaaaaattagctgggcgtggtggtgttcttttagttccagctacttgggaggctgaggcaggagaatcgcttgaacccagatggcagaggttgtaagtggagatcgtgccactgcactccagcctgggagacagagcgagactccatctcaaaaaagaaaaaaaaaagaaattaaataaaatctaaataaatggagaggcagtccatgttcatggattagaggactcaatattgtcaagacagcagttctccttaaattgatcataaattcacagtccatatcaaatttccagcagcctttctttttctttctagaatttgacaagccgatcctaaaatttacatggaaacaaaggacctagaatagccaaaacacttttgaaaagggaatgt

SEQ ID NO: 20813 - DNA, 1006 bp, Homo sapiens
ttaccaccttgggaggccaaggtggatggattgcctgagctcaggagtttgaggccagcttggacaacattatgaaaccccatctctactaaaaatataaaaaattagccaggcatggtgccacacgcctttagtatcagctgcttgggaggctgaggcacgagaaccacttgaacctaggaggtggaggttgcagtgagctgagattgcactccagcctgagggatagagcgagactctgtctcaaaaacaaagcaaaacaaaacaaaacaataagaaaaaagacattcaacacaatagaaatatggggaaaagacttcaacaggcacttcaaaagaagataccaaatgtcaagtaagtatatgaaaaggtgctcaatattactagtcatcagggatttgcaaattaaaattacaatgagttaaacacatagcccaaccaaaaaaggtaaaattaaaaaacgagcaatatcaagtgttagcaaggaagtggaacacactgactcttacacatcactggtattaatatgaattggtacagccactttagaaaactatttagcagtatcatttaaagctaaacatgcacatacctcactagtgagcaatttcattttagtgtatattcccagaggaaattagttcatttatccatcagaaataagcaaatattgtcaaaattcataaacaacccaaatgtccgtgaatagtagaataggtaagtaaatcatggtatatcatatgatggaataccatacagaaatgaaaatgaacaaactactgctgtatcacaacatgggtgaatttttttttccataaattcgaccaagtggtaagcatagataaattttatacacataaggccaggcgtggtggctcacgcctgtaatcccagcactttgagaggctgaggtgggaggatcagttgaggccaggagttcaagaccagcctggccaaaatggtgaaacctcatctctagtaaaaatacaaaaaaaattacctgggt

SEQ ID NO: 20814 - DNA, 1046 bp, Homo sapiens
aatggtgcgatcttggctcactgcaaccttcgtctcctggtttcaagagattctcatgcctcagcctcccgagtagctgggattacacgcgtgcgccactacgcctggctaatttttgtattttcggtagagacagggtttcaccatgttggccaggctggtctccaactcctgacctcaggtgatccaccctcctcggcctcccaaagtgctgggattataggcatgagccaccacgccaggcttgttttgttttgatttaccagtgcataatagaaatacatcaagcataagattaaattgctttttaaaaaggaagtcttgggaaatggtggcatttatcttagtgaatttatagttcaaaaactaggtaatgctgaagacctggtattgtgaaagccagcctcagagaacgctctctcatctgatgttgacctctctaaagtgctgtgaacaggttcaggtgtagatcactatgtaacattatttcctttgcagtcaatgactaggaaaatttttatacctgtcacgtggactggtttaacaggtttagggctagtgtttttctttctttaaaatctttttttcctttaattggatggctaatatcctaatagtcttagttgaggaaagaagtaaattaaaatacaaactgtggaataatgcattagaaattagtattttcaattgtgggaggagaagagaatccttttgtaattcagaaaaaaaagttatctcattatctaacatgttcctaaagattaacaattatagaagctgccgggcgcggtggctcactcctgtaatcctagcactttgagaggtcgaggctggcgaatcacaaggtctggagatcgacaccatcctggctaacacagtgaaaccccgtctctactaaaaatacaaaaaattagctgggtgtggtggtaggcacctgcagtcccagctactcggaaggctgaggcaggagaatggcatgaacctgggaggcagagcttgcagtgagctgagattgcgccactgtactccagcctgggtgacagagt

SEQ ID NO: 20815 - DNA, 1033 bp, Homo sapiens
aggcacacgccaccatgcccagctaatttttgtatttttagtagagacgaggttttaccatgttggccaggatggtcctgatctcttgacctcatgatccgcctgcctcggccttccaaagtgctgggattacaggcgtgagccaccgcacctgacgcttttgagtttttaagagtttttctgtaacatcctgagagcctatccacttatttcccagttttagtctagagtttaaagttttttccattattctgcttgtggatccccaatttctctaaaaatgtcaagttttattttatttttccagtaatgtagcaatagcatctaggggactgccagtttataaagaggaaccggctacactaaagaaaaaaaaaaactatatgaaaaaaagaaagggtgagaaaaggaaaggagggcagaaggagagaaacttcaggctgaggttaagaaccactgtccagcagctgtgggggaataggcattctcccccagtgtggatatgcacaatggaaccaacctctagtgagggtaatttagcagtaactatcagcctttgatgcaacaatcctgcttcttggaatcttattgataaattgataaatcttattgataaattgcaggtatacaagaagaatatatatagatactgagtaatagtgaaagaggggaaaagaatttattaaaagaaaaaagagaaaaaagaagaatatatacggtcattgttttcggaattgtttgtatttgcaaaagattggaaacgaccaaaatatatatcaatagggggctagtagaatatagaagagacatggccgggtgcagtggctcacgcctgtaatcccagcactttgggaggccaaggcgggcagatcacaaggtcaggcgatcaagaccatcctggccaacacggtgaaaccccatctctaccaaaaatacaaaaaattaactgggtgtggtggcgagtgcctgtagtcccagctactcgggaggctgaggcaggagaatggcgtgaacccgagaggcggagcttgca

SEQ ID NO: 20816 - DNA, 1046 bp, Homo sapiens
ggggcagtggtgggaaaagtctctgatgaagcccccaggactttacattgtgagatccctggtaaaaaagctataaaacaaagtagaaaagatgaaactttaggggaaaactttatcctgcctttggttttatctgatgaaaccctgcccagctgatagtaaacttccaattgtggtcccattaacctgtctgtccataggtttagggtgtgagcacaaaataatgccaagagtaaatgaggatagagacactaataagagatatggattaaatgcccatgggacttttaactaacataggatcaaagtgaaggagtcatgccaatgatatcattgcctatcattatttaggccataataataataaagatgaaggccataaaaactgttgacagtttccttctttaaaaagagatggctccaaagtccaaggaagaacatgaaatatcacagttagccttaatgactgctgcaagtgtgtctagtagaatctagatcaactactctgagaggggactggggaaagcaggaggagctggaagaaggaaaagccacccagcttcatgtactccttgatttcattcattcagcaatttttttttttttaagacagggtccccctctgtcacccaggctggagtgcaatggtgtgatctcagctcactgcaacctctgcctcccaggttaaaatgattctcatgcctcagcctcccaagtagctgagactacaggtgcatgccatcgcacccggctaatttttatattttttggtagagatggggtttcaccatgctggccaggctggtcttaaactcctgacctcaagtgatctgcccacctcggcctcccaaagtgctggggttacagacatgagccactgtgcccagcctggccttgctttcaaaggatctctgggctactgtgtggggaatgggttggggtgggcaagggtagaaggagggtaacctgttaggaggccattgcaaaagtccagatgagagatgatgtgattcacaccagcagtggaagtgatgggagatggatag

SEQ ID NO: 20817 - DNA, 1572 bp, Homo sapiens
cagcctggcccacatggtgaaaccccatctctactaaaaatacaaaaattagccaggcgtggtggtgcatgcctgtaatcccaactactcaggaggctgaggcatgagaatcacttgaacccgggaggcagaggttgcagtgagccaagattgcatcactgcactccagcctgggcaacagagcaagaccctgtctcaaaaacaaaaacaaacaaacaaacaaaaatatatatatgcttgaaaattgctaagagagtagattttagttgttcttaccacacaaaaaaataagtatttgcggtaatgggtatatatttgaggtaatggatttgttaattagcttgatttagccattccacaatgagtacgtctatcaacacatgttgtacatcatgaatatacacaatttttatttgccaaaaaatgtttaaatatgccataagtaaattaaataaaatatatttcttagaacattatttataaaaataaagcaaaaaaccagatctgtccaaatataactaataaactgactctcattatttaacactcaagagttggctggtatcaggattttcataataccatggccattaaacagttttcgtgaatccaggccttcgttacccatctcttctgcttcttcctcaccttactgacttctttctcatgtacacagagtgcggaatatctgtctcatgagtcaccagcctttgggcagaacccaaaaaattaggtgaactagaaatatattgttgctaagtggctcggtttatcagacaattctaaaatgcctactaggctgcctagctgcatacttttctgcctaatgtacaggacctccatcttgtgactgtcaaaacaggctcctaaattattttgcatcatttggtgacaggcagtctatactcttgtgcaaccaacaggtgcccaataaatgcttggaatatgcaaggaacttggcattgtttaatataattgaaaaagcaagcatggactttgaaactttcctgaatttgaattctgtctccactccttatcacctttaagaatttagggcctggtgcggtggctcatgcctataatcccagcactttgggaggctgaggcgggtggatcacttgagatcaggagttcgagaccagcctagccaacatggtgaaaccccatctctactaaaaatataaaaaattagccgggcatggtggtgcatgcttataatcccaactacttgggaggctgaggcaggagaatcgcttgaacccaggaggcagaggttgccgtgagccgagatcccaccattgcactccagcctgggcaacaagagtgaaactccatctaaaaaaaaaaaagaatttagggaagttattatcttcctgcatctcctttctcctcctatgtaaaatgaaaataataatgtctaattcataagcgtttcataaggatatgatgaaagcccgatgcagtagctcacgcctgtaatcccagcactttgagaggctgatgtgggtgggtcacttgaagtcagtagttcgagactagcctagccaacatggtgaaaccctgtctctacta

SEQ ID NO: 20818 - DNA, 1035 bp, Homo sapiens
caccgcccagacgcggggcgggcccccggggtcaggcccggccccacaccgccctcccccacagagcggcgaggcccgccgctgcccgcccgccggcccgccagcctgccgcgtcaagcccgccgccggggcccgcagcccgcgactcctcccccgccgcacctcgtggcccccgcttctccctagtcccgctagaggggctcgcgctccgccacccgcccgcccgcccagcgctgcctggcgcctcacctcgccgagaccccctaatccgcgccaaagagccgccggtcgcgcgcgcctccgggctttgcgtgcgcgcccccgggcggcgcagtggcgagcgcgccgcgtgccgcgcgcccgccgcctccgcccctcggccgtggaggcccccgccgggtgctgagcgcccgccaccgccctcttggccttttcccggtccccgccgcgcgcctgctgctgtccccgtgcccgaggactgggaggatggggctgagccgcttgcctgacttttgatccgaccagtaatcactttgcccgtgtggcgcgtggcccgttgcctgaggcttcctggcgcgtggggctgtttggtcccctccggagtgcggtgaggcgggccgagccgggactgcctgggtttggggataacgttcccatctccacccctgttgcagcaagggaaattgaggctgagggaactgggcccagggacggcgagccgtggctgcctctccagtccgggccccgaagggctgctcgtggatgaaccagactgattttaaggggtgaagagggtgcgtttcaatcagatgcttctggaacgtcgaaattgtcttctttggaaagaaccatcccctctttgggcttcagaggcccaaattgaggcgcaatgatgagaggatgtggtggtctactctgatgtcaatcttgagggctaggtatgtcccaagatctcttattactgctgttaatgatgattctaatagctaccatttgtcgagtacttattgcatgccagacattgcacaaagcagg

SEQ ID NO: 20819 - DNA, 1011 bp, Homo sapiens
gagcaccactccctgtaggtgggtcattctctctctcctaccataatccccaccgcttcctgtctcagcggacctacttaagttgttcactttacttgcctggtctctgaaggcatttgagtttgcctcttctgctttaatctcatcctgacaggaggggtcgttgatttcaactggattgagagactgtgaaggaactcggttacaaatccataacaaatgactggaaaagccacacaactcttacatactgatatttagaaaggtgcttttgttctccagactccagtgattctgcactgggcattatggaagacttgtgatagatcagagaagagtcatgttgaaaacgaaacgcagggaaaccgtgcaagagagaacagtagaaaagatttaacatgtagcttcccagaaagaatgaatgaggaatgtgtttgtgaatgcctcatgacataagcatctgaagaagagggtcgtgggctgggcgcggtggctcacacctgtaatctcaacgctttgggaggggaggcaggcagataacttgagatcaggagttcgagaccagcctggccaacacaatgaaaccgtgtatctactaaaaatacaaaaattagccaggcatgatggtgtgcacctgtagtcccagctactcaggaggctgaggcaggagaattgcttgaacccaggaggcggaggttgcactgagccgagatcacaccaccgtactccagtctgagcgacagagcaagaatctgtctcaaaaaaaaaaaaaaaaaaaaaagaagagggttgtggtagcgaggaagagcctctgcctgaactaaggtgagtagccaaaacctttgactgtattatccccttctcccaggatcacacaagaggagtttgagccttggtgataaagaaataagccgttcttctccttctccagctttggagcagcctttcagagaccgttccaatactctgaatgagaagcccgccctgcccgtcatccgagacaagtacaaa

SEQ ID NO: 20820 - DNA, 1014 bp, Homo sapiens
ggtgcatgcctgcggtcccagctactcaggaggctgaggcgagaggatcgcttgagccagggaggctgaggctgctgtgagccatgatcatgccactgcactccagcctggacaacagagcaagaccctgtctcaaaaaaaaaaaaaaatcagtaaaaaatatgccgaaatagcttcagagtaattatgaattgccttccaaaaaccactgttttgcacttgcctgcaagaataggaaaaacaaaaggactgtaaggtggcaggatggcagaaccaaacaagagtagtacaccttggagttttttcgaaatatgggttgggtttttgggctcttggttgatttaaaataaaatttaaatgccttcagcgtctgtgataggtgccaacatgaagctaccgagttccagagaaagaggggagagctgatcactcatcagtgctgcgagactatcaaagggcccttcaggacctatctgttctttgtgtgtaaagagtaacaataaaagaacaccagtgtacccaccgtatagtttaaaaatcaggactcagcctactctttccactaaccgcgatcatggttttcaaacggaggaccaacggcgctttgccactgggccgccagctgggccctgcagagggcctaccagacaatgaatcagctcccttggagaggcgcccgcgaccgccccaccagcccgagagctagaattgaatctgggggacccctgcggcgccgggtcacgtgccgtgggcgcgccacgcctccccgagggccgggggagtcacgtgggcgcgaggccccgccccatcgcccggtccgcggcgaggtggggcctggtgtttgacccggaagtggctgtgttcagctgacagctgctgataaggtggcggcggcgaaggcagcggcaggtcgggagcaagatggcgctgcggccaggagctggttctggtggcggcggggccgcgggagctggcgcggggtccgccgggggaggcgggtaggtgtgaagagcc

SEQ ID NO: 20821 - DNA, 1030 bp, Homo sapiens
tcgttatcttcagccccaacttccccattgagctacaaacctgaatccttgctgcctagtggacctcacttcaggcatcacaaactcagccccatgcagtgagtcggggaggaactggatttggagccagaagaactggttctaatatctacttccctgtgtagagttgggatttgggattatatgagttaatatacaccaaagaactttgtattactataataatagtttgcaaacattgattattttctcaaaacttttttcctttgtctgttaccacttagttaatgacattcaaccttcactaggctataggatcagactgataggattcgtgtctaacatggattaccagtgagtgatgactggcaagtcaaccactctgtgcctcattttcctcatctgtaaacggaggataataatacaatactcctcataagttgttaggaaaattacccgagttaatacatgtaaagcacttagtaaccgtttctagcatgcagtaagcactgaatcattgtgaactcattaggtcaggatccgaacctatgtgtcataccatgtagtaatgtagtttactgtgatggttctgcctcacttaggtgattgtgattttctaaagggcagagaccatgtctaatgcatctttgtgttcctagtgcctcattatttgatacacagtaggtttcagtaaatgtttattaaactggtggtagggttatggaaagtaaatatacgtagaattttttattcaatttttcttactttgctctttacaggaaaaaggtcactggtcagaacagcaagaagaaagtagctcttgaagacaaaagttaaaaacagactttaaaaatactgtcccagaaatgtaattttatgatcccagcatgaatgttattttcatggaatacttgaagtcttacagtcacctgtaccaaacatttgaaatcaactacaagtacatgggactggtgataaatgatcctaaactatcaagtcagtttcaatttgtaggtgccttttttttttc

SEQ ID NO: 20822 - DNA, 1047 bp, Homo sapiens
aggttagaagttatgactatgacaataacacattaatatgaagaaagcatagacattttatgaaggttttctatgaaagggcatgaaatgtacctaatatctgtgatgttttgattcttggatttaaccaaaaagtttcatatgctgctaaaggttatcccagaaactgttaatgttgctttataacatctgagaatgtatttatttggccatatccatggtggcctctttacttcacttttcagataaacttcttgcggaataaacacaaaattcacgtccaaggaaccgatcttcctgacccaattgctacatttcagcaacttgaccaggaatataaaatcaattctcgactacttcagaacattctagatgcaggtttccaaatgcctacgccaatccaaatgcaagccatcccagttatgctgcatgtgagtatgaagatctagaatgcctgtaacattccttcctctgtgtgtttgctcattctcttccctctcttcttgaactctttctttccaccttatctcccctgttaaaatccttcacttccttttaaggttcatcaaatgcctgtgcctccataaaagttgtcttgatcactccatctagatgtgatcttcttccttttctagtaccctttcccccacactgcagttcttccatggtatttggtgtgttcttttccttgcaacatttattttacattttaaactactttgtattcgcaccaatcatatttatctttttcattttactagtgtgtaaccccttggagaatggggattatgttctattcattcatacattcattatttagtttataatgcccaggaactactccagaaatacaaatgctttctaaagttcttgtacataaactgacttatttttccgaatactttttattattaaagtatactttacatacaataaaatgcatagatttttaagtgcccagtttagtgagtttcagcaatgcatgccctgtgtaaccactattccagtgaagatagagaacatatgtattaccccagacaattttct

SEQ ID NO: 20823 - DNA, 1079 bp, Homo sapiens
accacttgaggtcgggagtttgagaccagcctggccaacatggtgaaactccgtctctactaaaaatataaaaaaattagccagatatggtggtgcacgcctgtaatcccagctatttgggaggctgaggcaggaaaatcgcttgaacccaggaggtggaggttgcagtgagctgagatcatgcctctgcattccagcctgggtgacagagcaagactctgtctcaaaaaaaaaaaaaaaagaaaaaaaacaacttccatgttttcttatttgtagtttcaatttgttatattaaaatctttgaccctgtgaaattttatttggtataaggagtgaatagggaactaaaatttttttcagatgtctgaataattgtcttaataacataattgtcttaataccatatgttggtgttttatcttatgttgactaattgtcttaataccatatgttgataatccgtgttttctctattggactttaacgcaactttaattgtatacttattttccatatacattcaagtctgtctctggacctcttctattctgtttctgtatttgtacaccaatactagcttgttttaaatactatggccttatatgttataaaatccagtagagtggagaggcataccaatattttaggcaactcaatgttttctccctacagtgatctacagaatcattgcaatcccaattagaattctagcagaattttttttgtagaaatttctactaaagctttggctaactttcttcagacactctcataataagcagatactactctttggccttccagaaagtcaacaagtgaagtgccttgagcatccaaaaaacctgttgctgttgcctttgctcttgactggtcaacttttgctttgactggaccacttccacctcttggtagccattggtttaattgtgctttgtctttatgatcaaactggtaaaaccatgtttcatcttctgttacagttcttcaaagaaatgctttaggaccttgattccacttgtttaaaatttcttttgaaatctctgctcttgtctgcagctgatttgggagcagtggttttg

SEQ ID NO: 20824 - DNA, 1048 bp, Homo sapiens
aactctggagccagattatctgggtctaaatgctaagtctgccagttactcatttttagacctacctcaagttacttaatttccgaatgccttggttttctcattcgtaatactgctatttaccttatagagttgtaaatatgaagcaatttaatatgtataaacatgcttagaaatctgcttgacatttagtaagcatatatgtgttcattgctaatattaatttgttactattatgaggtcagagaaggtctcttcagattccatttgtccagacacctgttagctcgacagatacttggtgaaagggtagaaaagatgaggagtcattgaacagtcttgcttgaatgaaagcaatggtattctgtcagtaggtttcattttacattttttgggttttagataggaaaaaggaaatatgactttgattcttcggaggtgcttcagggactggacttttttggaaacaagaagtctgtcccaggtgtgtgtggagcatcacaaacacatcagaagccccaaaatggagagaaaaaagaagagagcctaactgaaaggaagagggagcagagcaagaaaaaaaggaagacgatgacttcaggttagtgtttgatttctgtcatgttttttctctttaatttttttcagttataaaaataatacaggcttatggctacaagtcagacaataaggtcatttgtcagctgatggcactcaggttgtttccaggtatttgtcattagaaatattgttacagcaaaggtaattttaagtaaagatatttatacataaatccttttgtacaggtactgttatttctgcagaataccatccgaaaagtagcatcatatggtgaaagggtatgtaccctttctctgaaaaatactacaaagtgacttcccaagtccttgtcagtgctgaatattattggtgttaatttttttgccaagctaatgaatgaaactttttttttttgagacagagtctcactctgtctccaggctggagtgcagtggcgcgatctcggctcactgcaacctctgcctcc

SEQ ID NO: 20825 - DNA, 1767 bp, Homo sapiens
acgcctgtaatcctagcactttgggaggccaggatgtgaggactgattgagcccaggagttcaagaccagcttgcaacatagcgagaccccacctctacaaaaaatacaaaaatattagccgggtgtggtggtatgtgcctgtagtcccagctactcaggaggctgaaatgggaagggtcacttgagcccaggagtttgaggttacagtgagcaatcgtggcaccactgcactccagcctgggcaacagaacaagatcctgtctctgaaaaaataaaaaatcaagggaatagtcatgtgttgcttaacaacagggatatgttctgagaaatatgttgtcaggcaatttcatcaatatgtgaacatcatagaatgtacttacagaaacctacacagtatgtcctaggctatatacacctagcctacacggtatataccctgttgctcctaggctacaaaatacctgtacagcatgttactgtactgaataccataggcaattataacacaatagtatttgtatacctgaacatttctcaatatagaaaagttacagtaaaaatatgatattaaagatgctccatcagctggctgatatgcctataatccgagcactttgggaggtggactgcttgagtccaggagtttgataccagcctgggcaccatgccaaaacctcatctctataaaaagtacaaaaattagctgggtgtggtggcatgtgcctgtagtcccagctacttgggaggctgaggtaggaggatcatagtttcaaagtgtggcacttactggttctccactcactccctcctgccatcttgtgaagaaggtgcctgcttccccttccccttctgccatgattgtaagtttccggaactgcaagtcaattaagcctgtttcctttataaattacccaatctcaggtatttctttacatcagtgtgaaaacaaatgaatacagtccccttccctgaggtgccttctccttaggcaaccagctgcccccatgctcctcttctgcccccctggtatttcctttcccctcatgaggcccaagtgatccacatggccagccacagccccatcctactgcaggcctgtgtggctgctagagaggccaggctcctttccgcaccccgaggctgcccgatatgctttctgcatcctgtagaaaactgacccactattctcatactggtgcaacttcttccattacctcaaaactggacaacgtgaacttgtttcttgtctcttcttgctagggctgtcactgggacagtccgagatgggggggtggggggagacaatggatgaatggatggatgaatggacagtagtccagggagatgtccctgtgtgtcctgaactgggaccttcctccaatgagaagccttcctgagtgagtttatacagtcatcccttggtatccatggattagttctagggtccccggggatgccaaaatccatggatcctcaagtctctgacataacatggcctagtatttacatatcagctatgcacatcctcccgtagacattagaccatctctggattattcatgatgtgtaatacaatgcagatgctacataaatggtcgtgatactggattctttagggaataatgacaagaacaaactctgcacatgttcaatagaaacataaccgtccaatttattttctgaatattttccatctgctgttgctgaatctacagatgcagagctcctggatacgagagccaagtgtgctttgagagtagggtggg

SEQ ID NO: 20826 - DNA, 1038 bp, Homo sapiens
tttgccttctactttcaattgccttcttagatgagctaagtgttgaacggccggctcagtgctgtttttgggactatggaatgcatcttcctccaccactcccctcatttaatgaaaggactttcttctctctccatctagcacagtaatcgctaatcccttagacaatgttttcccaaaatttcaggcagctattctatcaacaaactgataattaaacttgtgtcacatctttgatattctgttgtattaattctgttggggtagtctttaatcttcgtgaaactttttctttccatattaggaaatattttcctaatatctctaaagcctaacttgtccatctgacttactgtctgaatcttcccaacttatgcatgcccacttttattgtttaaatttgtttcttttttttttttttttaaacatagggagactgcattgcttattgatccaaaaaattcctgttcttcatcccgccagtgggttgctctggttgtgggacatgaacttgcccatcaatggtttggaaatcttgttactatggtatttaatatttttaagtgctcaaatatatttatcttcatcctactccacattattttggctacatagtatttcaagtttggctgcaacactgtgccaaaaaataattgagtgatagaaaagtattattttaaaaggtccactttgaaagggcttatcagaatctctgcattgaacaagggcatatggacagtctttattcaacagacacttcctaaactgttctaaaatttgtctgcaaatgggaaaagtcaagatactaatttgggtgagaggaaaagattcctcttaggtgtagatgaatgaatcatgcagtgagattccaggctaactgtagtttcttgaatcttatttgttaatctgactcacagctgaaaagtaacctgatgaataacagactgatctttaattagagagaaatgtttttaggagtcagttttttcattgcctaaaatgttaagttgaaatttaatgaaataaaagtaaacaaac

SEQ ID NO: 20827 - DNA, 1029 bp, Homo sapiens
ccaggctggtctcgaactcctgacctcaggtgatccgcccacctcggcctcccaaagtgctggaattacaagcatgagccactgcacccagtctgttgtttctttttatgatacagtatcttgtcattggttccattttatttactaaataaatggaaaattctgtttactgaagtgtctttcctttataactgataccctgcagaacccctaagttttattttgctttcataaggttgctcttttttaaatttttaatgaaagagtaaggactcaagtaggtcaagtggcgacagttttatgtgtagcatatggaagtgccattaaatgaatgacctgtcttgaattgatagagcatctgtctttattcccattgctgccatcccagataaagaacaaagcacatcaaagattgagaatatttttatttttaattcaaaaataaaagccagagaggcaacttaccatgttttcccaactttgaattcttatagcatactctttactgttctgtgctctgtgctgtgttaacattattgatttgaaggcatttgcattaaatttgaaatgttaaaatgtaaacaaaaatttagttgtaaataattataatatattgttaaaatccatagcagacactgttcctggatatttgctggaatggcagtggtagcaagtgttgtcttttctttctagttaatgcctagcttgttgcctggcactgaagagaaagtaaatatttgaacaagggaatgaatgaatgacagagggaaatggcgactgctttatgaaataacttgttaggttaattctaaggtatttatatttcatattcttttcttaaggctactgatgcccgaagggcttttccttgctgggatgagcctgctatcaaagcaacttttgatatctcattggttgttcctaaagacagagtagctttatcaaacatggtatgtatgtgtttataagtttatctaaaattttaataggctttagcagatttagtttgctgattagatgggataatat

SEQ ID NO: 20828 - DNA, 1051 bp, Homo sapiens
cactacttactaattttatgacactggacaagttatttagcttctcagcctcagtttcctcatctgaaaaaatgaggacaatatctacttccaggtttataaatagttatatatattttaaaagcactgtgcacaatagcacatatcaggcatttaagaataaatgtttgtttcctttcctgttcttatttccacatattggtagtttgagactaagttaataactttttaggcagtcaccctaaacatgactttcaagagttattttaggattagtctgccttttactttagtaagtactgtattctctccattgccaggaggaatatttgaaaaaggaaggaatgatttgaacattgtaaatagctaactgaatatagtgtcttgaggacatatttttggtaactgtgtttaacatctccataaaagtgttttttatttatcttcaatcacaggtacgggaaccttaaagatagattttgttggagagctgaatgacaaaatgaaaggtttctatagaagtaagtatactaccccttctggagaggtgcgctatgctgctgtaacacagtttgaggtatgggttattcttctctaaaatattattattcttaaattaggcattctgacaaaggtgtgtttattatgtggggtgattatttgaggctaggtgcccttggccatgattgtattcacaattttagaatttttattttatatttagccattatctctatagaaaggagggaattaagggtatgggttggggaatgattatatacagttatacacacagacattcaaacacacgacacattttgatacctgaattgcctatatactgtgtacctttcttaaaatcattctcttagtatttgacacctatggcttttcctacagtattattagctgttttctagaattcctttccttctttgacatcttttgtttatcttactgtagtatctgtgctgtctttgattttttttctctctctctgtgtgtgtgtgtgtgtgtgtgtgtgtgtgtatacatatatatatatacacac

SEQ ID NO: 20829 - DNA, 1082 bp, Homo sapiens
ttggagtgggggatggattagctaaagcatgactttctacagtgaagagaaaatgtctaaagttgaaaaatgaagaaataggccgtggtcgtggctcatgcctgtaatcccaacactttgggaggctgaggtgggaggattgcttgcccaggaattgaaggctgcagtgagccgtgattgtaccactgccctcgagcctgggcgacagagcaagactgtctcaaagaaaggaaaagaaaaaatagctgtgtaagcaagacatttagaagtcacagagtttgaaattgattgcttctaggggcagggtgtggggagtagggcctagtgttgagcagggcctggagcttacgtattttaaactgtgaactattactttgatagaaatttaaaaaattttagagttttaaatctatatcattacagactatatatattctgtgtttacactgtgaaaaaattagaagtcaatagaaaaagagaaatgaaaaaaatccctttttatatatttgaaaaaattatacctctgaataattgagtcaaagaagacttgttatggaaattagaaaatatttagaactgaataatgaaattaccacatatgaaacattagggataaacatgtttcatatgcagataaaatattagaatatttagttaagaagaaagactgaaaattaattagctaagcattaaactcataaaaacaaaaggtaacttggagaaagtagaagaaagttttaagagcagaaacaaatgaaataagtgaagtgaggggcagaaatattaaaaaactgatatttaaaaatagtcccaaaagatatataaacctagccagtatagaaaataaaagcgtagattgaattgttgttcagcattaggaaatatggtaaccatttttcattaaatttaaaaagttaaacattctatatttatcaaaaggaatcagtttatttgctagaattcaccagggaagagtagacagaaacttctaacatgatagaagatatgtattacacacacacacacacacacacacacacacacacacacacacgacataatctgtgccaagtactgtttta

SEQ ID NO: 20830 - DNA, 1027 bp, Homo sapiens
aaaaagcaaagacaaatctaaagaaagttaaaaaaaaaaacaaacccatagctaattactatccttagagagttaagagaaagcattgcgtgcattaaacaaggacaggacagaatgccatcagataggaagaattacagcaggaaaacttggaaattatgataggtataaaaaacccagtaaaagtgttaaagatgaagttgaggaaacttccaagcagtagaaaaaacagatagaaaacagaaaaatagatttgagaaccagtccagcagaaccaacatccatctagtaaaacagaaagcagaggaaatgggaagaggattttttaattttcatttttgcaacagaatcttgctctgtcacccaggctggagtgcagtggtgcaatctcggctcaccacagcctccacctcgtgggttccagtgattctcctgcctcagcctcctgggtagctgagattacaggcacacaccaccacgcccagctgatttttgtatttttagtagagttggggtttcaccatgttggccaggctggtctcgaactccggaccttaggtgatgtgcccacttcggcctctcaaagtgctagggattacaggcgtgtgccactgtgcccggccagaagagaaactcaaaaagacaggaacatttccttgaactgatagagcaggagccttcagtttgcaaaggtacaccattgagagagactagcttaaaaaatgtaaaaattgccacactgactgaaattttagaacttctgcgataaagtaaaactcccagaaagttcctgtctgggatagggggcaataggagggaaggcaggtagcatactacctttaaaatttaggaatcagaatagtcctagacttaccattaggaacagtggaaacttagactctaatgaagctgttcattcaaaatacaaagtgaatctgattttcaacctaagattgcatgcttagcccaactttgaatttcggagtaaaaatattttcagatttgcaaggtcatagaaaatttgatt

SEQ ID NO: 20831 - DNA, 1094 bp, Homo sapiens
tcccgagtagctgggattacaggtgcctgccaccacgcccagctaatctttgtatttttagtagagatggggtttcaccatgttagccaggctggtctcgaacccctgacctcgtgatccacccaccttggcctcccaaagttctgggattacaggcatgagctgccgtgcccagccatgtttctgaatttttaagtcaacttctgaataggcaaagaattctttttgtttttttgttcaactttagtgctataaatcgccagttggacacaaaggttttagtgctatttaggtatgttttggtgaaatagtgtgaaggaatattgctgcttaaaagataagccattcattaaatgacgtctttgttttgaaacatgaagacttatgagaagcattttttttgtaagccaaagtagtttcactttatgtgttacagattttgaatagctcattatagactttgtaatttactgtctctcatttaggcaggtaattttagttgccagctaatcatgtttaaatatgtattggttattaataaatgattacccgtatacaggtctttcatgcagatagcgtactactctgatgttcttacctagttttgtggtatgttcagttgtctaagagcattgttgatctgcacacagattttgtttggtctatacagtgtttctgaaaacttgaattagttaccattaataaaaaatagagagactgcacatgaaatctgaatttgtagcttttaaaaaaaaaaattggaagatcaggccaggtgcggtggctcatgcctgtaatcccagcactttgggaggccgaggcggtcagatcacctgaggtcgggagttcgagaccagcctgaccaacatggagaaaccccgtctgtactagaaatacaaaatttaccgggcgtggtggcacatgcctgtaatcccagctactagggaggctgaggcaggaaaatcgcttgaacctgggaggcggaggttgcggtgagccgagatcacgccattgcactccagcctgggcaacaagagcaaaactccgtctcaaaaaaaaaaaaaaaaattggaagatctgtcagcactaaacct

SEQ ID NO: 20832 - DNA, 1024 bp, Homo sapiens
aatagagacagggtttcaccatattgatcaggctagtctcgaactcctgaccttgggtgatccacccgccttggcctcccaaagtgctgggattacaggcataagccactgtgcccggccaattgttaattttttttaggtttgataataatgttggggttatgtttacttttaaagggtccttatagaaatatgtattgaaatatttaggaatgaaattatgtgatgtcttggatttgcctaaaaataacatggggtttgttctaggttgggcacagtggctcgcacctgtaatcccaacagtttgggaggccaaggcaggaggattgtttgagcccaggagtttgagaccagcctgggcaacatagtgaaaccctatatctacaaaaaaatacaaaaattagccgtgcgtgatggcacacgtttgtagtctcagctactcaggtggctaaggtatgaaaatcacttgaaccccagaggttgcagtgagccgaggtcgcatcactgcactccagtctgggcaacagagcaagacctgtctctaaaaaacaaacaaagcaaaacaaaataatatggggtttggggtttgttctatatcttatatttttctttctttctttttttttttttagatggagtcttgttctgtcacccaggctggagtgcagtggcacaatctcagctcattacaatctctgcctactgggttcaagttattctcccacctcagcctcccaagtagctggaattacaggcacgagccaccacatccagctaatttttttgtatttttagtagacatggggtttcaccgtgttggccaggctggtcttgaactcctgacctcaagtgatccacctgcttcggcctcccaaagtgctgggattgattacaggcatgagccaccgtgcctggccattgttctataatatatctttttttttttttttaattgagacggagtctcgctctgttgcccaggctggagtgcagtggcgcaatcgcggctcactgcaagctccgc

SEQ ID NO: 20833 - DNA, 1058 bp, Homo sapiens
ctcctggttcttcctgggtcttcctagcttcattctttctccgtccccagggaccgggacgagaagaagggccccctggagaatggggatggggacaaagagaaagtgagtgctggggcctgcccaggactggaatgtgggctgggagggagtggcctggggtggatcccctaccatgggtgcctgtgccccagcagacaggggtgcgcttcctgcgatgcccagcagccatgaccgtcatgcatcttgccaagtttctccgcaacaagatggatgtgcccagcaagtacaaggtgggtccctgggcctttcaaaaaatgagtgtctgtgtatgggtgtgtcagacagtctgtgcagcccagccattggtcagagctggctaggtgtcacccagggcttgcgcggttaactgagcccatgcgttaacagaagggtggttgaaaccaagattgggggcagtctaggggtgttgaagtcagtgtgcagtggtgcatgggaccaagacggtgtgtatgtgtgcatgttgcacactcggaactgtggcagaggtgagtgcaaaaaacgcagggcctcctcaggctggttggctgtgggaaggctagtctgaaattccaacggagctccaggacatagcttttcaagcttgaatgtatatgtgtcccctggagatcttgttaaaatgcagattctgatttatttagtagattccatatttccttttttttttttttttttgagatggagtcttgctctgtcaccaggctagagtgcagtggagcgatctcggctcactgcaacctccgcctaccggattcaagcgattctcctgcctcagcctcccgagtagctgggattacaggcgcctgccaccacacctggctaatttttgtagttttagtagagacagggtttcaccatgttggccaggctggtcttaaactcctgacctcgtgatccaccccaccttggcctcccaaagtgctgggattacaggcatgagccacggcacccggccagattccatatttctaacaagctcctaggtactgaaggtccat

SEQ ID NO: 20834 - DNA, 1025 bp, Homo sapiens
ggaggagatggaggtggaggagcgggcagaggacgaggagtgtgagaatgatggggtgggtggcaacctactctgctcctatggcacacctccggacagccctggcaacctcctcagctttcctcggttctttggtcctggggaattcgacccctctgttgacgtctatgccatgaaaagccatgaaagtaagtcagagcctgcgcctgctctgcacagccctgccctcatcctaccccctcagctcattgtttagatccttctaggggcatctggacctccacctcattcattgctgcctttgacctctttctgcctccagattcccatccagggtcaccacctgaacctggggctcctcctctgccaggctttcctatacttccctgcttgtcctggctgactgaagagtggttctgctctggttcatgagatgaaccaaactttattcatactgtcctgtcagccccacagagtgactgtgaagatccaataagataagagctatgacagctggaaaggactccactggtccttttctcagccccaacatgataaggatggagctgagccttgtgtctgggggttgtagcagtgcccagctgctgtctgcccttctcctgccccctcttccttcttccctgctctccttgtccctccaggttcccccaagaaggaggtgtatttcatggccatcattgatatcctcacgccatacgatacaaagaagaaagctgcacatgctgccaaaacggtgaaacacggggtgagtcctctccatcttcatccagggcccagctgggtcggtgcatctgtgcttaccctcagaccccagggagggcagtctcaggcctcctgctccaaggaacacactcctgtctccttcttcccaggagagcagactggaagagcagcctgcctgccttgccatgttccctgccttcacccacctgctccctgccaggctgggcccaatttgtttatcccccagttctccagccctcggggccaagcctgccagtgtc

SEQ ID NO: 20835 - DNA, 1080 bp, Homo sapiens
cggtagctctggagaagaactttatgaaaagatgaaaactgtcccctctcttattggttttcctgcattttccagggaagctgctgaccccttaattctctttataagagttcaaatgacttctttcacagatgtcaaaccaccagtgttcaaagtgaccctgcttcattgagtcctgaaacagctcacttcctttgagagctagtgtgacttgctttgtgggacactcagtaactttgggttttgactctttaacgggtgggcactggaccatctcggtgggagtgcttgtgccactctggaaggctgttccctggggttgtgatgtttatcatgccacttccttcttacctgtgccaacagacctatttcactgcctcagcgtacaccagacccttcagaaacctctctggtgtcacccagatagattgtgcttactgagacaaatgaacgtttacttgatttagaagataatgtgacagaatgatgtcaggttaggtcaaagccaagggagtgacagaatctggaaaatcaaacaatacaaaaagccctaaatgaactgttaactatttgatctttggatgtaaaattgtaatgcgtatatgtacaaatgtacaatttttacatgcttttaaaaaaggttagctttgtgaaaataccttgtttggtcaatgactttactgggtaatagaaccacattgaaccttgatggcaagtaatacaataaggcaggccagctcgtttttctctctgaatctggctggtttaggaggagcctgggtttatcgacgagatctggagtatctattcttttccactgcttgcagtctccaatgtaggcagtgtaaaggtatagtaaaatgattttaggagtcagaaccaaattgccaatatgctccatggctcctaaaggaaaataaaatggaagtttttattttgcggcttcacttcttaccgtgtagtaaccttactacaattacagattttcaggagttgtttgctagtctctttcagtcaggtactaaaaaaaaaacaaaaaacaggctgggcgcggtggctcacacctgtaatctcagcact

SEQ ID NO: 20836 - DNA, 1049 bp, Homo sapiens
ttagtagagaccgagtttctccatgttggtcaggctggtctccacctcccgacctcaggtgatccgcccccctcggcctcccgaagtactgagattacacgtgtgagccactgcgcccggccagatatatatatatatatattgtttcctttgtcactgtttatattctgcaagttctttctaggtaaaagttttaatagaatggattcaagatatcagatctgatttatagtagcttgcaacttgaacagtaatacatgtactttcataataaaaatagtagtaaatataaaaaaatagtaaattcactacaagacctagtggagcatgcctattatcccggctactctggaggctgagatgagcaattctgaagtctagctacaggcacgcaaaaattggccgggtgtggtggtgtgtacctttagtctcagctactctggaggctgaagtgggaggatcacttgaggccaggaggtcaaggctacagtgagcaatgatcacactactgcactccagcctgggcaagactgtctctatgaaaaaaacaaaacaggccagttacagtggctcacgcctgtaatcccagcactttgggaggccgaggcaggcagatcatgaggtcaggagatcaagaccatcctggctaacggtgaaaccccgtctctactaaaaatacaaaaaaaattagccaggcatggtgacgggcacctgtagtcccagctattcaggagactgaggcaggagaatggcgtgaaaccgggaggcggagctttcagtgaaccaagatcgtgccactgcactccatcctgggcgacagagtgagactccgtctcaaaaaaaattaaaaaaacctccatctcggctgggtgcggaggctcacggctgtaatcccaacactttgagaggccaaggcaggtggattacctgaggtcaggagttccagatcaacctggccaatgtggcgaaacacgcgtctctactaaaaatacaaaaattagctgggtgtggtgatgggcgcctgtaatcccagctactcaggaggctga

SEQ ID NO: 20837 - DNA, 2245 bp, Homo sapiens
tggcaggagggtggattgttggtctcagtcagtggtgggacagaccagagctccgaacacttcagttttaaaactagttgtgagtttccaattctgttaatgtcttttttggtccttgtttctgctaaatgaatacatcccctccccttggaacttaatatcaataaataacaagcacagaaatatgcaaaaggaccaggtctacttgaagaatttgtgaggattaaatggtttatgagtagaggagggtcagtcagtaagtattggctacctcatgtgtgtcccattactaacttggttagacttatctattttttgtgtagtcttcctgtcataaaaattctgtgtaaggaccccatgctagtatcagtgaagattgtgaatccaggtgtgtctgactctacaatagttcttcacaagcattatatttcactgtgtagtgatacttcattttgaaagttgggaaaagcgtctttttcactttagtacagatgggtataaaagttacttaggacactagaaaacagttcattaaaagtaaaacaaagcctggtgcttgggcccaggaattcaaactgttttccagtgtaaatctgaatagcttggtctctgctcattgccaggactgggaggagttgggggtcccaggtcccatttctacatcccaattcagtgatactgggatcttaataacctacctgtaaggtgaagttggaaaaggcataggcaaggatagttgtcctgagagttttacacttgtgagaaaatactggcagctttgattttaagatgtgaatagatgatcgtggttcatgcctttactccctatactcccagcactttgggaggccaggcttgccaacatggcaaaaccctgtctctatgaaaaaaaaaaaaaaatctgggcatggtagtgtgcacctgtagtccaagatactagagaggctgaggtgggaggatcaccttgaagattgatatttacactgtcactgtctcaaacgctgagtgtacattctgtctagttggaaactgcttttgtggtggcactgcgacttgacaggttaatgactgctgtccttttttcttctctcagtacatccagcagtggtcattcgacaacgaaagtcataccgtagaaaagatggcgtgtttctttattttgaagataatgcaggagtcatagtgaacaataaaggcgagatgaaaggtaggaaatcagtccagcttgttccttaggtctctgaggttgggtggattgtctagaagtacaggccaaggatcttctgtgtttgacgatgtcttaatctgtcccccacatgtttttattttattttattttatttttttaatgcaggttctgccattacaggaccagtagcaaaggagtgtgcagacttgtggccccggattgcatccaatgctggcagcattgcatgattctccagtatatttgtaaaaaataaaaaaaaaaactaaacccattaaaaagtatttgtttgcagtgcttgtctccctgttcacttccagggttcaagcgattctcctgcctcagcctcctaagtagctgggattacaggcacctgccgtcatgcctggctagtttttgtatttttggtggagacagggtttcaccatgtttgccaaacgactcaaactcctgatctcaagtgatctgcccacccaggcctctacagtgtttttgacataccctgaccatcacttttctgaaatggaaactctgggcattttttttttaaagcaatccttgcttttttgtgagtttgcagactttcagcatcttccaattgctgtatttacaattttggcctcaaaaagtattatttgggttttgagtcccaaaaataatagtagatactgctcaatgactggctatacatggtagcttctcctggagtgaggaaggcattcaaatggctgggcgcggtagctggcacctgtaatcccaacactttcggaggccaaggcaggcagatcatgaggtcaggagttcaagaccaggctgaccaacgtggtgaaacctcctcttttctaaaaatacaaaaattagctgggcgtggtggcgcaccgcctgtaatctcagctactgagagaatcgcttgaacctgggaggtggagtttgcagcgagtcgagattgcaccattgtactccatccagcctgggcaacggagcaagattccgttcccgcccccgccccaaaaaaaggcattgaagttaagatagact

SEQ ID NO: 20838 - DNA, 1059 bp, Homo sapiens
cggagagagagagccaggccaccgcgagagcactgccagggccctcgaaagtggcagtggggtgctggagagttgagatggcaggatcccgacgtgaatgtagtctggataccgcgagatcgctccgcgaatagggctatcgtaatggggttgaagttagactggattaggccctggtttgcgcgacctctgcggttttatgccttgcaggagtaattgcgttttgcgaaagttagagcaagggttgagtcgtctaggtttcttaatttcgatgtcagagtgttaatagtaagaaataggctactttccgtgagaatcgggtggcacatggggacggcataagtaaaatccgagcgagctaatctatagcgtacagtctatcaaagcatgtgcggtgaattacagcttgagtatgagggggaactccgaaccatgtctagattgtgatctctttatcctgtttcccttccctttatatccacaggacgtggtgggtcctctggtgcgaaattccggatttccttgggtcttccggtaggagctgtaatcaattgtgctgacaacacaggtgaggtctttgcacgttgctatactcccccttttaaaagcactcaatgggcctgtggctaatgacctattgagccgtcaagaaaggggagagtgaaaacatcgcttttgggtgaagtggcaacatgtgttgtttgcttcaatcggtggtgtgacaaggcgttcttgcggactaactgcttgggcagtgagtggagggaggggctttggaagtgtttgggaaatgttatactgatggaacggcctgatggccctcaacattttttatttttatttacattcttttgtaggagccaaaaacctgtatatcatctccgtgaaggggatcaagggacggctgaacagacttcccgctgctggtgtgggtgacatggtgatggccacagtcaagaaaggcaaaccagagctcagaaaaaagggtgagtaaacactgagcccaccttaatactgatgagtagtggggggacgctttcctttattggaaaatggatc

SEQ ID NO: 20839 - DNA, 1024 bp, Homo sapiens
ttctaacacccattcccacatctgtcccccatttcccccacccttcctggttctccctggccatccctccccacccccaccctgatccctacatctgggctctgggaccagggtgggggaaggctgcatgggggagcctggagtctgggggagaggatctaatgtcatctccactctggggtttcccctccctgcttccccccccagacagagcatgtgcccccctatgacgtggtgccttccatgaggcccatcatcctggtgggaccgtcgctcaagggctacgaggtaggacttcctagaggggagtggatgcagaggggccttagaaagatcttcagaccccagagagatcccctagaagggcccgatcccaaggcatcctcccaggagggctacagactttcagagacaacccccagggggcccaatccacagaaagacccactcagaggagccccgtcccccaaagaaaccctcagaagagccctcccagagatgccacttacagggaccttggaaccagagaccccagtggaggcccctcagactcagacccccgcccgccgtaaaggcctgtccagaagaaagtggaacgtgagggtacaaatacccagcgactcagagtctgagcggctttaaatgcctgccttctcctccctccctccccacaaacccccacccccaggttacagacatgatgcagaaagctttatttgacttcttgaagcatcggtttgatggcaggtaagatcctgggagctgctcctcgcacctgccgttgctctctgctgctggggatgggcaggatgcctcgaatcacaatcctgggactcggactgaggaacagaaggcgggcctggaactggggagtgggcagggcattccagcccaccctgacccctgactcccctcttgccccattccccaggatctccatcactcgtgtgacggcagatatttccctggctaagcgctcagttctcaacaaccccagcaaacacatcatcattgagcgctccaa

SEQ ID NO: 20840 - DNA, 1027 bp, Homo sapiens
taccttagcctgaaccttctcaggccttgaagtcattattctactctttttttttcttttccttttttatggcactagagaatgaaaacctaaggtcttagaaaatcttaacttgaaaaagtctctaactggcatgatttgattacttttttcccctgtggacaaataattttctttcctatataatagatttttagtaagtgaaacctttgctgctgctttcctgggtttacattagttttttcctgcccttaagaataatttatctgtgcttctctgatgactgttaatttctaatagtgcaggaagggatgagcttttgatttcttctcactcccctcctcaccctacttccaaattacacactaacttctaacccttacagcctgttggcacatacacaagatccacgagaccatgctcctcagaagctacccatgtcctttctcaccatggtgtggctcttggagccctgagtatctgtgactacccactccaaaggttgactgtaagaggagagcggccttcttaattttgcatttcttaattttgtttttctccattcctgttttatgacttggccttcagatgcttcctactctggcctcctccttttttctcctaggaattgtttccaggtaacctaccatgtgcacttctcagctgctctgctcacctttgcccaccttcccgtgaccctgagagtacagatccgaataatgtggcctgtgcagagctcagagaactgtgaggactacccatgcctgtcagactctgctcagggacagagatggatgggtaaatggtgctgttggagacatttttatcttcataccaggctctgtttcatccctgcaccccgcacccccactcactcccctgagggggtaaaatgcagaggtggttgacctgaagggtctgattccctccttcccaagccttagggcctaccctggagtgctgcagtgtgtgagagctgctgcttgcttgtttctccactaggcctgctccaaatgcttagccaatc

SEQ ID NO: 20841 - DNA, 1052 bp, Homo sapiens
tttccatgccaacatgctgagcatgctcacaaagaaggctcgtccattcctcctgtgttttagtatttggcccagaggtttcctaaatggttgccttgaaatcactgtggtccaaatgtaattcttacacactcaaattatcactgtctgtagcacacttgtgcacctgtcttacattctctgttgctcccccccacactcttgctcagtctgtcacctgttcagtctgcttactcactcaattgttacccttttgctgttgtcgtgtttacagtttgcattttgaatgattagttgggattaccaaacattttttaaaaagatattatcaataaatatttttttaattctaaattttaccattaggggaccctgcctgaatctttgccaacctgcaaggaaactctaatgaaagcaagaaaagttatgagaagaaactgttttgatgaaaacagatgctaccttttggtttctattttatcttctgatatgtgataattcgcatggtatccccaatattccccctacatattcttccttctgtcagactccaccaactgtatcataaggaaagagagagatgtattattaggaaagagtgaaaatgataaatcacaaaacagagcctgaaagtccccaacacccaagttcagacattaatgattaatgttattatatatttactgaaatctaggagtgatcagtggcatctctgacctatgaggttgttttaacaggaatgccactagaggagctgtgtattctagccagtctgtttctctcttttcccccatttcagcctttcagggatacaagaatggctctataacagctggtcaattgtatgtcagtgttaatggattcatatctagtgttggcaccccaaagggccagaaccttcccataacctgtcagtcatctctcttttctgccccagtctttttttttttttttttttttttttaagacgggttctcactcttgcccagactggagtgcagtggtgcgatctcggctcaccgcaacctccacttcccaggctcaagcgattc

SEQ ID NO: 20842 - DNA, 1016 bp, Homo sapiens
gggctgtttagttaatgaagagacaaacagatttagtcatttaggagagtttctctatgtgggatgacaaccgatgttctttatgagggacattagatgtatagaaataattaaattacctttccttaaactttaatgtggatacaaacatttgttgagtgcctacagtgttccaggcattatgctgaagatagaaataaacaatcactgtcctcaaggagctcacagggcagtagagagaacaggcatggaaataatcaatatagagctagaaaagaggttttgcctagggcattatagcaatctcacatgtagggctttaaacctagcatggagagttcagaaaatgcttccccagaaatgagacaaatgagctgtgacttaaagagtagtagcctgtatctacaaaaaaatacaaaaattaggctgagcatgatacctcccacctgtaatcccagcactctgggaggccgaggcgggcagaaaatctgagtccaggagttcgagaccagcctgactaacatggtaaaaccccatctctactaaaaatacaaaaattagccgggcatgatggcacacacctgtaatcccagctacttgggaggctgaggcagaagaatcgcttgaaccccggaggtggaggctgtaaaaaaatcatgccactgtactctagcctgggcgcagagcgagactctgtcttaacaaaacaaaacgaaaataaaaattagccaggtgtggtggcacatgcgtgtagtcccatgagagagattgttgtgttgagtcctttttgtgggcagaggaaaaggactttgattcaggtatgctacaagatttgaggcccaagctctttgcatagtacctagtattgtaatttaggattttatttttaaaggcttgcctggcaaattaaccatcatttatctctcttggagaatttacaaactttgtacatgtactccttttgtaaattggatgctgcctctctgtaggatgttattttctccctggtttgtttc

SEQ ID NO: 20843 - DNA, 1071 bp, Homo sapiens
gtggcggctgggcagaggggctcctcacttcccagacggggtggctgccgggcggaggggctcctcacttctcagacggggcagccggtcagagacgctcctcacctcccagacggggtggcggcggggcagagacactcctcagttcccagacggggtcgcggccgggcagaggcactcttcacatctcagacggggcggcggggcagaggcgctccccacatcccagatgatgggcggccgggcagagacgctcctcacttcctagacgggatgacggccgggaagaggcgctccacacttcccagactgggcagccgggcagagggtctcctcacatcccagacgatgggtggccaggcagagacgctcctcacttcctagatggggtggcggccgggcagaggctgcaatctcggcactttgggaagccaaggcaggcggctgggaggtggaggttgtagcgagccgagatcacgccactgcgctccagcctgggcaacattgagcactgaatgagcgacactctgtctgcagtcccggcacctcgggaggccgaggctggcagatcactcgcggtcaggagctggagaccagcccggccaacacggggaaaccccgtctccaccaaaaaatacgaaaaccagtcaggcgtggcggcgcgcgcctgcaatcccaggcactcggcaggctgaggcaggagaatcaggcagggaggttgcagtgagtcgagatggcggcagtacagtccagcctcggctgggcatcagagggagaccgtgcaaagagggagacggagagggaggagggagagggagagggagagctgaatttttttccttctaaaatagtagagagccaggtgtgactcaggcctataatctgagctacttgggaggctgaggcaggcggattgcttcaggccaggagttagagaccagcctgggtaacatggctaggcactatctcttaaaaaagaaaaaggaaaaaggcagcaattcatactgtgttggggtcccctagatccatccacaggtatggtgatgtgcaggaggatccacaggactcatc

SEQ ID NO: 20844 - DNA, 1065 bp, Homo sapiens
ttgtagaagtcatgtgaacaacatataatgtgtttttttgttattttccattattatgtatattgaagtgaacatagtgccttattaggtgagatgtggcatttaatactttgttttctaaaattaaaatgattaagttttactttttgtggatttgggttggacatagttctagtagattgagtgtttgatagaatattttaaataattttttgggcatgaaacaaagttttgactgcatcttttttttttttttttgagacggagtctcgctctttagcccaggctggagtgcagtggcgcgatctctgctcactgcaagctccgcctcccgggttcatgccattctcctgcctcagcctcctgagtagctgggactacaagcgctagccaccatgcccggctaattttttgtatttttagtagagatggggtttcaccgtgttagctaggatggtctcgatctcctgacctcgtgatctgcctgcctcagcctcccaaagtgctgggattacaggcgtgagccactacgcctggccttgactgcatcttgactgtgacttatcacaagaggtcaggtgtggaattttcttattttttttttccagaggtggggtctcactgttttaccaggctggagtacagtggtgtaaacactgcttgctgcatccttgacctcttgggctcaagctatcctcctgcctcaaccttccaaggtgccgggattataggcatgagtcaccttgctcagcccaaaatctgaaagattttgagtgctgacatgacaccactatggaaaattctgaccaggcatggtgacttaatacctgtaatcccagccttttttttttttttttttttttttttttgagatggaatcttgctctgttgcccaggctggagtatggtggctcgatttttatttatttgcttatttattttgagacggagtcccgctctgttccccaggctggagtgcagtggcatgatctcagctcactgcaacctctgtctcccgggttcaagtgattctcctgcttcagcctcccaagtagctgggattac

SEQ ID NO: 20845 - DNA, 1087 bp, Homo sapiens
ttgggaggctgaggcaggagaatcacttgaatctgggagttggaggttgcagtgagccgagattgcgccactgcactccagcctaggcaacagagtgagactctatctccaaaaaaaaaaaaaagaaaagaaaaagataaaccaggaggtccaatgtttgactaataggaattctacaatgagaggacagagaaaccagaaaaacttccaaaatatttaccagattgaaaaatataaacttctagattgaaaggactgataggctgggcgcggtggcttatgcctacaatcccagcacttttggaggctgaggcaggcagatcttgaggtcaggagatcgagaccatcctggctaacacgccgaaaccccgtctctactaaaaaatacaaaaaattagctgggcgtggtggtgggtgcctgtagtcccagctacttgggaggctgaggcagcagaatagcgtgaacccaggggcagagcttgcagtgagtcgagattgtgccactgcactccagcctggctgacagagcgaggctccatctcaggaaaaaaaaaaaaaaaaggactgatagaataataacctcagaccaagaggcttgatgatgaaattttggtaaactgaggataaagagaatatactaaaagcttccaaaagtaactagaggttacattcaaaggaccccaaattagaatggcattatatatcacagcagaaacttacgaggtcagaaatgcatcaagcagtgtcttcagatatcttcagtggaaaggattttcatcttataattttattgcaagccaaattatcaatcagatgtgagtctaaggtaaatacatattttagacatgcaagagacttaaaaacctgagttcccatgagctgttttttcataaattactgtgagatgttcccttaaaaagcaagtgagacaatatggggtactggaaacaatgcaataaaagagaagagctactggagagcccaagatgacagttgtgtagccagtctagggaatttcttagagtgtaggaaaagaaagtgttctgggaatgtttagcaccagagaaaaacagtatctgatgcattt

SEQ ID NO: 20846 - DNA, 1030 bp, Homo sapiens
aaccactaaagtcactgatgatgatacactaattctgtgagtattgtctttgtcctatattattgaaaagtagcagctgggtgcggtggctcacgcctgtaatctcagcactttgggaggccgaggcaggtggatcacgaggtcaagagattgagaccatcctggccaacatggtgaaaccttgtctctactaaaaatacgaaaattagctgggtgtggtggcacgcgcctgtagtcccggctgctcgggaggctgaggcaggagaattgcttgaacccaggaggcggaggttgcagtgagccgagatcacgctactacacccagcctggcaagagagagagactccatctcagggaaaaaaaagaaaagaaaagaaaagtagcttgagctgtccgcttaaattctgtccatttcattggaattgctttggcacagttgtctcctcagtgtaaatggaattattttcagttttaggtttagaagatgtataattagtttttaggaatcctagacaatacatacaaaaaacagaaacagtgatgacccaacatattatagcaaggaaaaataaaatcttagttataaaattagttataatctagcaattttttttttttgagatggagtctcgctctattgccttggctggagtgcactggtgcattcttggctcactgcaacctccgcctcccaggttcaagcagttctcatgcctcagcctcccaggtagctgggattacattacaggtacccgccatcaggcctgattaattttttttttttgtatttttagtagagacggggtttcactatgttggccaggctggtttcaaactcccaacctcaagcgatccaaccaccttggcctcccaaagtgctaggattacaggcgtgagccattccgactggtcttttttttttctttttttctttgagacgtagttttgctttgtcgcccaggctagtgtgcagtgccgtgatcttggctcactgcaacttccacctcccaggttcaagcgattctcctgc

SEQ ID NO: 20847 - DNA, 1071 bp, Homo sapiens
aaagctatgacatgattaaacacagacattaaagatgcatttatttatttatttgtttatttagagacagagtctcactctgtcacctaggctggagttcagtggtgcgatcttggctcactgcaagttccgcctcctgggttcacgccatcctcctgcctcagcctcctgagtagttgggactacaggcacctgccaccacacctggctaattttttgtatttttagtagagacagggtttcaccgtgttagccaggatggtctcgatctcctaaccttgtgatgtgcttgcatcagcctcacagagtgctgggattacaggcatgagccactgcacttggcctgcatttattttttaaaacgagcactgcattgccaataccctttcccactgcacttggcctgcatttattttttaaaacgagcactgcattgccaataccctttcccgacattcgtccttatcagctttttgaaaatcgtttgcatgtgtttcatgtaaagaaaagaaggtcatattaaacaaaatcatatcacaacttatttctgccacccacttgtagaaaagcaacctgatgtatcttggcgttctcctaggactggttaaaacttttctttaatactataactttccttgtacattatcatgaatagtaactgcagggagataagaaacttcattattattcagtattcttagtcacagttgactggggttatataaaagaagcttcccaaatgtagatctaatttttttttttttttttttttttttgagatggagttttgctcttgttgcccaggctggagtgcaatggcgtgatctcagcttactacaacctccgcctcccgggttcaagcgattctcctgcctcagcctccctagtagctgggattataggcgcctgccaccatgcccaggtaattttctgtatttttagtagagatgggggtttcattatgttggtcaggctggtctcgaactcctgacctcaggtactccacccacctcagcctcccaaagtgctgggattacaggcgtgagccactgcacccggcagatctaattt

SEQ ID NO: 20848 - DNA, 1048 bp, Homo sapiens
ggtggcatactataataaagtaataaggaaatttgttgctgtattaagaggtttctttttaacttgtagctgatgtagctggcaacgaaatctttctaaatatgatctgagaaggtaaaaaaaagaataaggtggggagtccttcttggacggtttcatgattaaataagtgtttgtttataaactaaaagctattcacttaatatgatgtgaagtgttccatgccggaatacagatgagaatggctagaaatgatatgtgttaatgaagttcattgagtacttcttaaaaccatttacctctttattgacctaatttacaaggactgagacaattagtaattggcttcttaggaagtagtaaataaatttattgcttatttgttgaaaatattttaaatatttactttcaataaaagatacgtaaataaagcagatctaaacatttacatcaaatgatattttaaatcctcaagattacagtctgcttcttaaagaactgataattttacaactgtaagcagatagcagatctcattgagaatttttgtggatgcatgaaatctttatatcacataatagctaatttcaaattgtggctacgtaaggtttatttttcttggagaagataactgaagctctatgattttcagatagttgattcattgaaatccttttgtaggtatgcttttatatgttgtaactggaggccacacaccttaaatctcccactctgggttagagctatagaaaaaaaatttttttaatttaaaaccaaggggccgggcgaggtggctcatgcctgtaatcccagcactttgggaggccgaggtgggtggatcacgaggtcaggagttcaagaccagcctgaccaacctggtgaaacccggtctctactaaaaatacaaaaattagccgggcgtggtagtgggcacctgtaattccagctactcaggaggctgaggcaggagaatcacttgaacccaggaggcggaggttgtattgagccgagattgtgccattttactccagcctgggcgacagagcga

SEQ ID NO: 20849 - DNA, 1049 bp, Homo sapiens
ctacgggcactcaccagcatgccaggctaattattattattattatttttgagacggagtctccctctgttgccagggctggagtgcagtggcatgatctcagctcactgtaacctccgcttcctgggttcaagcgattcttctgcctcagcctcctgcatagctgggactacaggcgcgtgccaccatgcccagctagttttttgtatttttagtcaagatggggtttcaccatgttagtcaggatggtctcaatatcctgaccttgtgatccgcctgccttggcctcccaaagttgtgggattacaggcatgagccaccgcacctggccaattttttgtatttttagtagagatggggtttcaccatgttggccaggctggtcttgaacttctctcctcaggtgattcaccatctttacctcccaaagtgctaggattacaggcattagccatcgcgcccggcctattattattatttttagaggtggagtctgactgtgttgaccatgctagtctcaaactcctggactcaagtgatcctcttgccggagcctcccagagagccaggattacaggtgtgagtcaccacacctgccatatttcataagctgttttggagcatgactcttcatatatgttaaagtactttcttgaatatcggtttatataataaatgttaatgtttttctgtgtttgtaatttacctgataaagatacagttatgagttttattttttataggtcatttaatgaacctgaagtactatgtctctccttctgacctactggatgacaagactgcatctcccatcattttgcatgagaataatggtaagactttaattgtaaaggaattaaaggttttgttcggtgcccagcttgcctttaatttctggtttgctattctctaatgagtttgttgaccttaccatttgcaccttatacacacaacacctcacacacgtatatgtgtgttcacaagtacatacatatgtatatacacacatgcatatatacacacatacataataggagcttaataagtac

SEQ ID NO: 20850 - DNA, 1032 bp, Homo sapiens
cttgcggaaagggaagttgaggggcaggtgaacgggcgtggtgagagtcagtctactggacctgatgaaggaaactgacattgatgggcacctactatggaccaggcagcaaaaccagcagccattcagaggagttccttggtgccaggcattccgcagacctcgtcctcatggcctcctgtgcagtgagcatcattatgaacctgttttgtaggtgaggcagtggaggctcacacatactgggttatgtgtccaaggtcacacagctgcgtaggggctgaggcaggacttgaatgcagactctgtctcattgtgaagactggacactcttcccccagcctggagctgtggaggtgggcctaggcagctaggagaccaccccttatctgcctaaacatccttggcctgcagggagagtgggaggcagacatcctcttaggcctcagttctatgggaagctgacggggttctgtgctggtcaggcaagtggagagaacactcatgtttcagcctgtcctgggctctgtgctgtacgctgtatttgtattgctcattaaacccttatcaactatgattattcccattttgcagatgagaaaactgaggcacagcaaggctaaataacttgcccaaggacacacaggaaatgcagagccaggaactgaaccctggcagtctggctgtagggcttgcattcttaatgataccactacctcccaaatctgaggaaagggtgagaagaggagcacccccagagtgggatgctccccaggggggaggggcttttcaggggtgcagaggccaggcttcaggtgggtctctgtgagtggaaggcacccagggaggcggttggagaggggacccagcagccccacccatcctgtggccctacgcatatgtttgcccgcacacacaccccctgctttcggtgttctgagccacttagctcagtcctgcagtcctcttctcacctcccccttcctgctgtgggtgacaaggaggcctggctggctgccagtccctgccgccttc

SEQ ID NO: 20851 - DNA, 1075 bp, Homo sapiens
agaggtatgggtataaaggactccatttactattataaagaaggaatggaatatcaacattcagagatagctttctggcagctgccaggcacctctggtgcctgacagctggcaaactcaatacaggattctttctgagatttgacattttgctttcctttagtgcttatacttcctactgggaaaacagaccatggagtagaaatatgatctctgaaattaagaggaaaattttgttagctaatattcttaattcaatggtaattatttaatagtacagtattagaaataaaggcaagtttataaccattagaattaaaaacatgattgtacatttttgttgctaatgtaaatatttgattttcttcatagctaatttatacttgaactaataggtaaagcattcatatgtgaacttccatgaaatctcaattaactagactcctgccatttccaagtttaaattttatttataatctgccccctttcgttttacagcacatgaaatgttagaaactctgaaaaaaaaaaaaaaaaaaaccttggtatcttaaaaaaactaaccggtgagaaaatttatatagtgtcatcgtcaatgaaaagagaatctaaaaagccaaaaacgaatttgaaattatcatctcttagtaagcatgtgatgaagtcttgttttctatactggtagaaaacaatttgagattgctagaatggctatgagtagctatgaatgggagagtgctgtggaacactgcaaaagaaataagctttaacttttacagtctaatatatatgtcagtatctcagtagtagactagttgtgtcctttagaagatgtgttatttaagagataaggtgttaatggaaaacacttatgttttaattaaaccttaaaacatatcaggagattggttatttagttgtggaaagagcaaaaagacaaatgaaataggtattaactagagttttctgctagattacaactctggcttttaaatgaaataagaaaatggttttatctaatgatacccaaaaatcctgatgaaaacatgatgctaagtatatatttgtatacata

SEQ ID NO: 20852 - DNA, 1048 bp, Homo sapiens
aacctcttctgtaactccttagctgttgggattctgcctttcccctcccaggaagtgagggaggaaggggtcctcccaacagtcttttatatctctccccacccttcccctcccaggtacttcctcaccagcttctacactaagtacgaccagatccattttgtgctcaacaccgtgtccctgatgagcgtgcttatccccaagctgccccagctccacggagtccggatttttggaatcaataagtactgagagtgcagccccttcccctgcccagggtggcaggggaggggtagggtaaaaggcatgtgctgcaacactgaagacagaaagaagaagcctctggacactgccagagatgggggttgagcctctggcctaatttcccccctcgcttcccccagtagccaacttggagtagcttgtagtggggttggggtaggccccctgggctctgaccttttctgaattttttgatcttttccttttgctttttgaatagagactccatggagttggtcatggaatgggctgggctcctgggctgaacatggaccacgcagttgcgacaggaggccaggggaaaaacccctgctcacttgtttgccctcaggcagccaaagcactttaacccctgcatagggagcagagggcggtacggcttctggattgtttcactgtgattcctaggttttttcgatgccacgcagtgtgtgcttttgtgtatggaagcaagtgtgggatgggtctttgcctttctgggtagggagctgtctaatccaagtcccaggcttttggcagcttctctgcaacccaccgtgggtcctggttgggagtggggagggtcaggttggggaaagatggggtagagtgtagatggcttggttccagaggtgagggggccagggctgctgccatcctggcctggtggaggttggggagctgtaggagagctagtgagtcgagacttagaagaatggggccacatagcagcagaggactggtgtaagggagggaggggtagggacagaagctagacccaatctcc

SEQ ID NO: 20853 - DNA, 1173 bp, Homo sapiens
ggcttcatcttgtctggctgtgtctggcctgttaagcccacccagaccccatgccctctcctttccgggttcccatggtccctgtgcctctgtcttccctgccaggctttggctgctcgagtgcagattccatgtctgccttgttccctgctgtgtccccagcacttagcccagcgtctgcacagagtaggtgctcagataaatatgtgctaacggaatgaatgtcagacgaacttgagaactttcctcctcctccctggacctcctccccagacctcctccccgacctccctctggcctctcccacccttcagccacctccccagcccctggccaggcaccagctggactcaagaaggaggaaggacgtgactggaggcaaacactttattatcctgaagttcagttacaatgtgacagtggaggggacactggtgagtggggggtgaagaggtggagggtgacagtggagcttcctttcacacacaggcctgacatgattcctcctgtctgctccctcccacatccccagtccccgtccagcaaggcaaatgtccaggcacctgcctggccctaaaaagagtcacagtcctgaccctcgtgggggcagggcaggtgtcccgaggccacccagaaaaacaggagacgcgtcggtgatgttcgggagtcaaaccatgtcccaaaagtcttaagaagaaaaacgagattccccagcaaattcgtgggaccccagggccatgcctcccagctctggccacctctgcttgtccaggggcctcacagccaaggggatgcaggggccgctgtgcagtcggctgaggccagagtgaggggtgcaaggacccagatggggaacactgctgtttaaatattaaacagggatttcttgtctcccacgtgggagacctgatactctcaagggtcccaggtggggaccctcaggaccaggggctcacagcggctcatcccagtgcccattgcagagccagggctggggagcagtcatagtaataaatacttggtatttacctatctacctcccagtccaggggatgggaggacaggagctttttctcactgctacaggcaggagaatgaaactcagaaatgcagggaaggacacagaggcctggggctccgttctgctcttccctgtctttaaatatgaggctt

SEQ ID NO: 20854 - DNA, 1090 bp, Homo sapiens
tcaatgcctgggagaatggggtcctggccttcgagtccatccaggtagccccgccttcccagcagcgtttgctcccctgagacacagagccagccagtgatgacttgttatatttcgtaagggcaagaagacctttaatccaggagctcatgttttgatattgatattttgtgtaatcgttgtcttagctactccctctggcccaggtagctctgggaagatcaaacttgtggagagaggtgtggaatgtggcccgggactccacccgctgcacttagctgcccgcagaggctgagaaggtgatgttggctcaagaaagggagatagatggtagcccatcacctttccgtctcccctagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagaggtcggtaacctgccttcccttctcagacccttcaagtgtgttgtgagaagtcagcacatccaataacaagcacccctctcttttctgaccttcgcaaacacgctacttgatcactcactcactttcctattcatgcattcactcatctgactcagcaaacatgtactgtgtctctgtggcagaagcgtttatatgccagcacctgctgtgttgtcagaaatgcagaccctaaacagggtctgcccgcagagactcaagttctagacaactagctcccaaaagaacaaagctgtgtgactgtctaggagctaggaacctgtctgtagattttacaggccatgccccaccctcagttacctcttaggacagtttcctgccctggctcttcaggggcttggaggacttccctggtgaccagttacgttgagttcattcacccaaccaataagttgtttgctttttttaattgtaaaaaacacataagatttgccatcttagccatgtttaagtgtactgttcagtagtgttaagtatattcacactgttgtgtaacag

SEQ ID NO: 20855 - DNA, 1781 bp, Homo sapiens
gctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctgtatgtcccttgattcccctgagccccacctgccgctgctcccatagccggtcctttaattgagaagggagaggcaggatgccatcccacctctttccaggaggatctgaaaccatcccacttccttttttttctccccataagcattgcacacatcccagggacttgggcagggtggcacccgagccaatcaaccaacaggtatttactgagcattgttgtatacccagcactgtgctaggtgctgggggtggggggtggggggctaccaaaggagcatgtggcagggtccctgccctcatcaagcatagctgctagtgggtagcaagactagtacatcacagacgaggaaaaaactagaggacaagacaagcacagtgtccattattgtgtttgtctccatgttactcatcgcttggaagcagatgactcttgtatttgaatgttacctaaaatgccccttttaacacagtgcctgtctgctgttgggcctgttgtaccatatgcctcttgactcaagttcagatgttaagtttgggtactttccagagcctgagaacagacagatcacctggcgggagggaagatgccagtatttccagcaatggggtcctaaggccatagtcttgctccttgaagcccaagtggcttgggaccacctacaggtctcttgttctccaggaacaagaatgctagaatgggctactctcgaggcttcaggacctggttggagagcttgttttaggactagtatatttatttcttccccaagtatgttttactgcctgtgaaaagtccaaaaagacaatctttatataaaaatggactgtgttgacagcctcttccctaccttgggcccttgataaatgtttattggctgaaaatcggatgaatactgaattttaatggatctcaggtcttgtctttttttcccccttttatgctccatggaggttaatgggctagttggtgccattattcatcatttgaccctctggaattgtaactaggataagtaacttatagttcagtgctaaccaatatggcttagaccatgagtgtgggcattaaggagagaacagtgagttagaccagtcgggtgagttgctaaaggaactggggcttgaacagaagcttagagcatggtgggagtttgagagagagtgtgtaagaggccttcagcaggggagggcagcaaacgcaatgcctagatgagggagtggttgagaatgagaaagccatttagggacccagttcccccagaggagagtgacagcctctgcaagactggactttgggatccgctcactcctcgagtgatttgtggccgccctccctgttccagccactggattctggcctccctctgcctctctctcctgagcctgtgtgatgccataccttctgaagtcagctggctgtgtcccctggaaatcaggcttttgggaatggtctctggggtttccagctctaggtgcccaccccccttctggaaacagtgcatgctgccctcaggcccctccctccctgttgtcctcaggggaagccttcctgtgtggtttcgtgtgccggagggagtgccaaaatcgaggagttcagggccaggtgctccttctctc

SEQ ID NO: 20856 - DNA, 1048 bp, Homo sapiens
aggctggagtgcaatggtgaaattcagctcactgcaacctccgcctccggggttcaagcgattctcctgcctcagcctcccgagtagctgggattacagtcacgcgccaccacgcccagctaattttgtatttttagtagagacaggatttctccttggtcaggctggtctggaactcccgacttcaggtgatccgcccgcctcggcctcccaaagtggtgggattacaggtgtgagccaccgtgcccagccctgaaatagtcttaattgcttgtttttcttttttgtctgaggtgtgctttttaaaatctctatggagatggagaagactgacattctctggcctgatgtgaaaacctctcattaaaactgtgtctgtgctttgtgggctgaaagcatgaaacactggaaattttaaacaaacgtatgtgaatgtgttaagaagccaagagtccggccctctttcaccagactgtatggcctcagatcagcaagggaagtattgagcttagggacaccaagtaatggagtgagcagggatgagagggcacatagaatgtggtgatctctttccatgtcaaggcttgtgtgtttgtggcactggggtcttgctgtgtccccaaggctagagtacagtggcacaattatggttcactgcagcctcaacctccagggctcaagtgatcctcccacctcagtctcctaagtagctgggacaacaggcttgggctgccacacctggctaactttttatttttttgtagagacgggcctttgtaataccagcctttgttgcccaggctggtattgaactcgctcaagcgatcctcccacctgggcgtcccaaagtgctgggattataggagtgagccactgtgcccagccttcagcgtcaagactttctgcaccatctctacgctgacagctccgtaatttatatttctttctggactcatcccctaactccagaatcatatatccaactgtctagtatacatacccagttggatgtctaataggtatttcttttttttgaggtggagtcttg

SEQ ID NO: 20857 - DNA, 1053 bp, Homo sapiens
gatcatatatgatttgactgcccccttgtggtaatttacatttgtcaatggtttagggagacttgcctgtataccgggatatacaaatttatgcaagcacgaagacagtttaatttccagttttaaacttttgacttgtgtaaaaccttatccccttcctaaaatattactcaaaatcattatctctgtttacttttttaaaaatagaaaataagcctaagaaagaattaattaaagttctgattcagaggggatatgattcggatcctgtgaaggcctggaaagaagcccagcaaaaggtaatcttgggtggcacttttctatattgttaaagactatgtattgtacaatgtttatgtttcacattttctaataaagctagattttaattaatcctttaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagtgagttgatagtaggatggtacatgctgcttagttttgttctattctaatggtaaaagtaaaattgtgtgttgcatgaaaatgctgcttgtatacatatattaactcaattttgtaattatcttatgaaggaacaagagctggacacattaaaaagaaagagtccatcagatttgtggaaagaagacttggctacatttattgaagaattggaggtatgtagtttataatgcccatgttagaatttttattaatgaaataatatattccagcagtatacctttgtcaagatagttcacaattggcaataaaaagaaaataagaggcataaggataaattccaaatagcgtataaaagaacagattattggccaggtgcagtggctcacgctggtaatcccagcattttggaaggctgagttgggtggatcacttgaggtcaggggttcaagaccagcctggccaacatggtaaaaccccatttcta

SEQ ID NO: 20858 - DNA, 1459 bp, Homo sapiens
ggtgatctgcctccctcagcctcccaaagtgctgggattacaggcgcgagttactgcacctggcgccctcagtgtcttttctctgctcaaatgttttcctatcagaaacggcttaactttccttagcacctcttcagtcactttcccactttttcttctcttgtttatcccaccacctaacaaaatatgtgttaattgcaaacttctactggactgtgagctccttgaggattgagactttatgtccatgtgcgtgacacatagcaagtgctcaataaatattgttaaatgtatattagtcagcaagtaaaaccaagataattttcatgtataatacatgtcctttccataaaagttaagtgtgaaattcagtatttttgtaaaataacattctttgtttcttttctttagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatggtaagtattctgtgtgtgttaagagccttaacttttccttgggtttcagttgaatagattgtatgattaaagatgatgcaaacataaaatttaatttcatactttagatttattgttaaacgctgttgtgatttccgtctagtatcacatttagaaaacatactgtttttttaaatgccaatttagcttccaagttacaagaacttcaagggtactattgaagaactggctccaaatcaatatgtgattagtggtgaagtagctattcttaattctacaaccattgaaatctcagagcttcccgtcagaacatggacccaggtaaataattatggatttcttttttaggtttgtgatcaaaagaaataccttttgtactattgctgttgactattcagaagcctatattttagaaacttcaggattatttctttctttagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtatgtatttgttttgtgagatgtacacgtttcaatttatattaaagattaatatcaattttaaaagtatatcttagtctacctttataaagtttagccaatttgtctattcttggctctaatcttgttttcctttttcaggtgctttttgaccacgtaggctgtttaaagaaat

SEQ ID NO: 20859 - DNA, 1030 bp, Homo sapiens
taataatgtttccaaacttttaagtcttatagttgttattttattcattaatggcataccacggatatttatttttcccttgacagaataactatattcaacagaataacttgttaaaaatcggcccgtttcctattatggaagatttaggtcatttccatgttataaataatattgaggtgattattttggagtataaaacaagaatgtttatattatgatctattacctaacaaataattttgctcattatatagtaaattgtgttttatcacaaggctataaacagcatgttcaagttagtatatttgaggttgaactaaatgtgctaatattaatatgtatatttttattttagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcaggtagaatataagacgatcttcagaatctaaatctaatttataatacaagactttatgcttatatttaattccctcattaggcattttaaaatatattttagacaatttgtgcttattttgagaaattaggtacattgtagcctattttaacagacctttctgatgtagtaaattataagctaatagctcaaaatactggagctcaagaaaatccaagcaacatatactgttaaatttctttgttcttttcaaatttataaacgatgctttttttggtatatgtccatttcagatcatggaaaatgctgagattaacaatatcatcaagattgtgggtcttcagtacaagaaaaactatgaagatgaagattcattgaagacgcttcgttatgggaagataatgattatgacagatcaggtcagatttgttattaaatttttagattgttcaactaaattaagcatgtcttaatttaatttcattgttttttgccatgaaaataaattagttaaa

SEQ ID NO: 20860 - DNA, 1726 bp, Homo sapiens
taatcagctcattttaaacttaccgaaggaatttctttctcaaagaaacacctaaaataaatatttcatgtcctttttttattttcctttttctttcttttcttgataacctcgctgtgtcacccaggctggagtacagtgatgcaatcacggctcactacagcctggacctcccaggctcaagcgatcatcccacctcagcttctggagtagctggaaatgcaggcagcaccaccatgcccagctaatttttttttttctttttaatagaggtggggatctcactatgttgcccagggtggtcttgaactcctgggctcaagtgatccacccacctcggcctgtgtcctttaatgaccattcccttatgcctatcagtgaacatcattgcattggttttggaaagtcctcatagtctatcattgaacctattttttaataactttcttaatactgttacctttaattcctgtacaggtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaaggtaattttattcttaaattattaatcatgatttatctttacatatatgtgttcttattgtttttaatatataaagtggacttgaatattgggctagcttagtataaaggaggttaaattagtttttaatgtttgattattataattttgaggatactgagttttacagtttggtatttttccttattagggtggcagacatgttgattatgtagctgatcagattgtgactaaacttgttgatgttgtgaagaagaagaacaagggtggtgttgcagtaaaagcacatcaggtatgtgcttttggcagttttctttttctaaagtcaaggaagaagagaaaggctataaataaagcatgagtacatttttagtggcttaatatcaacttctattgcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgtgagtacttagaggaaaataaaaatagaaacacctgactttattttccattgcacttcttagctctgcagaaacaatgattcttctcatagtgagcttctccaagtcttcccaatctgaaaaggaagtaaaaaagggctttactttaactgatttaccaaagacttaatgaccgtctatatttcagtatttcccaattacattttaccattaagcttagatcacttttgaattaatctagctgtttaacaaacaccctcacttaaatgcctaagacttgctttcagtcaacacatccaaaattgaatttgttacctccatactcactgatttgcccatacaagcagccccccactctccaacaaaaaaacaacttcctatcttagtaaaaagccccaaccaacctctaggttgtataaacaagaaagctgggagccttcctttatttcccctcctctctaatccggtcaataagaatcatctcttggatgctgcagtagcttctcaccattatctcttttttggtttactacaatagg

SEQ ID NO: 20861 - DNA, 2016 bp, Homo sapiens
aacagaggacagtttttagatttcagggatcttaaatagattggcagttcctggagaataaacatcctttgcttttctcctgcacacttttgcctcaggccaccccttcccgcttccaaagcccatctcttccaagctttccgcacgagaaaacaagtgagcccttctcattggccagattccctgtcaatctctccgctatgacgccgagtggtgccttttgaagcctctctagtcccgcctccctaacctgattggtttattcaaacaaaccccggccaactcagccgttcataggtggatataaaaggcaagctacgattggttcttctggacggagacggtgagagcgagtcagggattggctggtctgcttcgggcgggctaaaggaaggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcaggtacggctcgcgggggggactggcggtggagcctccgcgcggcccgggcatctctctggccgcccgtgacgggtgaagctctggggctgcggtcaggccggcgaccggcttgggagcccatattctccattcccggttccggggtgatcgtggagaggcggaagccccttctggtgctagtagtgaagtatgacccggcttccagggtgtcgtgcgttgttgccctgtttctaggggcaggagtccgttggtcccgtagtggatccatgttacagcggcccgggtgcgacgttattgagtcgcgcgtacagatgctttcccctcctgcccgctgcttgaaaacggtcttgaatgtccccgatcttggaaagggcagagcctagcacagtgtttctctggagcagctggccagcttacaaaagcgcccccttcctgagttcacaacgctcaggtggccaagggattgaacggatagccgcccaaactgctgctgccgaactagaattatttacggtgtcgtgtgctcgggacaccgtaaataatttataataataggcactcggtaaataatgtatgcaggaactgaaagaagtgggtgtattttattgatgacatctaccatgttgctcaagaaaagaggtttccagacagacccacttggtgagataatatgtgtctgtttaacctgacacctggggacctggccgcagcgaatttaaattgtcctatttgtacaaaactggcaactccaccactgcctactaacagattgcaatgcatgttgacatctcactatggtaggcattttgttcctagtttagggtaaacttatgattaaaaattcccttctttctctctttttttttaattgctagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccaggtaaaatcaagctcatcaaaggcagttaacctagtagttgaaatggatactcttctttctgtacctttcatgtactgagtgtgacctttctgtatctctcatgtactgagtgtcactggaactggcctaaatatggtaatacttaatatgaacactttatggtaatcatgataacagaacaatgaatatagaataaaaataacagtatttctttgccttatttctagcaaatgtgggtttacgatgaagatgttggcattaactatagggaagtcacttttgttcctggtttgtacaaaatctttgatgagattctaggtgagtaaatcctttaatataaagatctggtcaaatctttcataagaagtatcattccaaataaaaatttaaaaaagataaaagtaaaaacaaaaagtatcatttctaccaaacctgctgtagccagg

SEQ ID NO: 20862 - DNA, 1035 bp, Homo sapiens
tttataatttgcactttgcattcagacaaggaaatctagttggtagcccaaaatgtaaaacggaagccttatgtataccccagaactttcactattttgcctcaccagctgctctggaatatcctatattatacaactgctagagctgctgttttttcttgtagacccaagagtttcagagaagacctagaaccacatttttttggcacacacacacacacatacaggtgtatagatatatatatatagtttataggcaagaaaaccaacttttgaaagaatatatctggctcaaaaattataaggaaaaaacattacggagttctgtttttttctgattagttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacaggtaacccactagcaacaaacgcagaggcagtgccaagactttgtacggctgtctttaatttaggtttttctttctaagtgcaagtattctggtacctgccactgagggtgattcccagtactaaatttgacatgatattgacattcagtattttaacctttaaatgcttacattatttatcaagatgtggttattaccgttaagattaattgtctttggtgtcctaggacagcattctgcaaagtaatacctgtaagccaatcctgcccaccacttgtttttgtaaataaaactggaacacagccacacttgtttgtttacatactgtctgtggctgctttggggataaaacagtatagttgagtagttgcaacaacaactgcctggcctgcgaagtctaaaatattttctatctggctctttacagaaaaaaattgccagctctgtcctagaaaaacccttacttctaggtatactgattt

SEQ ID NO: 20863 - DNA, 1047 bp, Homo sapiens
tactcaaaatgcacgaaaggtttttaaatcacaatcaggattttgcctcatctgcttttaaaaagctaaatgcattctaattatatcttgttttcttattggttcactaaattcgctgaattaaaggctcttaagggagaagctaatgagtatgtggaaacatgaagtttcctttccatttaattcagaaatccaataagaatgtataaatatagctcatgctactatttgtatgggtgtacatgagggtatacccatacaaattgtatacatgcacacgaatggcagagcttcctaattgccattctgtatgagtagttagcaggtgttctgattgttctggtcttgtgcagccaggcagggtctgaagctgcgaggagacccagagatagccacctgcagtgtgaacacactcaaccacatatctagtgtgctgtataaacattaatagtttctctgtatactgctatgatgtgcaaaaggttagaagctttagctgcaagcgacaagaacatcaggaaaatgatttaagatcccatcttaaagtagcagtaacaaagaggaaggctataagaactttaaagacaatatcaatgagggaggaagcaataatagtacctgaagacaagaataagttgataaaagtggggaaaaacagaagtcatttttaaaaataatgtactggaatattgtcaaatgttctcataaatacagacagtggaatgtaatactatagagaatagaatatggaatagaaacagtattgaatgttaagcagaatcagcagtgctaaagacacactagcatcctcacactttaattactcaaatggggtgattaatgcaagagaaacatacagaactaaaaatcagaagacaatccagtctacagatattgggaggatggaggtcagtacaagaggaaacaaaggctagcaacgtaagtagaaaataactaaagctttcattaacaccatgaacactgagaaggactaaagagattcactcagaaacagtctgaaacttgggcctatgatgtttttaactt

SEQ ID NO: 20864 - DNA, 1033 bp, Homo sapiens
agcatgtacactttctagagatatttctaaaaggtttctatcatctttttaacgagttccattttataccagattgttataaatagaaatcatctgagtgtgtgaacatggcattcagaaacaatgatataaattatgaccattgaaattccccaaattggtaacgattctccactaagatttttgcttctgtactataagatgagaaacatttctttccattacaaagcttgtaatatttaagtatttaaaaaagagaaagagagcctacttagataaggactaaatcctaatttcatagacttagttttaaagtaacaatcaccttcagcaagtaattaaggtctcaagtctttaaacaaatttacaaacaaatattttagaaacaaagattaagaaatttaggggattttttagtttacctatcatatatgggttcaagttatcttccaaaccctgaaatacagcaaaaagtttacttaagaatatcacccaaaattttaaaaaaaaaaattggtagaaaaatgtcaggcctttattccattagccactcatttttagttccattgtaaatttcacctctagataacattttcagccttcataaagaatgatcaacatcttagattaagcaaagtcactggtacaggtaagcattgggatagttcattcacctttacaaacagaagaaaaaaatcaatagatgacaacttctaaaaatcataaacaaaacacttaactttgcagtagtagaaatatgagtttagtttacaagtcacagggccaaaatgagtaaattcaaatgaaaaagcaagactacggtgagttttgtttaaagtgtcttttaatttgaaactactttagaggattttcttccaaataactcagaaagtcagctgaaataaattcaagacagcctgattagttatttttttaaatttctaaataagctattttagttacagattgttgtataacaccccaaaactcatctgggacctcaatcgtcttggggcatgactgggctcactta

SEQ ID NO: 20865 - DNA, 1046 bp, Homo sapiens
caacctgtaggaaagccagatcctggagtctctgagggagcctggggcgctccagagaaacctgtcagaccgcttccctgccccgcccagtttcctgcccaatggcttgggtgcctcctccctgcagcctttcccagggagccccagtagttgagggtgggcccaggggacctcagaagctgctagaagccctgagtgccttctcttgcccctgggagagttgggtcagggcagcaaggtgcgtgagcaggggcttctggcggcagctggcccttgactgtcctgccccctggggctcatccccctgggaggtcagagatgcaagcccaggacatacacacagccgcacccctggggctcactgctcccagggtatctcgtcgtgggcagcccctccctgggcctggtgcccttctgggcagtccccccatccccagcctgcatcctcattgaaatccctgggccatggtgatgatgtgggaagacaggcggggcttggtgacgggctgaagctgggggctgggccaggtgacttcctgcttcctgacttcctcctttgtgcccccagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtcaggacccctggggactattgcatggggcagaaaacctgcctgggtcctggagagaggtcagagtgaaaggaggcagattgtagggggtctctggtctgagggaggaggcacagctcatgctaactaggggcccacccagtctgaaggaggaggtgcagctacttcagggtgctgcatctgggagggtcacagaatcctcttctgtgaaccatcagtagggagggaaggcatagtccctgcccttagggtgcctccagtc

SEQ ID NO: 20866 - DNA, 1027 bp, Homo sapiens
gacaccagaatgggcctggatttggggtctgggaaatgggttctctttatgtgatggtgcagccggagtactgaacctgtcactaccgcgcttctggattccctgagggcaggcggggaccccaggcaacgggattattgatcgtggagaaggctaatgggacttgagacagagaagaaaacagaatgaaccccatcccactgactactacaaagagggcatgaggttgcagtttttccatctcccccgaggacttgagagctgcaggcccgatgcacttactgaagggacgcagtctagacaggaggaggggctttctgcctgctaaagatgaaatcttgagttgagaaataagagggagaggtggagactcagcattgactcttctctgatgagggccatcctgtgcggcagggaggccagacaggaattgctgccctttggggagactcctcatttgtatcttttgggagaagagcgacctggcagtgagagggaaaggcatctgtgagctggtcctgtgacccctgtgaagaggaaaagcaagcagtgtggctgggcaggtcaccagggcttgtgttcctgcaagtgacactgagcggcctctcctgggacatggttgagtctggggacatggaatatcttattgtgaagcgacttcctctgccaggcctgaagggcaagctcatggaccactctcctttgctcagcctcctggcatcttggcctttggggccagcagagcaggaagctcagctttctttttctctttctttctttctttttttttttttgagatggagtctctcactctgtcacccagactggagtgtagtggcacaatcttggctcactgcaacctccatctcccgggttcaggtgattctcctgtctcagcctcccgcgtagctgggactacaagcgcctgccagtacgcccagctaatttttttttttttttttttttgagacggagtctcactcactctgtcgcccaggctggagtgcagtggcacgatctccgctcg

SEQ ID NO: 20867 - DNA, 1089 bp, Homo sapiens
ggctaacacggtgaaacccggtctctactaaaaatgcaaaaaattagccaggagtggcggcatgcgcctatattcccagctgctggggaggctgaggcaggagaatggcgtgaacccaggaggcagagcttgcagtgagccgagatcatgccactgcactccagcctgggcaacagagcagactccgtctcaaaaaaaaaaaaaaaaaaggaagtcatggtccctttcacgtgccgctcacagtctagtgggggaagcacaaactgctgctggagagggcagcacacggcaccaggggaggtctccagcccagccagagtcaccagcaagggctcagcctggaactgatgcctggctttggagggattagtgcgggctacgcaggcacaggggacagcagtagttcctggcagggaaacagtatgagcaaatattatgcatggactagcaatattcttgccagggtctttatgcttaaaaggtggggctgtgcaggggcgatgtttatgctgacaccaaattctgctggtggtgccctatgcagccactcagggaggggcagtttgggaaaaatcctcaggactgtctcattagatcttgagactggggagggggaggggctttggggaccgagagatgggatgggaagtcccattggccaggaagggagcccatatgggtttgggcgtactgtgacccggtttctcccacaaccgtggcgctactctagatggagctggaggagacagaaccgcccctggagcctgaggatgccctatctgacgccgagtttgagggggagggtgactacgaggagggcatgtatgctgactggtggcaggagccggatgccaagggtgacgaggccgaggctggtcagtgacacgagtccttggggggtggggatgcagcctgggatggaggttggggacagatgcattcacccgctgggctccggagcccagggtgtgtgtgggtgctggggcccatcctccaggggcctccagcctgttggcaacccctgtcccgcttgggggtggtggtgcagcatctcccctggagctgggaccagctgagacctgtccgggg

SEQ ID NO: 20868 - DNA, 1049 bp, Homo sapiens
tgatgagcttgtgagctgatacctattctctgatccttgagctagaagagggccagtgggcccagatcctaggagccctggcttcttgccatctggcaacagggtatggctcaccccccaccccgtccttccctccttccaggaggccatgctctaccacaaccagaccgccgagctgcgggagctgctggagttcacccacatgtacctgcagtcagatgatgaggtgagtgcctcctgctttccaggattgggctgtgatggggacaccttggaccttttcctggggccaccagtgtgccagaattcagccccagcccctggtggtcagctgtcgtgaagaagagaggtttgcctgttccttgtctagactgtccgttccttccccagccttagtattctcatgtcctccttttgtacatgtctcaatcctgttcctcccaggcccagctcacatggtgcctcctccaggaagcccttgctgcatgccctggctctttgttctgggctagcagtgcccactctgacctgtgtgcctccctggccacctgtggcctggacctgggtgattgcagccctcgtccatctcagccctgggccccttctccagccagtatccaggagaaccgcactgcaggacacagggccacattattccctgttctcccacatcctgcacagagcctgggctcagaaactgagtttgaatgaaccagtgaatgaatgaatgcaggacctcaggacagaaggaccgtattgtattacattgatttattttatttatttatttattttttttttttgagatggagtctcgctctgccgcccaggctggagtgcagtggtgtcatctcagctcactgaaacctctgcctcccgggttcacacgatgctcctgcctcagcctccggagtagctgggattacaggcgtgcaccaccacgcctggctaatttttgtatttttagtagagacagtgtttcaccgtgttggtcaggctggtctcgacctcgtgacctcatgatctatctgcctcggtctcccaaagtg

SEQ ID NO: 20869 - DNA, 1055 bp, Homo sapiens
gcacttcgaattctagtcccctccaggtgggtggtgaagccgcggagtgtgagaggcatctccgtgctcatccgtgaccccagctgtactccaagggaaggcatctccagggaagagcagcttggtcccgcaaaagctggactgaaagaaggactttgtgacttgggatgtgacgggcacggagatggagtggggggtggtggcagcgcaaggtgtgcaggtgacagcaggtgtgtgcctccgacgtgggcgggggagacactcggagggtgcaggagggcgcagcgacggaaggcccggctccagggcttccttctcgtatgggcagcgcagaggaggcggccctcactcagtgtcctgatctcaggcgggggcactgtttgcatggggaggggcttcctgggcttcccatctctggcgggaagcgctccccgacgcattctctacctaggggacacccccaaggcaggagcccgggccgacggagaggacttaacgacactatcggaccctctgggaaaagaggggagacgtcgtgacccaggccccgccccaccttgccgcctcgtgcccggcgctaagacccagcgggcgcgccgcccgcccggggcccggccctgtccccttccgtccgcggggcagccagctcagctccggagagccggcggcgcggcgggcatggctcgggtggcgtgggggctgctgtggttgctgctgggcagcgccggggcgcagtacgagaagtacagcttccggggcttcccgcccgaggacctgatgccgctggccgcggcgtacgggcacgctctggagcagtacgagggagagagctggcgcgagagcgcgcgctacctggaggcggcgctgcggctgcaccggctcctgcgcgacagcgaggccttctgccacgccaactgcagcggccccgcgcccgcggccaagcccgatcccgacggcggccgcgcagacgagtgggcctgcgagctgcggctcttcggccgcgtcctggagcgagccgcctgcctgcggcgctgcaagcggacgctgcccgcctt

SEQ ID NO: 20870 - DNA, 1012 bp, Homo sapiens
ccggctaatttttgtatttttaatagagatggggtttcaccatgttggttaggctggtctcgaactcctgacctcgtgatccgcccacctcagcctctcaaagcgctgggattacaggcatgagccaccatgcccagccctcaaatttactcttaatgctcagttaatataaaggattcctaacagtttacaatgtggttttcttgtttttgttgttgttttggttttttaagatgtgaggtctcaccttattggccaggctggtctcaagctcctttcctcaagcaatcctcccaccttggcctcccaaagagccacctgtccaatgatttatcctgtttcttaagaactgtctttaccttcttagacattttgtcataccattctagaagtcaaattccaagtgcagtgattttttttttccctagtccattatagttaatcttcttgttagtgatcaaataccaaaagagaaaagcacaaccagaaattttggctatttgctgcaagttgtaggtcttgggctctatactaagaacttgaaatttttaaattagtatccctgcctaggtgaaaagtttttaataaatgtgttgaaaatcaactttaaatccatttaatttagactggagtgggcgtgagaaactgcaagtctatttctacatataaggatatattattatattgtcccatcccaccactacctttttctcaatttctatttctttgtagttattttagtaaaagccatttggattctgagaagcactaattcttagctgtgataggtctatgcaagtaagacagaatcattaaatgaagctcactaaatgaagttctcatttctctccaacagactgtgctagcaaacttcgttttcttgattgtatttaaataatttagtatctcactacgataatagtttttaactggaagggtgtgatgtgttttttgttttttgttctcagagttgtcttctgagataattattaccaagtcatttgtggggttg

SEQ ID NO: 20871 - DNA, 1139 bp, Homo sapiens
ggtacaggcaccgaagaccaacatccacaggctaacaccccttcagtccacacaaagaagcttcatattttttttataagcatagaaataaaaaccaagccaatatttgtgactttgctctgctacctgctgtatttattatatggaagcatctaagtactgtcaggatggggtcttcctcattgtagggcgttaggatgttgctttctttttccattagttaaacatttttttctcctttggaggaagggaatgaaacatttatggcctcaagatactatacatttaaagcaccccaatgtctctctttttttttttttacttccctttcttcttccttatataacatgaagaacattgtattaatctgatttttaaagatctttttgtatgttacgtgttaagggcttgtttggtatcccactgaaatgttctgtgttgcagaccagagtctgtttatgtcagggggatggggccattgcatccttagccattgtcacaaaatatgtggagtagtaacttaatatgtaaagttgtaacatacatacatttaaaatggaaatgcagaaagctgtgaaatgtcttgtgtcttatgttctctgtatttatgcagctgatttgtctgtctgtaactgaagtgtgggtccaaggactcctaactactttgcatctgtaatccacaaagattctgggcagctgccacctcagtctcttctctgtattatcatagtctggtttaaataaactatatagtaacaatgaaggcatactgctggctcctggcatccatatcctttgatctgtattcctttgtaactgtacttttttccagacagggtatcactctgtcgccccagggctggagtacagtggcaccatcacagctcactgcagcctccatctcctgggctcaagcagtcctcccactccagcctcccaagtagctgggactacaggagcatgccaccactccaggctaacttttgtattttttgtggagataaggttctgctgtatttcccaggctcttctggaactcatggactcaagcaatccatcctccttggcctcccaaagtgctgttacaggcgtgagccactgtgcctggcctggcctgaactgtactaatagtttcagta

SEQ ID NO: 20872 - DNA, 1050 bp, Homo sapiens
ggttcctgaatcgccgctgggatatgtccagttctacctacctgtaacacaagtatgaacaaacacatcccagcagtgtgtgagtgttcctctgtaccgttgggttcatttctagataaacaacccagacatgcgagtgcagatcctcaaagattacgtcaggcagcacttccctgccactcctctgctcgattatgcactggaagtagagaagattaccacctcgaaggtaacaaagaaaaaacttcctaattccctcacgttggacaagtttattggaggaaacaggagccacgttacattttgattatgcagctaaaagcaaacctagttttctagaaatgttatttttgtttcataactaaatttaacagacatgcactaaatgtcaactaggtgttgggtactttgctagatgctgggaattgaactgagtcagacacagtgtcgaccagtggggctggtagaaggtttttaaatgatggtcacaattcgtagtaatagtagtgacagtggaaaattatgaagaaaaaatgagaaataatgataaatgctttgaatttttttgccttcccagaagccaaatcttatcctgaatgtagatggtctcatcggagtcgcatttgtagacatgcttagaaactgtgggtcctttactcggtgagcattgtagctgttttcttcttcattacgtttgttgatttttgttgtttcctccaaactataaaagtaatgcatactcataatagaatatttgaaaaataaggagaggtataaagaagaaaacaaaaattgcctgtaatgctaccacccagagcaccccttttcttctcattcttgggcagtagtagtactgtctgtggggaggagggcagtcacgtgagccttttaaaactacaagttgatgtgtgttgcagggaggaagctgatgaatatattgacattggagccctcaatggcatctttgtgctgggaaggagtatggggttcattggtgagtccattcgttgttgttttaagtgtttttttttaaaccccacggttcagcta

SEQ ID NO: 20873 - DNA, 1032 bp, Homo sapiens
ccagagattgggacatgaggtagtagggagcagagggcaggtgcagtcttggctagaacttcttttcatttagttctcagaattcagcaggtaagagtaaactaagaaacctacagtgtttgggttagatagagcattcttgggatgtcttacaggagcccaaaataagaaaatccacatggatgtcttttttttcctgcctcccaggtctgtatacgaagatctcgtggccaatggagtcattgtacctgcccaggaggtgccgcccccaaccgtgcccatggactactcctgggccagggtaggtgccttaaatgtctctaacagtgtgagcaagggagatctgtgggtctatggtggtgggtttcgcgttgatttgccttgaactcttggaaaccaggccttctgtattagtcggggatctcttagagggacagaactaataggatatatatatataaaggagagtttattaagtattaacttacatgatcacaaggtaccacaataggctgtctataagctgaggagcaaggagagccagtccgagtcccaaaactgaagaacttggagtccgatgtttgagggcaggaagcatccagcacaggagaaagatgtaggctgggaggctaggctggtctctcttcttcacatttttctgcctgctttatatttgctggaagctgattagattatgctcactacactaagggtggatctgccttccccagcccactgactcaaatgataatctcttttagcaacacctacacagacacacccaggattaatactttgtgtccctcaatccagtcaagttgacacttttggaggtcaaggtggaaggactgcttgagaccaggagttgaaggctgaagttagccatgactgtgccactgcactccagcctgggtgacagagtgagaccctgtctgtaatttaaaaaaaaaaaaaaaaaaagggctgggcctggtggctcatgcctgtaatcccagcactttgggaggccagggtgggcggatcacctgaggt

SEQ ID NO: 20874 - DNA, 1060 bp, Homo sapiens
aggagactttcctaagcaggaaacccagtgggcaagtgtgatttctcttggtcattctctccccagcctggccagaaggggctgggcagtaatgcaggggctttgtgattctttgtggtgaatctggaagtcaccttcctccctgattgtggtttctgcccccacaggttggaggcatcaagcctgggtgctttaagattggcaacacaggtgggatgctggacaacatcctggcctccaaactgtaccgcccaggcagcgtggcctatgtctcacgttccggaggcatgtccaacgagctcaacaatatcatctctcggaccacggatggcgtctatgagggcgtggccattggtggggacaggtaatcagctgggaagccaaggaggggcttcctgctttgagagcagtgggctaggagacgatgctgtgtcctgcaggctgcttgctgcccctgagttccaggcccgcaggaatgctgctgaagtctaaacaatggggcatcactgctcttgtctcaggactgacagagcatgaaatcggaaaacacagaacagggcaacaatgtgcaggaggggcgactgggctttggggataattctgtttgttgtgattggccatagggaggcagcagagtacagtggttaggagggccagttctgaaattggactaaagaggttcaaatcccattttccctctttagtagggggtgggtggcaggggccatcctggtccggttacttaacctccctagacctccatcatttttacacatcaaatgggtaaataatacccccacctcatggggctactggaggaataaatgaattgtaatacatataagtgtctgagccagggcctgcgttcagcaggtgctcagtgagtttttattgtagttaataatagtatcctcattatttttggtagtgggaacactgatcagtaggtcatgaatacagtattatatctcagagtaacgtctggcacttagtaggttcataataaatgttagccattattgtttattattcctactattactactgctgtcgggcttag

SEQ ID NO: 20875 - DNA, 1032 bp, Homo sapiens
atccatgtgagttttgagaataatgactagataagtgtcaaacttgaaagtctgaggtctcaagaagtgagaggctgggcgtggtggcttataactataattctagcactttgagaggctgaggcaggcagatcacttgagctcagaagttcaagacaaggctgggcaacataatgagatctcatctctactaaaatttaaaaaaaattagtgggttgagctaggaggattgcttgagccccggaggttgaggctgcagtgagccgtgatcgtgccactgtgcttcagcctgggcgacaatgagaccctgtctcaaaacataaataaaatgtggggccagaccccatcagtcctgcccaaaacagggtgtccataactggacctgatttaacagacaaatctgggacaggggagcctcagcagcttttatttaacttctgagctgccctgtactgacccttggttagggcacttggtttggagcaggtactgtacatggaactttgtgtaaaatgccttgggtgacagaagtcagactctaggctcaaaaatctagcctctgtcttgagaaacagaactaggacacacctttccaccctctcatttttccaaagtggatatccattgtaagaactgttcttacaccgcgctgggcgcggtggctcacgcttgtaatcccagcactttgcgaggctgaggtgggtggatcacctgaggtcaggagtttgagattagcctaaccaatatggtgaagcctcatatctactaaaaataaaaaaattagccaggtgtggtggcagacatctgtagtcccagctactcgggaggatgagacaggagaatcgcttgaacccaggaggcagaggttgcagtgagccgagctcacaccactacaccccagcccgggtgacagagcgagaatttgtctcaaaagaaagaactattcccgcacatcacttaagaagcttttgtaggacattgactatgtcttagtacctctgagaacccttgcatagagcccaacatagatat

SEQ ID NO: 20876 - DNA, 1032 bp, Homo sapiens
cgtggagaagtttccctgattaagccctggctccccacttctccacccattccctgcgcccggacccatgtcctgaggctgagtcactgtgccttcctcaaggctcatgaagcagaatggttacctcccttctacccggtttcccctccccgtcaagctctgccacagccgtgacttgttggagccctttcacttgcgcaggtcctgtgtcaccctccagaggaggccaagagtgggcaaggtcggtgcctgttcaggcacagcccgcaccagagcaaggggtgaaagggcatctcctgaggacttactgagcttagggatctgtgaccccattttttctggaaaaatctctctttgctgggtgtggtggtgggagtgcttgggcaccacccctgtgcagtccctccttctgccctaggggcaagacgtgctgtccctctgagtttcatctccctcaatttttctgtaggttggcaaggccacaggcttcctcaagaactttctgatcgagcccttcgtcccccacagtcaggtatgtgtgaggcggctccaggctgggtcttctccctcctggaaccttgggtttgtccaccgtaacctgaggaaagaagtcaagctgatgaggacagtcagagggaccagggtccctgaagctgcactgaggatctgagggtgctgcggactcgggagtccagaggggaaggaaagggcttggtctacagcagagaggagttaggactggtaacaaaggggacttccaagtgcagggatgagaacgacctgcaggcaggccccacccctcagctggggttggtcatactgattcagtctggaccaccagccagtggggtagaggcttcttcctcttgtcctcggggaaaagatggtggacaagtctctggatgaatggttttcactgggttttagaaaatgagaccgtggggattggtttcctctcccagtacatggtagaccatcttccccagttcagcgcccctcaccagcttcgcccccacaaccccaatcccactg

SEQ ID NO: 20877 - DNA, 2028 bp, Homo sapiens
cagccgtactctgcactggtcagagaacagaaaggtgtttcagtgtctgcccacctcagatgggaccagcactcagatttgggtcaaagcaccggttttcttggccttctagccagctgccttttgctccaggatgagtgtggttgtggatcagctagtttgcctagagggaatggggcagggtaaggcaagagtcccaggggaaatggcacttttgtttttctctatcttccctcacccattatctctggatcttcttcctctgctggcaaaagtgctgcttgatatctctcttccatccctcccgctgggacagcattttttccttcctcttgagaaaagctgagatctggttttattgtctgggggcaactgggagtgggtctgccctgctggggaagatagtgcctccacacgcctgcccccttctgaccagcttctctctcccagacaggtagagcaggtctctctgcagccatgtcggccaaggcaatttcagagcagacgggcaaagaactcctttacaagttcatctgtaccacctcagccatccagaatcggttcaagtatgctcgggtcactcctgacacagactgggcccgcttgctgcaggaccacccctggctgctcagccaggtgagccctgcctccactttgggcctttcttccaggcccggggtctgaggaagagaaagccattggtttgttggtgatgccgatagggtcatggggttggaggctgccagcagcagctgtgggaagcatgccatgggctgagcagggtttgtgttcatgctgagccctgcatgttgaggtaccccagcatggtataccctgccatgggcttgaaactggacaaactggtgtccaaatcaaagctgtgtttattaaccatgtggcctggggcaagccatttcacctcttttgagttttagattccccatctctccaatgggataatactcactttgagctgtaaagattagcaagaagcatttagcgtgcttggtgcctggcacatggtagatgctcagtaaaaagtagggatgtgccctctcctcccctaagtggagtatatcaggaatgtatcaaggcaattaggaagtgtgatgttgtactttgtgaagaatggccccgaccctggagggtcagcctggaatagagggctctgttcttgagatctttgcagggccattgttagaaagctcttagatttccttggcagggctcagagagtaagcctaggactagtggtggtgtttcttcccactaggaggcagctcaaccacaaagggatggagggagtttcctggccctggagatgtatgagcagtggttaggggctgcttattgggcctgttgtagacagggttcaagcacagggatggggttgaccagatgacctctaaggttccttgctgcctcaaggctctgtctctctgttttcctctttggaacacatgttctggtccatattctgaggggcttactgttgaatgaagaagctaatgtatcacatagggagggtagagaatcacttattcactcagcaggtatttgctgagcgcctactctgtgccaggctccatctgggcacaaatgcctctagatacctggttgtcaaaagcaagatattggctagggtaggtggaggaagcatccaggagttgactctgaaggatggttagggctggctttggagcagagtgaatgggaagtcaatccctgctgtcctctatttggatccccaaaatactacggtttatctaattcttcctcactctaaatacaaaccgcttttgttccagaacttggtagtcaagccagaccagctgatcaaacgtcgtggaaaacttggtctcgttggggtcaacctcactctggatggggtcaagtcctggctgaagccacggctgggacaggaagccacagtgagtgggcatggggtcaggatgaacgtgtgtggtaacagaagcaaatatggtcacctccaggtcagcagctctgtggatcacccccacagccagt

SEQ ID NO: 20878 - DNA, 1074 bp, Homo sapiens
ctcaggcaatcctcctgccttggcttcccaaaatgctggaattacaggcatgaaccatcatgcctggccagaagactccttttatttttttattttcatttatttatttattttgagacagagtttcgctctgtcgcccagggtggagggcagttgcaggatctcggctcgctgaacctccaccaccctgtgtggtggtgggcgcctgtaaccccagcttcttgggaggctgaggcaggagaatcgcttgaacccagaaggcagaggttgcagtgagcggagatcgcgccacttcactccagcctgggcaaaagagtgaaactccatctcaaaataataataataataataataaactcattcagagataagtttaaacgtgtcatatgtaaaagtcaagggtaagtgatttatgtgtgtgggaggggctgcacaggttcttcctgaaagaggagggaattttataggaacatacctggtggggaggaggcagtggcagtttttgagagagagtcagaatggagtgggggtgactctgggaaggggccagcctggacctggttgggctgcatggagaaactttattccctgagcacagatgctgcatccccagagagataactgctgcccaggagtggaactagccatccctccagcttccctggtggcaggcagcctctgtcgggttagagagaggggccctggctgcatctccctggagagccttccccaggacacacaggcccttagctctgatggaaggtttgtcagtactgggcaaaagtgagtggtgcggaagttagaatccttggctcttcacagggtggatgatgatggggctttgctggaagctcctgtcttgggctgttacaaggagagaggtgggtttagaactggatactctacataaacagaaaatgcatttgaaaaaaatagtagccgggcacggtggctcacgcatgtaatcctagcactttgggaggctgaggcgggcggatcacgaggtcaggagattgagaccatcctggctaacatggtgaaaccccatctctactaaaaataaaaaaaaaaatc

SEQ ID NO: 20879 - DNA, 1131 bp, Homo sapiens
gcgtgagccaccgcacccagccggaatttaaaataagaatgatggtactatatagataatgctgagtcctctccagttcagtgtgggggtatttgtgtttaataaacctaggttcaccacaataaacatgttcctctgcctagcagttaagaagatctataagcagtcaaaaactagtgaagaggttttgttttgttttgagacggagtctcactctgtcgcccaggctggagtgcagtggcgcgatctctgctcactgcaagctccgcctcccgggttcacgccattctcctgccttagcctcccaagtagctgggactacaggcacctgccaccacgcccggctaattttattttattttatttttatttttattttttttagtagagacggggtttcactttgttagccaggatgatctcgatctcctgacctcgtgatccacccaccttggcctcccaaagtgctgggattacaggcctgagccaccacggccagccgtgaagttttaagtaggggcactgtggaccagattttggctctggaaatatatttgtgataggggtgaggaggttggggttggagggagtaaggagaatggagatggaaggaagacacaaaaggtaggaaaggattggagggcacagtcagggagttagttagtggtagactcagcaggagttggttgctattcagatgtgttggggaaagtgacaggcatagctgactcggggtcattcactaagccaggagcccaggaagacacacagatgcaagcagagaaactcactctgggcacgaggtggctgtgggatcacctggtgggggtcagtccttctgtgaagcttgggcagtcagtcagggatggggccaccagacatgctgtggccttgcaaaagtgcacagagccagtcaggcaggagttggattttccagttctgctgctttcgctgccatgtgatcgtgggcaagttacttgaaccacctacatatgttttgttgagtattaattgggaatgatacttaccctgacaaaacattactaggattaagtaatgtaatgtatgcaaagtacctagtactttgcacctagtaggtgtttttgttggtttgttgttgttattaagaca

SEQ ID NO: 20880 - DNA, 1028 bp, Homo sapiens
agcttgattcctccgatcttgggccaagggcccctcctttcttttgtgctactgaaatagaagcaaacctgtgtttagagttcccttttctgtctcatttacctgcatctctcattgattggtcttagtggagggatttgccagcagctgccacgttgaacttgatccttttagtggctcactaatcccacctctattctggattgtagctagtcctgcatgtttatggcactataggtttcaaagctctttcatacccatttattcacttgataatttttctcttgtgtgtttcaacccaaagtaatcaagtagatcccttcacattgtcttttctaaggcagtccagtacctcttaggtggctgtgtgtcagaaggaactttttcctcttgattactttctgctcaaagctgaacatcactttgctggttggatgcaagtgccatgcgacctctctttttatttccttgaggacttgttagctaattttctctcactgctagattaagggctcctgtttctgaagcatcttaccagaagtgtgtgtctcttgcttgagccatgcctcttgccctagagtgatcctgagaaccactgctatttatgtcttagtgctgtattgccttgtatttccttctcagttacatggacacagaacagtatgaagaagcagtacgagactatgaaaaagtataccagacagagaaaacaaaaggtaagtttaaaagcatttgttttttagggaactgtgtggacttcgtaggccataaatctgtacacaaggtagtttgattcagggatcagggatctacctagaacttatttgatcaccagccagaaagaagtgaacaaaggctgggcgtggtggctcacgcctgtaatccccagcactttgggaggctgaggcaggcagatcacctgagatcaggagttggagaccagactggccaacatggtgaaaccccatctctactgaaaatacaaaaaattgtgggtatggtggtatacgcctgtaatcccagccact

SEQ ID NO: 20881 - DNA, 1090 bp, Homo sapiens
tgtgaagtatgattgctctctctctcctgaagcttaggaaactagatgatgcaatagaagactgcacaaatgcagtgaagcttgatgacacttacataaaagcctacttgagaagagctcagtggtaagtgcctctgatgggtagggggaagagggagttgccgctggcctcaggggaattgccttgtggatgacgaagcagacccagagatgttgtgaggtcatttggtccttccccctgcctctaggtgggattgttccagccctagactatctttatagacctccagcggaggagattgcacaagctccctcagtctcccatgcctgtgtctaacgcccctcacggtcagtaagtttcctctgatgcctgacccaaattccttttgttaaaaagtttaaatccatttcctttggagattttattttgtgttgtacacttatgctctaccctggcacagtgcttgacacataggtgctcactgaataaatgttttgttgaatgaatgtatggtgcttggaagagaaaacaactcttggagacagttgagagttgtacttcatcctgtttgttctgggcgagggaagacaatcttagagttggaagagatgtaatccggctcagcctcccaggataaaggaacttccttttgaaacaccctggatggctactctctgcttgagtgttttgagtggagggcactctgtgtctgacagggtgattatgagccaggatgtgcctacctctaatgctcacatttgccccagagtcagggtgctccctggcatggttgctcctcttactcttagacccaccagctggttttctccagataggaacagggctaggagaaatctttctcagaaatccatctcttctgatttcagattattctctaggcggagaaaaacttcccgtctttaaagttcttagagaagatgtatttattgtatactaatcctccagcacctgctccactccttattataaaatgtcatatccaaagaacagatgctgtcactgatgcctgatgagccagtagtttaagcttccttgtctcatcagtggtacagaatatctcatggacta

SEQ ID NO: 20882 - DNA, 1522 bp, Homo sapiens
ctttcttatggtaaacttgagggatttcaaattgttttcttttctttttgacggagtctcgctctgtcaccaggctggagtgcagtggtgtgatctcagctcactgcaaactccgcctcctgggttcaaatgattctcctgcctcagcctcccgagtagctgggactataggcgtgtgccaccacacccagctaatttttgtatttttaatagagacggagttttaccatgttggccaggatggtctcgatctcttaacctcatgatccgcccgccttgtcctcccaaagtgctgggattacaggcgtgggccactacacccaacctcaaattgtttttcaaagagaaaacacttacgtgtctcagcatatacctagtgtgactggacaacaagatctaaaagaatcaagggatccatagacttaagagtcaggacatccttacctgattccttgagctgataaacttaacttctctgtatgttttcctgatgggcacaaataagagcaattcttattaggcccttactacctaggtattgtacactctttgcgattaggattttgccttttatttctctattcagattgttaatgggaacaactgaactctcaattcatgtcccgggtttcctgtagttgctgttcgtttgctgcagctttgcatggtgtttttgagtttgtggcctcacttaactgaagagcttgtgggcatgcctccccagctttcttccttacctggttttaaattcttaggaatgtgtccttctaatcttcctcttgaagtttcagagcaagcacctagacatttcagtaagcctccaaactgagtgggaatttatctttgacctggaacccaaatcagtgagaaacactattttccttttgctgtgcactaagtgtagtcagatgtgaagaaatgggagatgggaggagaaataagttaaggaagggataaacctaggaatacagaattctcaataccggcaaattaattgaaccctgatactaacagatggcaaagtagataatcataactggagcaaaggtagagtacagagaaaggttctctcttagtgctttagttcagatccacatgttaactagtgccagagaaacaagaattttgagaaaatatagggccaagtgagtggcagttgcttagagtccagtccactcccaacaaacagaactctgattggccgaaagcccagccttattgtacattccagccaatcagggattagtttagtcattgaagtttgtattttaatggttttgaaaagctgagtactgggcacttgcttttttgttcttcgggactttagaagtttggagaacaatagtcagcagttgcctagttgctttgtggcctgatgcagagtccctctgagagcccatttctcccttactgcactagtctttggtcccctttctccagcactgagtgatgtggaagttactcagaggtctttccaggtattcttttaaacttttgaagtaagaacaaaattcaaagtgca

SEQ ID NO: 20883 - DNA, 1027 bp, Homo sapiens
agccaccatgcctggccctttcattcttttaaacaaccaacttttactgagaggtatctgtgtgcccagccccagacagggacttacgagatatgaaaatgaacaaacatggtcttggcttctaggaactcagtgcagagatatgtacagaatccctgtattcaccatattgtgtcatgaagactcacgcatagggagctgtggggaactagaggatggctaccagcccaggttgtggggatcagcatggcagaagggatatctgagctgctctcaggcaatgagtgggaattagtaaggaaagaggagggagagggaattctaggctcagaggatgaaggcagggacaaagtaacagcttggtgtctactgggaatgcaagccttcaggattgattgggcagacaggaatggcgggaggctctattaacagaagtattcagaggctggggagggccttgctggcttgtggttaggtgtgtagacttaggcagtgggatatcagtaaagaggtggaaactagggagtgacacagttggatctatgtgtgagcttgctgtctctggctgttgggtgagggatgagtctgggggaaatgaccatgcagagaccgaggcagctgcagtgatcgaggtgataccgtgagggcctgaactgggccaaggctaggcagctggagggagagagacagtacagaccagggtctcagtacagcctttggggtcaggaggtcactctgattgagcctcagctacttattgcttatgaatcctggagcaagccagttaaagtcacagacctcagttttgtcctctccaaaaggataatatctcagccacagagagtcatctgggtctgaccctggatcgttgtaaagcacttagcacagggcctcagttcacattccagaaatggtagttacatttaggcatgaagacgaggacacaggttggagagataattaaaaggtagagttaaggccaggcgcggtggcgcacgcctgtaatcccagcactttgggaggccga

SEQ ID NO: 20884 - DNA, 1170 bp, Homo sapiens
ccctctctcaggtccccagttccctaagagcagggtctgtctctgaccagcctccagtccctctgctgcctggcccaggctgcaccctggagaacagagttgtgggacagactgtgtcctccctacagattcctgtccatgctggaggaggagatctatggggcaaactctccaatctgggagtcaggcttcaccatgccaccctcagaggggacacagctggttccccggccaggtatgtgccatggtacgctctgtagggtgtctggcctgcctggctgagctaagcctcctgggtggaagagagctcacctgggccggaggccctggatcccactgagggacctgccaccggcttcagcccccccagtccctgccttctctctctctctcctcagcttcagcacccccgtccctgactctctctctcctcagcttcagcccccgtccctgacttctctctctctctcctcagcttcagccccccatccctgacgtctctctctctcctcagcttcagtcagtgcagcggttgttcccagcacccccatcttcagccccagcatgggtgggggcagcaacagctccctgagtctggattctgcaggggccgagcctatgccaggtggatacttgacccctgacctctgaccctcattcactccttcccaaaccttttttactgatcctgagcaaccttgcctgcctccccaataggcgagaagaggacgctcccagagaacctgaccctggaggatgccaagcggctccgtgtgatgggtgacatccccatggagctggtcaatgaggtcatgctgaccatcactgaccctgctgccatgctggggcctgaggtgggcagcccgacctgctgaccagttgggggacccccaccaacctgagaccccggctcaccacccctcttctgtgcccagacgagcctgctttcggccaatgcggcccgggatgagacagcccgcctggaggagcgccgcggcatcatcgagttccatgtcatcggcaactcactgacgcccaaggccaaccggcgggtgttgctgtggctcgtggggctgcagaatgtcttttcccaccagctgccgcgcatgcctaaggagtatatcgcccgcctcgtctttgacccgtgcgtcccccagagagcccctcccc

SEQ ID NO: 20885 - DNA, 1056 bp, Homo sapiens
gtaagagattccacatggtccgggccagtcagtgtcttttgctgcccttccaaaatggactgcccccatgggacggtttgtggctgttggcgggctcagggtaggctgtcactttgtgccgtgatcctgaatcattgaatagctgaaatccttccattgtactgtcatctctctgaaaatgtgtaacttgagccctgctggaaacactaacttgggatcttaacaggagttggtttacaagccttttgccttctattcatagctccatgtatgtccccttcaggtggctgtcagaggcatcccaggcatggaggagggcgtgggtggcctctctaaccctggctgctctcctagacatcagattgctctctgagctgctcagacagcgtggtgatgaatgacgccagtttccaaacctctagcatttgcagcctggtttttaaaaggaactctgctttctttgtcagctgctctattcctgtcccctagccctctcaacaactgaactgcttcttccctttcctgaaagaggctttgagatggaaggaagggcatttgggctttaagatgctttgtgggctgggcgcggtggctcatgcctgtaatctcagtactttgggaggccaaggcggggggattgcttgagcgcaggagtttgagatcagcctgggcaacatgatgaaaccccatctctaccaaaaaaaaacccaagatgctttgtgttaatggggctttttttttttttttaagaggttatggtttgcatggttggggccttcaccccatgcagatttattggatggtaatggtttctcccctccatttttgtggttttgggagctagtctctggaggatacaagattggggttgttgacaggacactgagtatcttctaggaaactgaggaaagacgtcctcttcagcattctctccaaatgagaggtgctgaagaatggagtcccgggaaactggaggtaagaggaatgtgtgaatgttgtctgacagatgaagtgaggagtccggctccttcacagggaagtgaaggcgcaggggct

SEQ ID NO: 20886 - DNA, 1049 bp, Homo sapiens
tctcagctcaccacaacctccgcctcccgagttaaagagattctcctgcctcagcttcccaagtagcagggattacaggcatgtgccaccacggccggctaattttttgtatttttattagagatggggtttctccatgttggtcaggctggtctcgaactcccaacctcaggtgatccacccgcctcggcctcccaaagtgctgggattacaggtgtaagccaccatgcctggccctcgcccacttcttttaacacacacttcccttcctttcttcacacactttggatgtcgtgaacctatgattcaaacttaaatccatctgatcccacagcttgagccatatctttggtccatcccccagaaagttgctcacagacaaatgggagagcaaacaggtcaataggatcaatgttacagtacggatgatgggaagcaagtcacaaactcagtttccagaagttaagactctccaaatctccatttctggtgaagggtttaatgggacaatgagggcgcggccctgactagccacagtccggctgactggcttctgccgtgtgtgtatctgatggcaggacagaacgaccgtgcttctgcagttgtgtgtggtgaggcagcaccgaccccagaccagtacttagcaaggatcagtggaagcaaatttgactctgcctgtggatactgttctgtatgtctgcacaaggctcgttcctgagtgaaggtggcttaaaaaagtggtggcagcagctgttcagaccagtggtatgagcagccctcacatgtgtattccacagatggggtctttaacattccctggtcctgtgcctgcagtacttggatatcctctgctcaccttgaggctggtctttctttctttctctctctctctctctctctctctctttctttctttctttctttctgtttctttctttctttctgtctttccttctttctttctttctttctttctttttctttctttctttctttttctgtctttctttctgtctttctgtctttctttctgtctttctttctttctt

SEQ ID NO: 20887 - DNA, 1046 bp, Homo sapiens
atgatccacccacctcagcctcccaaagtgctaggattacaggcatgagccactgcacccaacctgaaacgactttgaaggggaagctctgccatttagagagacgaggcaggccccagtgctttgggtcgttatgcagccacttctggcacctagaaattatagagtccaagcagaggtctgactctgcctggcagagagagcgatggctccgtgtgcgacagaacccctcctttctgatgctgttcctcccctgccctcttgcctctcacaattagagggctgttaaactgtagagggacagtaacactaatttttaaaaatcattttaaggttgcaaaattattttcatacatattcctcataggtgccttgggaaatagtggggcttgtttccccactttgtttttaatttttattattacttttttttttttgagtaagataaggcaagtgtccctgctttagaagggatgcagaaggaacttaagtagtttgcctaagatcgatcatacatttagaaagtagtagagctggggcttggatttggggtcagatgtgacctgatctaacagtgggcccttcttcggcctggtttgttcgttaaatgaatgaacatgcagactgagtgcgccacggcacaagggcagactcttaactctttagccctcctcatcactagcgctcctctgtttttttgtcttccccagcgtctacccgacctcctgtcttctctcttgacccctttcacctctgcctctgaggaccaaaacagttaggagtcccaagtcagtactcttcagggcctgagagtttgctgacatctacatgtcattaatttttctgggaacctgaaagtcctaatggctagaaaatgaaagttaaagtgagtaaactcaggggtcccactgggcagggttaagggggaagcaacagagcgggcctctggttagtcctctgtttctcctgtggtgctgcctgctgcttgcaagtgggaagaatgtggcttgccaccaggagctcctgtcactagaatttacatggaa

SEQ ID NO: 20888 - DNA, 1024 bp, Homo sapiens
cctcagcctcccaagtagctgggattataggcgccggccaccagaccctgctaatttttgtatttttagtagagacagtgttttgccatgttggccaggctggtcttgaactcctgacttcaggtgatccacctgccttggcctcccaaagtgctgggattataggtgtgagccaccacgcccagcctgagtttggggttttttattttattttattttattttattttattttattttattttattttatttaacgaattgggcagtctcctgaggcacagtaggctcagagagactctgcagggtttgtttttgaggtaaggaaaatgttattatctgtggtgttggttgcacatatctctggatatactagatcttgaattgtacactaaatgggtgatttgtatggtgtgtgaattatatctaataaagctgttactgggccaggtctagtggcttacacctgtaattccagcactttggaaggccaaggtaggaggatcgctgagaccgggagttccagaccagtctgggcaacatagtaagaccccctgtctctacaaaaaaaaaaaaaaaatgtttttaattagctgggtgtggtggcacatgcctgtagtcctagccactcagaggctggggtaggaggattgcttgatccccggagttcaaggttgcaatgagctgtgaccaggccactgaactccagcctggacaacagagcaagaccctgtctttaaataaataataaaagcaaatgcaagatctcagcgagaaaaaacgtgaaagtgaggtgagttagccagagtgagaacagacctgttgaaagaagctcagctgtgaagggaagagaggtgctcagcaagtagtagctctcttctcaaaggtatccagaggcaagtaaggggagaaagggagtggttttagtgttttgagagcctaggtcaagaacacaccagcctgggcaacatagggagctctctcgtctctacaaaaaataaaattagttgagcgtagtggtgcgta

SEQ ID NO: 20889 - DNA, 1778 bp, Homo sapiens
attggaatgatgggtgagaatcattatttcttaaggcgccgacagagtctgaaggtcttctctctggcatcgtaagtcacactctgcttctgtcctttgtccttggtgatccagggccattttggggtttgtaaacaagcaacaggcccatgacctactcattaacaagccagatgggaccttcctcctgagattcagtgactcagaaattggcggcatcaccattgcttggaagtttgattctcgtgagtgcccctcccttcttatgtccaaagttagctgctttcgttacaaaattattttaacaaataatttagtgggtacttactatttgttgaggtcagtactaattatgggaaacataaatgtatagccatgacatactcataataaggcagcctatgaaaaatactattatgggaaacacaattgctaatttggttatacatgaaagtatatggcagcatggttacacatgaacatttaaccatgacatggctacctatgatacaagagtccgtgcagaatctcagttgcttccctcttaaaatgtttgccttattgtactactctgcataaagcttatttcagtgaagaatttgatgatttggagttcttacagtagtaaaaatattcctttatcctaattaacatatggatattgccatcaaccatttctacccaagatgttagttcttttctttttttgaaacagggtctcactcttttgcccgggctggagtgcagcggcacaaacatggctcactgcagccttgacctcctggcctcaagcagtcctcctcccttagcctcccgattagctgggaccacagacgtgcaccaccacacccatctaatttttaaattttttgtatgttgcccaggctggtctcgaactcctgggctcaaacaatcccccactttggcttcccaaagtattgggattacgggcttgagccactgcaccagggcatcaggaaagttagttctctcctctgaccctcacaataagggtagcttgctggttcattttctgtgaattaaagtttttaataacttttggctgggtgcggtggctcatgcctgtaatcccagcactttgggagcctcaggcaggaggatctcttgaggccaggagttcaagcccagcttgggcaacatagtaagaccctgtctctaagtaaataaataaataaataagttaattaggtgggcatggtggtgctcatggtgtgcgcctgtagtcccagctactctggagggtgaggtgggatgatcacttgaccctgggagttcaaggttacagtgagtcatgatcacatcactgtactccagcctgggcaacagagtaagaccctgtctcttaaaagaaaaaaaaaaaaaggctgggtgcggtggctcacgcctgtaatcccagcactttgggaggccaaggcaggcggatcatgaggtcaggagatcgagaccatcctggccatcacagtgaaacccccgtctctactaaaaacacaaaaaaattagccgggtgtagttgtgggcacctgtagtcccagctacttgggaggctgaggcaggagaatggcgtgaacccgggaggcggagcttgcagtgagccgagatcgcgccactgcactccagcctgggcaacagagcaagactccatctcgaaaaaaaaaaaattcatcacttttaatagctcttatgctttctctggttgtgggcatgcttcctagcttttatatatctttgtatgggaaatcagggattgggggccagta

SEQ ID NO: 20890 - DNA, 1059 bp, Homo sapiens
tgtattttcttcccagaaatatctccaatagtcttttctctctcctgttctccatgtaactttgagaaactttatccttcagaaatatctaagcaacattgcttgtaaaatatttaaaatttctaagattgtgccagtatgaaaagtcatattattcctggggccatttagattctgtgtctgagaggaacattaactgaaacttggaaaataaaagtgttgttataataagaaaaaaaaaaaagagagaaggagaagaacttgaggctcgtgggcgctcagccttctcttgtgtctttttagaccctgtccctgccagtggtggtgatcgttcatggcagccaggacaacaatgcgacggccactgttctctgggacaatgcttttgcagagcctgtgagtgtattcctcgggcatgtgggtcccaaaatcaatgccggtgtcatgaatctcatttatgtattatccttttaaaaagcataggaaaaggccgggtgcagtgactcacacttgtaatcccagcactttgggaggccgaggcggttggatcacctgaggtcaggagttcgagaccagcctggccaacatagcaaaatcctgtttctattaaaaaataccgaaaaattagctgggtgtggtggcacatgcctgtagtcccagctacttgggaggctgaggcacgacaatcacttgaacccgagcggcagaggttgcagtgagccgagatcgcaccactgcactccagcctgggtgacagagtgagactccatctcaataataaaaaaaaagcataggaaaaaagacgctgttttctttagtgggaggcagaatagaaagaatgtggaaagtggaaagaacatgggcttgacatcgggccagggtttgaactgagactccaccatttcctcactccatgaccacatgggcagttcactttacctctctgagcctgagtttccagcaagtgtctgcagcacagggatactcttgctctacagcattgttaggaagattaaattagataacatagaaaatgcttgccacacagtcagtactcag

SEQ ID NO: 20891 - DNA, 1056 bp, Homo sapiens
ccagtttgtccttccctctctctctttcttccttttttctttctttttcattctcatttttctgagtagttgctgaagacacagcctgaccctaggggtccaaatatagatgaaacaatcatagctctctagcagttcacctggagggagagagaaaaagagagtaagagaaccaaaatgaaggggaaatattcttaatttttttttttttaaggacagaaactaacttgttgaggaaaaagagaaatatactgggagttctgactgataggaacaaagagaggacagcttcgaaggatgatttgaaaagtaatctatggaatttagctttaaagcaggatcttgggctgtagactactttattattattattttttaagagacagagtgcagtggtgcagtcatggctcactgtagcctcaaactcctgggctcaagccatcctcccacctcagccttctgagtagctaggattacaggtacataccagcacgcctggctaattttttaatttttattttgtagagatgaggtcttgctgtgttgcccaggctggtcttgaactcctggcctcaagtgatcctcctgcctcagcatcccaaagtgctgggatgttgtggactcctttagagcctcttgaaatagggctagtaaagtgattttctaccactgtatctgtgctcatttacattgggcagatcacttctgcttgacttcatagtttcaacctataacatgaggggtcaacaggtagattcggaaccatcagagtttaggccgaagcccatagaatatgaaagttatttttaaaatttatttttacaatgtctacaaatgcagttgttaaagtgccagagacagaagtattgacaatgagaaattatccaaaaccaggccaggcgcggtgactcacgcctgtaatcccagcactttgggaggcaaaggtggcaagatgacttgaggccaggagtcacaggctgcaatgagttgtgttcatgccactgctctccagtctgggccacagaacaagaccctgtctctaaaaataatcatcat

SEQ ID NO: 20892 - DNA, 1033 bp, Homo sapiens
gcttgtactcccagcagtttgggaggccgaggcgggcggatcacgaggtcaggagtttgagaccagcctggccaacatagtgaaaccccgtctctactaaaaatacaaaaattagccgggcgtggtggggcatgcctgtagtcccagctactcgggaggctgaggcaggagaatcgcttgaacctgggaggtggaggctgcagtgagccaagatcgccccactgcacaccagcccgggtgacagtatttcatctcaaaaaaaaaaaaaaaaaaaagaacacaattattgtactacttactagccctcctctgtccccagctaaaaataagaacagcaacaaccaaaaaatccttagttatgtactggaaatgaattagataattttcaataacttacacgtttttaggatatgttagtttgaaaatgcaaatattcatgcatgaccccagtgttaatctatgatggagcaggtatagtgggatgctgtttcatgatttaatttggaccttcagggagtagactgtgatgcctctgcatttgtatccaagacaaataattaaatagtctatttttggctgggcatgatgcctcatgcctgcagtcccagcactttgggaggctgaggtgggaggatcgcttgaggccaggagttcaagatcagtctgggcaacaaaatgagaccttgtctctacaaaaactacaaaaaattagctgaacattgtggcttgtgcccctagtcccagctactcaggtccctgagttaggaggattgcttgagcccaggagttggaggttacagtgatctatatttgccactgcactccagcctgggtgacagagagagaccctgtctcaaaaaataaagtctgtttttaaaattaattttaaacactggagtttattacaaaaagcagttggttctttttttaaatcatttttttttaggagaaccaccgctttttggctacattgtctagagtagcagtgttcaataaaaataagatccaagtcacatatgtaatgttaagtttt

SEQ ID NO: 20893 - DNA, 1044 bp, Homo sapiens
gcccgccactacgcctggctaattttttttttttttttaattagagacgaggtttctccatgttggtcaggctggtcttgaactccccgttctcaggtgatccgcctgcctcagcctcccaaagtgctgagattacaggtgtgagccaccgtgccccgcctgttttggcttttactgtgaagacgtgttagccgctgtgatgactagcaagtgtggccctccacccagtcgctctgggctcccagctcctgcatcctgctgcaaacttgacatcttccctcaagtaacttgtagttgtctcctgtctacttgcccaaaatataactcttaaacttttctctctgcaagtttgtgcctctctccctgtctgacttccccatctaaataaatggtagaccaccatctactcctttgtgcaagccagaaatctaggaatcatccttaaattccctgttctgtcttatctctgctttcattcaaagcatcagcaaatcctgttggttctacctctgaagttttctcaaatactgttacttgactcatcctgacttttgtttctgctttatgttaggctaaatgccctgaaaactcttttgtacaaaacacctagaaatactggataaactgggcttaacagggaggcccggtgtggtggctcacgcctgtaatcccagaactttgggaggccaaggtgggtggatcacctgaggtcaggagttccagaccagcctggccaatacgtagtgaaaccccacctctactaaaaaaaaaaaaaaaaattagctgggtgttgtggtgcacacctgtaggtggtgcatgcttgaacttgggaggcggaggttgcagcgagctgagatcgcgccactgcacttcagcctgggtgacagagcaggattctgtctcttaaaaaaaaaaacaaaaaaagaaaaacaggaaaatcttcagaagcaaaaaccaaacaatctcaccaaagaaatgagaagatggctgggcgcggtggctcacgcctgtaatcccagcactttgggaggccgaggcgggcag

SEQ ID NO: 20894 - DNA, 1046 bp, Homo sapiens
attatcttggccacctcaggttctctttggctgagtgattgactggaaaacgcaatgtgaattcatgcttcagactgggttcttttttttttttttttttgagatggagtttcactcttattgcccaggctggagtgcaatggcacgatctcagctcactgcaacctctgcctcccaggttcaagcgattctcctgcctcaggctcccgagtagctgggattacaggcatgcaccaccatgcctggctaatttttttgtatttttagtagagacggggtttcactgtgttggtcagactggtttcaaactcctgacctcaggtgatccacctgcttcagtctcccaaagtgctgggattacaggcatgagccaccgcacccagcccaggctaggttctatatgggtgtgctttttagaatttagatcatgggctatccccaacacaaactggataatgtttctttctagattctctctaagcgtgtattctctttctttcctaggcacagccaccacttcacttacattgtgggattataatttcatgagtagtggaatttccttaaccttctcttgtgtgggagctgaaggacaaaatgagatattctctgaagagtggttacatcatgcaaaactatgatgtgtaatgaggtcacttagttttctaagtacattatacattttgataagattttcatagaaaagcttgtctccttggggagatcactcatcttccatcttgactattatttaaactttatgggtcagatttatctttttaaaaacttaaccataaagctcaattaattttttttttttttttttgagacggagtctcgctctgttgcccaggctggagtgtagtggcgcgatctcggctcactgcaagctctgcctcccaggttcatgccattctcctgcctcagcctcctgactagatgggactacaggcgcccgccacgatgcccggctaattttttgtatttttagtagagacggggtttcaccgtgttaggatggtctcgatctcctgacctcgtgatcc

SEQ ID NO: 20895 - DNA, 1097 bp, Homo sapiens
tatgcccggctaatttttcttttggtatttttagtagaaatggggtttcaccatgttggccaggctggtctcaaactcctgacctcaagtgagctgactgccttggcctcccagagtgctgggattagtcgtcatcttttgttaaaccaggatttgatttttttcttttcttttcttttcttttttttttttttgagacagagtctctctctgttgcccaggctggagtgcagtggcacaatctcggctcactgcagcctccgcctgccgggtcaagcgattctcctacctcagcctcctcagtagctgagattacaggcatgcaccaccatgcccggctaatttttttgtgtttttagtagagatggggtttcaccgtgctggccaggctggtctagaactcctgactgcaaatgatcagcccgcctcagccacccaaagtgttgggattacaggtgtgagccactgtgcccagcgtgatttttttttttttttaaagcaaacttgtcctttggttttgcagaacaggcctgctccctctcatctagcccatcatttcttggggcctgaaccccagtggtccaaagtattgcttgtgaaatttaaaaaatgtgaatatgatgtggggatgggcctcttctacattaccttggcccagggggatcagctggctgggaggattagtgagcacctctgtattttgaggtctgagtcttctggagctgtgtagttaatcttcggtttctgataacccctgggtccatctggccatcagcctcagcagtgagcaaagcaataccatactcatttctatgttcctgttccttcctctgctcctcctttggagaagcaataattcatgggggatgatacagtagcactttacaaatggctccatgtcattcatcccaggggccataatctcttgcaccacctattcttacttcctgttcagctcctttacagcttttattttcaactgcttcccaacttggtggggcctcctttaaggatgagccaatagtaagaatgtggctgtaatcagcagagacccctctgaggggtatctgttctgcagcccctagtgaaatcatgtg

SEQ ID NO: 20896 - DNA, 1017 bp, Homo sapiens
ctgctgtggtttattttggttttgctttatttattttctttctaaggggcacatccaccatttcctcccccttagcagcagtggtgtcagtcagactatgctcacttttatccctggattgcaatcacagggaattggaatggtctgagtgcaaggaagaaaacgtttctaagcacaaagggccttggagctggggacaggtttacacacgtggattgggctgcttgctcatagggtggagttgtcagaacaagtttgtcctccttgtacctaaattcagatttcaacctggtgagccaagaagaaagtcatgcttcacctccaaagcacctgggcctagtcactccccaaaccccatttaaaaccggaagcactggctgcctgcacagcaagatggggggaccctcaacaccctcctttcacagctcccccttctctctcccatagctggggctttgtgcaccctcggttgctcagcgtgcccgagctctgccaccatgtagctgaagtctgggttagtgggaccattttcataaggaatgttttgcttttcaaaaagcaaaacccaggcaaggtaagactcttccctttttcactttcatctctggcctctcagttcagttcatgctaaactgaaacagctcctttactatgtgtcttcattcaagaaagtaaagactatgatgttcatagagacaaaaggaagctataggaaaggccttctgaccagccattaggactaacacaggagcttggtgactgctcatttggtgtggttgccacttagatgaggccgttttcttgcttcaagataggaaagaaagctttcttgtgtacattctgtgtcatattaaatatgtgataggttgttgtgtttttttgggttttgtgtgtgtttctgttgacttaaaaaaccaccaccaacattgctttcagagagaatttttggctaagtcctattcaaaccaatttcttggcaggaaaggtgcagccctatggggttagccatgtaaaagg

SEQ ID NO: 20897 - DNA, 1031 bp, Homo sapiens
tatgccaactttctgtgtgaccttaatcaaatatttttcaggcctcagttcctagatctgtaaaaagatatgtaattgaattaaatgctcttgagtgcatctctgtcagtttgttgccctacactagggtctaatttggtagaaagatgtttgctttcattataacaacttgttatcaaggatgaatttctccgtgaaattaatagagatatagactggaaagcagaaggagctttaagaggttatttgatttagtcctctgcctttacagcagcaaattattttctctgccccataggtagagtagttaaggtccagaaggtttaaatgatttaccctaggtgtataactagttaagtgtcagaacaaaaaaagctagacctcaagtctgtttaccacagagcccatcgtacacacgtggccttttctgaaattaggataactaggtaaatgatctttcttctgtttttcttcctctgtaggttttttgccctgacatctcttcgtcttgtgtttttacttgcatttggcttgatgatcattgtgtgtattgatcaatggaagaacaaaatctggcctgaaataaaaggtgagtttggtagcatttagaacaatctgaactgaagatggcctttcctataatttgtacctttagtattaggggtttatgaggaggtgtatggagctggggactgtcttttgaagtctgaatcatttgctttaggaggcacttgaagggcttgtgccccaattatggttccttagagctgggttctgcccttcccattgttactaagcacaggaaatctgtactcaccacctgagttatttttgccaacataatggcctgaggaataagtagtcctcaaatgaaaaataataaattatcgttattggacactgcatctttattgaggcagtacctctcaggaattccttttacattgctcatttgcaaaacactaggctaggcaattgtgacttatagaaagtaccatgatggccgggcgcagtggctaacgcctattagt

SEQ ID NO: 20898 - DNA, 1068 bp, Homo sapiens
ctgaggagcagtggacaaaagctctcaagttcatgctgacgaatcttaagtggggtcttgcttgggtgtcctcacaattttataacaaatgacttttttccttagggggaggtttgccttaaaggcttttaattttgttttgtttgcaaacatgttttaaattaaattcgggtaatattaaacagtacatgtttacaataccaaaaaagaaaaaatccacaaaagccactttattttaaaatatcatgtgacagatactttccagagctacaacatgccatctatagttgccagccctggtcagttttgattcttaaccccatggactcctttccctttcttctctgaaaaaaactaatttaaatttgcttttcttttttttaactgagttgaattgagattgatgtgttttcactggatttttatctctctcaacttcctgcacttaacaatatgaaatagaaacttttgtctttactgagatgaggatatgtttgagatgcacagttggataatgtgggaaaatgacatctaagctttacctggtcaccatgtgatgtgatcagatgcttgaaatttaacacttttcacttggttcttatactgaatgccgactctgctctgtgttagagatatgaaatggtgtttgatactgtttgagacattatggagagatttaattatttgtaataaaagatttgctgcagtctgaaaactgcccaggggtgcactgttgggtttttctttaaaatagagtactttgtattctgggagaatcaagttctaatgaatgcaggtatgtggaaattctgttgaaacttctttagagttagttttagttttaaaaaaagactctagtaaaaatagatagctgttgaggaagccttgtttgtgtagatctgaataatggaacagagatgttaaactaattttaaggggaaataaaggctacctccttgatgcttagtcaaggtcacccagatagtctgtatttgagcccctgattaatactgattgcaatgcctgatgttcctcttaatgaaattaagctaaaagtataaatacctt

SEQ ID NO: 20899 - DNA, 1032 bp, Homo sapiens
catctcaaaataaataaataaataaatacaaaaataaataaaaataaatatgtaaaatgaaataaattttatttaattttatttgttatttttatttttttttgagacagagtctcactttgttgcccaggctggagtgccgtggtgcaatcttggctcactgcaacttccacccctgggattcaagcaactcagcctcctgagtagctgggattacaggtgcatgccaccacacccggctaatttttgtatttttagtagagacgaggtttcaccacgttgtttcaggctggtctcaaactcttgacctcatgatccacttgccttggcctctcaaagtgctgggattacaggagtgagccaccgcgcctgactgaaataaattttaaaaaatgaaaatattatgtcactcctctgcttaaagctcttcagaggcttcctgtaggtcttcgtgtaaagccaaactttttaccatggcatacaagctgtatctgggtggctcttgtctactgctgtagcctcatctggtgtcccttgacctcttgctggctgcatcctggccttgcttgtcatctctggattcctttgacatgcgctacttctttcttccttaaggcctttggctgtcttgttccctcttccttgatagttcctcctctttctccttttcttcctcctcctcttcctcttctttctcctcatcatcactcttgtcaatcagggatgctgctgtatctcttatgtcaagccctgtgccttgcatttggtaggtactcaataaatacttgttgaatggatgaatgctgcatattggaacttaagttcactgggcacagtggctcacacctgtaatcccagcattttgggaggccaaggcaggtggatcacttgaggtcaagagttcaagaccagcttggccaacgtggtgaaaccccatctctactaaaagtagaaaaattagccgggcacggtgatgcacgtctataatcccagcaactcaggaggctgaggcacgagaattgcttgatcctg

SEQ ID NO: 20900 - DNA, 1115 bp, Homo sapiens
aaccagtcaggcgtggcggtgcgtgcctgcaatcgcaggcactcggcaggctgaggcaggagaatcaggcagggaggttgcagtgagccgagatggcagcagtacagtccagcttcggctccgcatgagagggagaccgtggaaagagagggagaccatggggagggggagggggagggggagagggagagggagagagagagggcataatgcctatgttgctttatgatacaattatctttccagatgtgttgtctcctcagtcaatcggctcctggagggtgggacttctttttttttttttttttttttttgagatgcagtcttgctctgtcacccaggctggggtgcagtggcacgatcttggctcactgcgacctccgcctcccaggctcaagcaattctcctgcctcagcctcccgagtagctgggactacaggtgcccgtcaccacgcccggataatttttgtatttttactagagacgaggtttcaccatattggccaggctggtctcgaactcctgaccttgtgatcctcctgcctcggccttccaaagtgctgagattacaggcatgagccaccacgcctggccggagggtaggacttctgagattttcagactctatcatgcctagctttgtgtgtagattggcaggttcctggtcaaaggagtgcagttgggaggactagggacctactgaccctcttttccccaggcgtgctcccatgcatatgcccacactctcccacacactcctgctcctgccctcctggcctgtgactcttggtgcctcttcttgcagccagtgtggctgtctgtggactttgataactggagagactgggaaggggatgaagagatggagctggctcatgtggaacattatgcagaggtgagagacaacacctactgtgttctgcccacttgatcattctttgtgtttctctgcacacatgtctctggaggattgtcactggggccaagcagagatatgcaagctctctaggcaggttactcattgatgctgatattctttacgtattttgtgcaatgtttatttaatagggatgagaggaaagaatattattgaaattatatacattgattcactt

SEQ ID NO: 20901 - DNA, 1034 bp, Homo sapiens
caagattgcgccactgcactctagcctggggacaagagggagacttcatctcaaaaaaaaaaaaaaaatcccagctgggcacagcggctcacttctgtaatcccagcactttaggaggccaaggcaggaggatcacttgagcccaggagttcaagactagcctgggcaacatagtaagaccctgtctctacaaaaaaatttaaaaattaattgggtgtcgtagcacactcttgtattcccagctactcaggaggctgaggtgagaagaatgcttgagtctgggaggtcgaggctgcagtgagccatgatggtgctactgcactccagcctggccaacattgtgagaccttgtctcaaaacaaaacaaaacatccttctactgagcactttctgtccctttatagaaacttaagagggaaccagtagaggtaatttcctaaggaaaactgctttgggacatgatcacaaatgaagcctggagttttgaactgctgaggtcagcctgtttttaccttctgagcctatcaagtaattgttccagatgccaagaaaagctgctggccttatttctgcttctgcctttaccacaggggagcgccatgtgagccagtcctctgtttttcctccactgtatgctaggcagtattagcaccagattcttcccctctttaaaaagaaattctagtgctttggattttttcctccatgcagaatagcaatgatggaaagtatgtggtcaaagtaatgacattctgaaaatactaaatgtcaccatagtatttttctctggaagagaaatgtatatgtagaggtgaaacttcaaatttctttttttttttttttaagacgaagctttgctcttcttgcccaggctgaagtacaatggcgtgatcttggctcaccgcaatctctgcctccagggttcaagtgattctcctgcctcagcctcctaagtagctaggattacaggcatgtgccaccacgcccagctgattttgtatttttagtagagatggggtttctccatgttggtc

SEQ ID NO: 20902 - DNA, 1022 bp, Homo sapiens
caggggaatattagagggttaggactccccaggtagacattctaggggtgaaaatttgtcattacattgacatttcagatttaggttttcaacaatactgttttcttctttcacatattgccatctagtaatatagatgttctccgtccacattaatcaaaactattgacatggataattcctaattccttgaacactataatggagatctatagctagccttggcgtctagaagatgggtgttgagaagagggagtggacagatatttcctctggtcttaacttcatatcagcctcccctagacttccaaatatccatacctgctggttataattagtggtgttttcagcctctgattctgtcaccaggggttttagaatcataaatccagattgatcttgggagtgtaaaaaactgaggctctttagcttcttaggacagcacttcctgattttgttttcaacttctaatcctttgagtgtttttcattctgcagatgctgagtttgtgtgtgaacggacactgaaatattttctaggaattgcgggaggaaaatgggtagttagctatttctgtaagtataatactatttctcccctcctccctttaacacctcagaattgcatttttacacctaacgtttaacacctaaggtttttgctgatgctgagtctgagttaccaaaaggtctttaattgtaatactaaactacttttatctttaatatcactttgttcagataagctggtgatgctgggaaaatgggtctcttttataactaataggacctaatctgctcctagcaatgttagcatatgagctagggatttatttaatagtcggcaggaatccatgtgcagcaggcaaacttataatgtttaaattaaacatcaactctgtctccagaaggaaactgctgctacaagccttattaaagggctgtggctttagagggaaggacctctcctctgtcattcttcctgtgctcttttgtgaatcgctgacctctctatctccgtga

SEQ ID NO: 20903 - DNA, 1103 bp, Homo sapiens
ttgtgcaacacgtaaatactggtgtgagtggctgtggctatggctagtaaatgatggcccttggtaaacaaagttatttatcagacaatacctaccagctaggtcaactgtgcccataattgatctggttaatttcttttgctgcctattgatttttatttggttgatagataatagctagaggactctaaatttctttggggaagaacatgaaccccttctaagccttcttacgagagaattgatcgcttttgcactgacctttagtaacatcctgatttcagtgttttgtaactatcagagggttgagtcttggttttaagccatgtatatctgtagcataactttctgtgtaggctagttacctctcagcttataaagtgtaggctgataaatttatagtacagtagagtgtcactatgcaaagaaacgatcttagggaatcgaatgatatctgctattaaagcaaaattaatatatattttttctttttacttttttttttttttaaagacatgaaatctcactgtattgcccaggctggtcttggtctcagactcttgagctcaagcagtcctcccacctcagcttcccaaagtgctgggattataggcatgagctgccgtgtctggcccagtatatattttttaagttttaagttttgtggtacgtagtaggtttataatattattttgaatccttagttgtaattttatgtctgctgatgtgtacataatttttattaaactatttatttgagacttcaggtatcttttttttttttttgagacggagtctcgcactctcgcccaggctagagtgcagtggcgccatctcggcttactgcaagctctgcttcctgggttcacgccattctcctgcctcagcctcctgagtagctgagactacaggtgcccgccaccacgcctggctaattttttgtatttttagtagagacagggtttcaccgtgttagccaggatggtctcgatctcctgaccttgtgatctgcccgcctcagcctcccaaagtgctgagattacaggcgtgagccaccgcgcccagccgagacttcaggtgtcttagaattttttaaatgtacc

SEQ ID NO: 20904 - DNA, 1035 bp, Homo sapiens
ttcctcctaaggtgcttttcatagaaaaaagtccttcacacagctaggacgtcatctttgactgaatgagctttaacatcctaattactggtggacttacttctggtttcattttataaaagcaaatccaggtgtcccaaagcaaggaatttaatcattttgtgtgacatgaaagtaaatccagtcctgccaatgagaagaaaaagacacagcaagttgcagcgtttatagtctgcttttacatctgaacctctgtttttgttatttaaggtgaagcagcatctgggtgtgagagtgaaacaagcgtctctgaagactgctcagggctatcctctcagagtgacattttaaccactcaggtaaaaagcgtgtgtgtgtgtgcacatgcgtgtgtgtggtgtcctttgcattcagtagtatgtatcccacattcttaggtttgctgacatcatctctttgaattaatggcacaattgtttgtggttcattgtctccttaaattagactgtaagcaccttgatggaactcatactaccttttatttcacacacacgcacacgcgcacacacagcctacacatacactgcctagctcattgtagcatactaaatactgattttaatgaataagctaaaccttcgaaacccatttgctaatcccagcactttgggaggccaaggtgggtggatcacctcaggtcagaagtttgagaccagcctggccaacatggtgaaaccccacatctactaaaaatacaaaaattagctgggcgtggtggccaatgccttgtaatcccagctattctggaggctgagacaggagaatcgcctgaacctgggaggcggaggttgcactgagctgggattgtaccactgcactccagcctgggtgacaaagtgagactccatctcaaaaacaaacaaacaaaaacacatcatttcccctatagcaaaaacatgacggcacttactgtatcaagagaggtgagaaaaaggagccacagcaggatgattcaagggactctgcatagctcca

SEQ ID NO: 20905 - DNA, 1018 bp, Homo sapiens
attgaagacaaaatatttgggaaaacctatcggaagaaggcaagcctccccaacttaagccatgtaactgaaaatctaattataggagcatttgttactgagccacagataatacaagagcgtcccctcacaaataaattaaagcgtaaaaggagacctacatcaggccttcatcctgaggattttatcaagaaagcagatttggcagttcaaaagactcctgaaatgataaatcagggaactaaccaaacggagcagaatggtcaagtgatgaatattactaatagtggtcatgagaataaaacaaaaggtgattctattcagaatgagaaaaatcctaacccaatagaatcactcgaaaaagaatctgctttcaaaacgaaagctgaacctataagcagcagtataagcaatatggaactcgaattaaatatccacaattcaaaagcacctaaaaagaataggctgaggaggaagtcttctaccaggcatattcatgcgcttgaactagtagtcagtagaaatctaagcccacctaattgtactgaattgcaaattgatagttgttctagcagtgaagagataaagaaaaaaaagtacaaccaaatgccagtcaggcacagcagaaacctacaactcatggaaggtaaagaacctgcaactggagccaagaagagtaacaagccaaatgaacagacaagtaaaagacatgacagcgatactttcccagagctgaagttaacaaatgcacctggttcttttactaagtgttcaaataccagtgaacttaaagaatttgtcaatcctagccttccaagagaagaaaaagaagagaaactagaaacagttaaagtgtctaataatgctgaagaccccaaagatctcatgttaagtggagaaagggttttgcaaactgaaagatctgtagagagtagcagtatttcattggtacctggtactgattatggcactcaggaaagtatctcgttactggaagttagcactctagggaaggcaa

SEQ ID NO: 20906 - DNA, 1030 bp, Homo sapiens
gagcaggactctgtacaccccccaaaacaaaaaaaaaagttatcagatgtgattggaatgtatatcaagtatcagcttcaaaatatgctatattaatacttcaaaaattacacaaataatacataatcaggtttgaaaaatttaagacaacagaaaaaaaaattcaaatcacacatatcccacacattttattattactactactattattttgtagagactgggtctcactctgttgcttatgctggtcttgaactcctggcctcaagcagtcctgctccagcctcccaaagtgctgggattataggcatgagctaccgctcccagccccagacattttagtgtgtaaattcctgggcattttttccaggcatcatacatgttagctgactgatgatggtcaatttattttgtccatggtgtcaagtttctcttcaggaggaaaagcacagaactggccaacaattgcttgactgttctttaccatactgtttagcaggaaaccagtctcagtgtccaactctctaaccttggaactgtgagaactctgaggacaaagcagcggatacaacctcaaaagacgtctgtctacattgaattgggtaagggtctcaggttttttaagtatttaataataattgctggattccttatcttatagttttgccaaaaatcttggtcataatttgtatttgtggtaggcagctttgggaagtgaattttatgagccctatggtgagttataaaaaatgtaaaagacgcagttcccaccttgaagaatcttactttaaaaagggagcaaaagaggccaggcatggtggctcacacctgtaatcccagcactttgggaggccaaagtgggtggatcacctgaggtcgggagttcgagaccagcctagccaacatggagaaactctgtctgtaccaaaaaataaaaaattagccaggtgtggtggcacataactgtaatcccagctactcgggaggctgaggcaggagaatcacttgaacccgggaggtggaggttgcg

SEQ ID NO: 20907 - DNA, 1056 bp, Homo sapiens
ttttgagatggattcttgctctgttgcccaggctggagtacagtggtgccgtcttggttcactgcaacttctacctcccaggttcaagtgcttctcctgcctgagcctcctgagtagctaggattacaggcgtgtgccaccatgcccagctaattttgtattcttagtagagacggggtttcaccatgttgtcaggatgttcttgatctcctgacctcgtgatctgcccacctcggcctcctaaagtgctgggattacaggcgtgagcctccgcgccaggccttaagattaatttttaatggttttttagactcatatgtatggaaacttctaggatggggaccatatttcacttccttttaatacagtacccagtatagcacaatttgcagttatgtcttaatatgtgattcctgatcatgactggaaacagtgttatttgtggtagctatagggtaggtaagtttttcagcctgttttaggtttcttgacctaaaattccttctgctggactctaagtcactattggcagctatttctgacgattggtagttctttgtaactttttacctatgactgtaacatttttgactttcagaagaatttgctaaaatgtgttccccggtgggttgttgtttttcaacctaaacctagctgctttttccagtcacttatccgtattggaagctcaaaatgcaaatatacagtaggcctaaaatattgcctggtttgaaaagtgtttaaaatatttgaatcatttttatagtaaacatttactctcatcaggacctagaaggggaacattttaatttttttccttttcccttttcacagtcttccttcaacattcattacctttttacatattggagttttcatctgttcacagtttatgtttacagtgtgtttatatagtgtagattataattaccatactgaaatataattatttcagaattgagtcagtggtgagaatgaaagccatctggtatgataactgaatccaatttttcttttacggagaatttctttgaaatgtagcttatctcagaaata

SEQ ID NO: 20908 - DNA, 1022 bp, Homo sapiens
tctgggtcctaaaagcctcaatcattagacaatactatatagcaagagtggagaaggacttcacccttcctgtaggaagactacatggtggagttcaaaccacacagagaaaaatccattcagtaaatttccaaagttgcagaccgtttaggcccacccagaatcccaccgggactggacagcccccactgggctatactggatatgtggacatagagcctacactaagctgcctgacaagtagttgtgttattggcactattaaaccatctttcttcctactgtccataaaaacaggagaactcctgggcttccctgtctatgcttcccgtgaaaagcatagctataagaaattgaaacaatgataaatggccccctgagagaatcatacagtattatgggcctgctacttaggcacaagatggctcgtggggataccggatccccatttatatgatcaactgaatcatacggttacaagctgtcttaaaaataatcactgcaaccggcagagccttgactattctggcccagcaagaaactcagatgagaaatgctatctatcaaaatagattagctctcgactacttgctagcagctgaaggagaggtctgtaggaaatttaaccttactaattgctgcctacacatagataaccaagggcaagtagttgaagacatagttagagatatgacaaaagtggcacatgtgcccgtgcaagtgtggcatggatttgatcctggggccatgtttagaaaatggttcccagcgctaggaggatttaaaactcttataataagagttataatagtaataggaacctacttactgctccctcgtttgctacctgtacttcttcaaatgataaaaagcttcatcgctaccttagtataccaaaatgcatcagcacaagtgtactatataaatcactattgatctgtctagcaagaagacatgggtagtaaacatgaaacaactcctgctattgagtgagagtctcaaagtgggggaataagggagga

SEQ ID NO: 20909 - DNA, 1028 bp, Homo sapiens
agagtgtccagtgtgtgcccacctgtgggatccaggccttggcttcccaagttttccagaaggttcctttcaagtggttatctggcccagctcacgggcccgcccatccccttgtgtccctgcagacgactaagctaccggagagccgcgggcaccctgccgagcccccagagcctcaggaagcccccctgtgagtagattgtcagggatggcactccagggagggcccggggttagggcgagggaggattcaggctgggaagaagtaggcagtgggctggagggggcatcaggggtcttgtctgagctcatggactccagaggaaggagggggtgggaagtaggaggtggggggcagctagtccctggagaggagcttgtatatttggagtccatagatgatgctggggggtatgttaacagctttcccaaaatgtgcagatgtgtgtgtgttcacacgcgtgtgcatgtgcgtgtgaggatccacagctttcgttagattcccaagggctctctgaccttgaaaatggaagaagcactggcgttggaagggaatggagaaggccatgtgtgacctggtgcctctggtagggctgccagattgccagactgggcaaatacaaataaaggatgcccagttgaagcttgaatttcagatagatgacagattggtttctagtataagtatgtttttatgtagtttttattatagtataagtatgtcctgtgcaatatttgaggcatacttatactaagaagttacttgttgtttatttgaaattcaagtttaagtgggtgtcctgcattttatctggcaactctacaccgtgtagcactttacactttagaaaacatgtccacctacttcttggaaccctgtgaagtcggtagagtcagctatcttttctaagctgggaatatgtagggtcacaaggttaagtgagcagagttggggtcacattttctgaaggcctgtgatcagagccccagggtagggccccgtgcagagaggaagcttttccagagca

SEQ ID NO: 20910 - DNA, 1077 bp, Homo sapiens
tagacttagagaaggtgagagagggagaagggaagagaccttgtaagatctataaaacctaagagatacgatgagtggaggtgattaattaatgggaaacagcaagcctgggaggaagctcttcatcatgtgtcccacatcttcctgtccccccccattggtcttaattctgtaaatggggggaagtgagtaccaactgggtttggcaggaagcacttttgactccttagttttagttgttaaatgatgtggaactttaaacagttcaggaggtggagttagtgtggttggaaaggcaggcagtgaggtgtggaataaagaacaagggctttgataacttcattcctcatgttgttcctggataagtcatttcatctttcttagccttaaatttcccaactgtaaatgtggaaataatgtccatctcctagggttgatatgaagggttaataagatattttaaaagcctaatacttagaaagtgctctgtaaatgttagtataaatgttagcttgatccttggacagttaaatctggaggtgagattggagtagatgatttctagaagttccatgtttgctttagaagccttagtttagaccaggtgcagtggcttatgcctgtagtcccagcactttgcgaggccaaggcaggagctcaagaccattctgggtggcatagtgagaccccccatctctacagaaaatacgtttaaaaaaaattaggcagatgcgatggtacatgcctgtagtcccaactacttgggagactgaggtgggaggatcacttgagccagggaggttgaggctgcagtgagttgtgatcgtaccactgcactccaggatgcactccaacctggtgacagcaagatactgtctctttaaaaaaaaaaaaaaaaaaaaaaatttgtttagatggtatttgaagggaggctaatatgtaaagcacctgggcagatctggttcaggcaggggtaggggtctcagagccctgccctgggtctcacagatctcaccccttaacccttccttggagtgcctaagaatgcttttgattataatttttttttgagatgaa

SEQ ID NO: 20911 - DNA, 1046 bp, Homo sapiens
tttagtagagacggggtttcaccatgttggccaggttggtctcaaactcctgacctcaggtgatccgcctgcctcggcctcacaaagtactgggattataggcgtgagccactgggcccagccagtgcctctttttatttaaggaactgatgtttggggacaaattgtgtgttctcgcgcgtgtttgcacatgtgctgcagcattgttagactcagctgttcatgttcatgggtctgaagagtctccagattatttgttggacttttaagatgcattgtttgcctttaatttgttttaactaccttgtctagcacatttgttttgtcttacactcaaacaaatttgtacctctggaatctctagcaaccagtagtgtggggtagggatcagaaatgtgctggagaggtgatagggattgacagggtagaagttacgagattgtagtagactaccagattttactagattttcttttgatcagtttgtggatggttccaccagagggcagtgaaggaacagacatgacgtagaattcagactcttcgtttttctcaaaagcaggacagggttgcctttagctaaagttaaaggtggacagcgtttatggttagatttacttgagtcctggctccctatgtgagcacagataatgttctgtaagagtttttagagtctcagattgtggtctgtgaaggtgtggtatgtattaatttttaaactggaggctctagcacaacagctgataaatcttaattttcgccttgaatggaaattctgtgtgtgtgtgtgtgtttgtgtgtgtgtgtgtgtgtgtgtgtgtgtgtgtgtgtgtgtgtttgttttttttttttttaaagagacagagtctcacttctttgcccaggctggagtacagtagcatgatctcggcacactgcaacatctgcctgctgtgttcaagtgattctgctgcctcagccttctgagtagctgggattacaggcacgcaccaccatgcccggctaatttttgtaattttagtagagacggggtttcaccatgttgg

SEQ ID NO: 20912 - DNA, 1064 bp, Homo sapiens
atgtaggtttagtttttctctttattcctggatgttatcagtagatcttaagaagtagcttaactcccaaataagttgagagcttgcttctgcctttatgaaagaggactttttaaatcttggagttcatgatgaactaatagtgctgctggggtttgggtggtggcgttacctatgaatgtcttcaaattgtgtatatgtggatgtgtgcatacgtgaatatatgcattttctgcttgaagatctaaagtgtttttcagattctcggagggtttcatgacttagaaaagtttgaaagccactgtcttaaaggttcttttttgtctttatgtttgaattttgagttctaacagttacatgcttagcatattttaatcttgcacataaaagttgatctctgggaacccccaagtcacttttgtgtgtgtatgtgtgagacagggtcttgctttgttgcccaggttgaacttgaacgcctgggctcaagtgaccctcctgcctcggccttctgagtagctgggattacatgcatgcgtcaccatgcctgcccaagtctttctttttattggagccactgcgcccggcgttttttttgagacagagtctctctgtgtcgcccaggctggagtgcagtgacgcgatctcggctcactgtaacctccgcctcccaggttaagtgattctcgtgcctcagcctctggagtagttgggactacaggtgtgtgccacgacgcctggccaaattttttttttttttggagacaggcacacactgtcacacccggctaatttgttttattttagtagagacggggtttcattctgttgcccaggctggtcttgaactcctgagctcaggcagtctgcttgcctcggcctcccaaagtggtaagattataggtgtgagccactgctcctggctcaatttttgtattattagtagagatggggtttcaccatgctggccaggctgatcttgaacttctgacctcaagtgatctgcctgcctcagcctcccaaagtgctgggattacaggtgtcagccaccatgcccggccctaagt

SEQ ID NO: 20913 - DNA, 1029 bp, Homo sapiens
gggagccacggaggcccatggtggtgttggtacctggggagtctgggctcctagtgggaggaccacactgatctgactgcccctccaggcagagcagaggtcagtggagtgagatctggaggcaggggtgagggcaggggcaatgtttgggactcccaggtggtgagaatagccctctccccaactctggtgccaggttggtggaggaccaggcgtggggtacaatgtgaacgtggcatggacaggaggtgtggacccccccattggagacgtggagtaccttacagccttcaggtagggactgaaaagggccatggtagtcagtgggagcccctctgggccctgcagtgggaggggcagaaggcactcagttcagtgtgggtagagggggttgtctctgggaggataacagtggggcgaggcctggcctggtcatctgccgggctcagcttgagccatccctttgcaggacagtggtgatgcccattgcccacgagttctcacctgatgtggtcctagtctccgccgggtttgatgctgttgaaggacatctgtctcctctgggtggctactctgtcaccgccagatgtaagcctgctgggggattgagggaggaagtgaaacagtgaggatatcgagtccagtgaggcatggggcagggaacagactgatattgcagcagacggggaaagcagggggcagggcctagacttggaatcatcttggtaactcccccaacttgtcctctgccaaccccggccttgaggggataggaggtggcagtggggtagcagaggatagaggatgtatcctgccggagctgtagagatgggcttgttggtccctggtgtttcagtgatgctccttgtcattggattggagtcttcagccagtctgttaatgttttgactgtgatagggcatttagttcactgatgctgtattttattatggatatatttgggtttatatctcccatcacattttgtgctatttgtcccacctcttgtgtttctttttctctcctttt

SEQ ID NO: 20914 - DNA, 1072 bp, Homo sapiens
agaagaaaatatgagatgggccatccctggtcctcacagtgaacatgttagcaagagagactgttttggtgaggggcagcaggtggagactgtgagtgatttccttctggggcccactgcccaggaaggtgggagctgatgacttccctctggctcgggctgcctaccagcctttgactttatttacctcttttgcagtcttggaatcacaggcggaggctattgatggggttgcctgcttccctgagaccattccctgatctctgccttttcttccggcaaaagggggtttgaggattaaggctgtctttatttttctggaactgtttgcttctgcatgttctcctcagtggggctgaaaggctgacagaactttccctcagctcagactcggcccaaccaggttggaggagctgcccaggggcctgggacccaggccagctctggttgtaccctctttgtgccattgcccagaagagcaggcaagagtgaggcccactgtgcaagccagtctgggtggcagcggggccatggaggaggcggccaggatccttctccccagtgtgggagggagacaagcttcatgacaacacctgcctgcccagcgcctcccagaaccttcacactttctctctttcccttttccaggatggagggcagcagccccccccccccacgcctgctctctgggtgaccagagaaactggggcatgggtgtggggtggagccaggaacctcggtgtcctgccttccagccttgggctctgcctccttcagagcccccagggaaggcaggcagtgagaaagtgggtcaatcctggcatggggctggggtctgagaagtagactcctggcctcccttctctactgagatgccccctggcacacctctgtgctcactgcagagcgggacctgcttctcccctcctcttccctgctctatcattccaaagagattgaaggcttagaatggaatggccagagaaggcagggtcaaccctgaggggaagtagaagatgccaaagtaggtgttcacatttttcctggacttggcttcaaatgagagggttca

SEQ ID NO: 20915 - DNA, 1030 bp, Homo sapiens
agttgtgacgctgacctgtccaggagccatctgcagtccctgcttcccatggggctggggtctaactcttggccaagggaattgaagctgcctagcggcatctgttggtggcttggaaaggatttttcccagctttggggtttctttcccttgcagggaaatgtgataatcaacccaggatagatgaagttattgggttacctttccagatgctggcggtccaagtttcccttgcagctacctctgtgggagctgacaagagtgttggaggagctggacgtgtccaccaacgcaggaggctggcagcttgagagccactgctgagccctggccaggaggggcgtcctgagtgggcctgtggaatgggccccgcgtcctgcctggctttccagctccccccagcagggggagatgctgtcttctctgtgttggggaaagaaggaaaaaaggagggggccagggattgggaacctcattttaggattgttgagaggctttggaactggggccactgcttggggatgtttgcttgaggcccttcctgcagagtgttcctggggttctggactggctttcccagttgtggggttccagctgccctgggccagggagatagtcagcctccccccagctcttcctttctgaggggcctagcgtctgctattcccagagcttgggctggcatctgggctagggctggggtgcccagcgcctggcagaagcctggaaaccacatgccttggaactcggcggaagtaaagtgagaccaccgattgaagccagagcacgcgggtgtccacttccctgtagagagccccaagaaggaaaggtatgggccatggggcaggagataagaggtgggaaggaaggaaatggttagtccccagggtctgctgcagcccctgagcgcctcccaccttttcctcacttccctgaacacttgctcctctttccccagagtaaaggacagtaggctttgtaaggggcagagcttctggttcccctcaagtcctctcagcgtaggagcttt

SEQ ID NO: 20916 - DNA, 1050 bp, Homo sapiens
cagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttgactgctgtctggtcactggaatcaatgaaggttcacaggggtgacccaacaggtttgatctataaaaatgcttgaagccaatttgccttttcttcctagaactatcttcctcttccctaaagattccataggcaacctaccttcacattgttctgtgctactgttcttgcccttttctcaattccatttgttcaccttgggttgtgagaccactaaagattctgagaagttggagaacaaatgcattttcacccaaagtacatggtcttggggaattggaggtgatgagctactagggtcaagggttcgccctgggcatgcaagccttcctagtgtagggcttatcgtggggagttgagggagcacgctctcactttgagccttcagctccatcccaggttaaaggttaagggttaaggatgactttcctaggaccatctaggcctctgatgggaagcaggctgggctgggctgagatgactcactctct

SEQ ID NO: 20917 - DNA, 1073 bp, Homo sapiens
tataatgaatgataggatataagagattagtattttataaggtttatgaaatgtactcctaaacctgctttttgttttttatttttctaaatcatcatgtagtgcacctggaagtggtcccatgttcaaaccaaccacagtggctgtagatgaagaaggtggagaagatgataaagatgaatcagctacaaatagtggcacaggtgccactgcttcttgtggcctgggatctgaattctccacagataaaggaggccctttcactgcagtacaaatcactaataccactggactggcccaggctcctgggttagcctcccaaggcatcagctttggcattaagaataatctggggaccccattgcaaaaattgggagtgtcattttcttttgccaaaaaggctcctgtcaaactcgaatcaatagcatcagttttcaaggaccatgcggaggaagggacctctgaagatggaacaaaacccgatgagaagagttctgaccaaggactgcagaaggtaggagactctgatgggagcagtaatcttgatggtaaaaaagaggatgaagaccctcaggatggagggtcccttgcctcaacattatccaaattaaaaaggatgaaacgagaagaaggagctggggctacagagcctgagtattaccactacatccccccagcacactgcaaagtaaaacctaattttccctttctactttttatgagagccagtgaacaaatggatggtgataatactacacacccaaagaatgccccagagagtaaaaaaggcagttctcccaagcctaaaagctgcatcaaggcggcagcaagccaaggagcagaaaagacagttagtgaagtctctgagcagccgaaggaaaccagcatgaccgagccctcagaaccaggaagcaaagctgaggcaaagaaggccttaggaggggatgtaagtgatcagagtttagaaagtcatagtcagaaggtttcagagacccaaatgtgtgagtccaactcttctaaagaaacctctctggccaccccagcagggaaagaaagccaagaaggacccaaac

SEQ ID NO: 20918 - DNA, 1224 bp, Homo sapiens
ataagggctaatggaaacaggactgctttttaataccataatggtcttttccaaagttctggaaccatttttctggaagaaatacaggtagttccatttttctaggtgggattactgtgtcagtctgtgtgtatgtacacatatatatgttgtacaggtgcttcccttctccctagcccttttagagttgatggctttgtccctgattgttcagtataatagtttacagattcactaagagagctcgtgtagtaatgcttgctttattttttttttctcttccactcttgttttattttttacttttttttctttgtgatgtgacattttcagctgatgtattgaaagcaaatccttctaatttgggagcccagatcacaagagtgagtttttctactagtgtctttagctgtatatctttttttgtgtgtgtctttttacccttcccccctcccaatttaaaaagattcaaaacacatttcataaatattaggtaagaaaattcctctgtctgttgaacatcatgcctttctacaaagcaatgtccactttatactgggtcaaattccttttcccaatgctgttgtaaaagcataggttaatgtatatgtttcgttttgtttgtttcttgttattatctaatgtcttgaaaataattttagttctgtcttcattgcagatagatatgtctgggttctgtcaccagtgtgtcataacactgttcttttttggttgtagtttgttttgttttattttaaggaaaattatacagtagcttctgaaaataaaagacccattctgttacctggattttaagtaataaaatctttgacttatctctgctctccctcctcatcccctggatattcctctcagggccatgaaggaatgcaaagcctcacatactactttcagcaggctgaccagataaaagtggtcagactggtgagctctaaacatgctagcgctggaagacctgtcttgggtttatttaatagttataggaaacctctactcatgctgaaagaaaaaaaaaccacctttttatggtgaaataaaagtatgctttctatttgttctaatttaaataaccccccccccccatgtaagctgtacattgcttttcaagatcttacacctgggtaattttctgtactagcctaacccctttctgttctctttggcttgtgttattacaatttatctcatgttatgtttgtctag

SEQ ID NO: 20919 - DNA, 1065 bp, Homo sapiens
cacttcaggacctaatgttgccagggtaaaccaggcattctcttgttatgtatttctaactgttcttcattttggcactcaatcccagttgactaaaaatgattctgccttacttttgttctacagtttcaacctttctgccccttacacttaatttatcacagtgatgcactgtggtagagatgctgggattagactctttgttctattgtagtcagaaaagttaaagcaacctaagtaataagttctttagtgacagtactgtaaagagctctgaactgggttgttgttgtgccatttgctttggacccaggcagctcttatgacttatccgccttcagattttacctatggggcaaatctttgtccccagatatcttcttggagtgctatgtaaatacagattgagcatcccaaattcaaaaaattaaaatccaaaatgtttcaaaatctgaaagtttttgaatgccaacatgactctcaaaggaagtgtttattggagcattttgggttttcagatttgggatgctcaagcagtaaatatacaatgcaaatattctaaaatgtaaaaaagcccaatatctaaaacacttccagttctaagtatttcagatacgggatactcaacctgtatacttaaagctcattatctacaaaaccacaaaatttatgtataccatttcatacccactgggatggctaaaataaaaatggtactctaacaaagtgttggagaagatatcaagaagttagagccctcctgcattgctgatgagatagtgaaaagatagtggaaaagtttttgacacttcctcaaaacattaaatacaaagttaccatattactagtatatacccaagggaagtgtaaacatatgtccacacaagaacttgcctaaaaatgtttatagcagcattcttcataatagccaaaaagggaaataacccacatgtccatcaactggtaaatggataaaatgtggtacatctgtacaatggaatattattcagcaataaaaaggaaggacttactggtatatacaacatgcatgaatcttgaaaatag

SEQ ID NO: 20920 - DNA, 1050 bp, Homo sapiens
gtgacactgtcctcaacctgaatgtagtagaaattgttacatctttggttcatttgaatttgacatgtttattctcctgcacaccttgtgttacctcagctctcccaccacttttctctattgcatttgctctcaaactagggagattttgtcactctggaggcacttggcaatgcctctgtacatttttggttgtcccaactaagggtgtgatactactggcatctagtaggttgaggccagcaatgctggtaacatctacaatgcacagaaaagctccttgaaacaaagaggcaaaatggcagttaatagtgctgcagttgaaaaccctattctatcagaattaattaaaaactttcgtatatatatgatattgtggtgtcatttgaccttagtacaaacaaattattgtcattttaagtcccaagttatgttgtaaacatttataaagtgctcatctaggtgatccagaatattcacttattactcttctttagagtaccatcaaaataaaaatacaaaattaagggttacccatggagaactcatggactgcctgttcactaatacagaatatatatctgtgatccctggtctaggaaaaatctttagctggtatgatgaatgaatgcatgtgagtttatttcttcatcttaaaagctcatcttacgcattaaaaaaaaaaaaaaccatgtagtacaagtttggttttggttttggtttttggtgaaatgttcttcatttgcttgaaaggtaggctttttcacctttcttcatactgctgttctaatgcaaacagtaggatctcaaaacagaatgttataaatatataaacaaaagaagcacagcactaaatttttcatagttcgtctcttccctgaacttggaatgtctgaggaacccactgggtgcagtggctcatgcctataatcccagctactgaggaggctgaggcaggaagatctgttgaggccaggagttcaaggctgcagtgagctatgctcgtgccactgcacctcagcctgggtgacagagcaagactctgtctct

SEQ ID NO: 20921 - DNA, 1031 bp, Homo sapiens
tgctcagctggtttttgtttgtttgtttgtttgttgttttgtgtgtgtgtgtgtgtgtgtgtgtgtgtgtgtgtgtttagtagagacggggtttcaccatgttggccaggctggtctcgaactcctgacctcaggtgatccacctgccttggcctcccaaagtgctgggattacaggcgtgagccaccacgtggcctagttttacatgttttttaactttatataagtggaatcagttttcttgtatatatatatacacacaagattttctccagagtgtgacatttatttattttcttgtttccattgctgtaaggggttaaacctgtgttcaaggaatacacataggcttaacttcttaaagcaatatactttagcctctgtataatgttgtcattatccttttttaccttaaaattctgcagcttcagattcatggaagggtcttttaaacatttttgttaattcttagctgtattatactgtgttgatatatgttgtgcatattacttcttcatttctgactttattacagtttcttctatagcctataatgggctttttgtctgtgtaaatattctttttttttgagatggagtctctgtcgcccaggctggagtgcagtggcgccatctcggctcactgcaagctccgcctcccgggttcatgccattctcctgcctcagcctcccgagtagctgggactacaggtgcctgccaccacgcccggctaattttttgtatttttagtagagacagggtttcaccatgttagccaggatggtctcgatctcctgacctcgtgaaccgcccacctcggcctcccacagtgctgggattacaggcatgagccagcgtgcctggccttgtctgtgtaaatattctatgagtactgtttatttgagatagggtctcactctgtcacccagacaggatctcactctgtcacctagaagtgcggtggcagtgatcacagcttactgcagcctcgacctcctggactcaagcgatcctcccacctcagcttcccg

SEQ ID NO: 20922 - DNA, 1046 bp, Homo sapiens
tttagcaagacttgcatatataagagagcacttaggaatttctattattgcataagtaaaactgccttttaaaataggcaataggctgatgtgcagctcacacttgtaatcccagagctttgggaggctgaagcaagaggatcacttgagcctgaaaggtggaggctgcagtgagctgatcgtgctactgtactccagcctcagcgaccctgtctctaaaaaataaatgtgtaattccagttagtgaaacattatttaaggttttgatttagaaaatatgagtatcagttgttttccatcagattaatacattgatattggcatattcttgattttgcatgtgtttcctttcccttctccagttggccaagtaagtgtctgtagatcttttcctgaggaagacagtttcttttaaggagattatttagtgttctggttgaagttgcttcctttggagtgaaacaagcaacaaaaatgttctcactaatttaatatattttaaataatatttgctgtattttaaaagaaaccaagaagtagggaacctggattttatttttaaaagaagttgaggccgggcgaggtggttcacgcctgtaattccagcatttgggaggccgaggtgggcagatcacctgaggtcgggagtttgagaccagcctgaccaacatgaagaaaccccgtctttacgagaaatacagaattagccgggcacggtggtgcatgcctgtagccccagctacttgggaggctgaggcaggagaatcgcttgaacccaggaggtggaggctgtggtgagctgagattgcgccattgcactccagcctgggcaacaagagcgaaactccatctcaaaaaaaaaaaaaaaaagttgagttttctagagaatacatattagcagacactcttgctacctaccttttgaggtcatcactacaaattggtattcagatattgtaagtgatgttctttaggattatcattgatagcaactgaataaactgagggggttttttgttttgttttgttttgttttttaatgctgc

SEQ ID NO: 20923 - DNA, 2072 bp, Homo sapiens
ttttctccatctgtaaatggggttgtttcattaccatcaaattgtatgtaaaacatttggaaattatcacagattctgttttagagtatctttcattttaaggtatttactttcaaaaatgccaaatttaaattagccgggcttggtagtgggctcctgtaatcccagctactcaggaggctgagataggagaatcgcttgaacctgggaggcagaggttgcagtgagctgagatcacgccactgtactccagctggggcaacagagtgagtgagaccctgtctcacaaacaaacacccccaaaatgtctaatttggaaataaaaggaagactaatttctttattttctgaacccttgagcgttctgcatagtgatttaaagtttacaaaatatcttccatttgttgtctcttttggtctgtatgccagtcctaaaaagggggatggggtaggtgtggtgtgatggcttatgcctgtagccctagctacttgggaggttaaggcaggaggattgcttgagcccaggagtttgaggctgcaagtgagctatgattgtgtgactgcactctaatctccagcctgagccatagagctagaacctgtcttaaaaaaaaaaaaaaaaaggtggtgataatattttcattttgcagaggaggctgctgagactcaggctctgcttgccaaaagtcacacaagtgtctagctattatctcttattggagagctaagctttgcagcccagtcttttttagggattgcctagaaaaatataggaagaagtttattggctgggtgcggtggctcacacctgtaatcccagcactttgggaggctgaggcgggcagatcacgaggtcaggaattcaagaccagcctggccaatatagtgaaaccctgtctctactaaaaatacaaaaattagccaggcatggtggcacgtgcctgtagtcccagctattcaggaggctgactgaggcaggagaattgcttgaacccaggaggtagaggttgcagtgagccaagagtgtgccactgtactccagcttgggcaacagagtgagactgtcttaaaaaaaaaaaaatttttttttattaaacatgaaatggaggccaggtgcggtggatcacacctgtaatcccagcactttgggaggccaaggcgggcagatcacttgaggtcaggagttcgagaccagcttggccaacatggtgaaaccccatctctactaaaacacaaagaaattagctgggcatggtgatgcatgcctgtaatcccagctactcaggagactgaggcaggagagtcacttgaacctgcgaggcggaggttgcagtgagccaagattgtgacactgtgctccagcctgggtgacagagtgagactcagtctttaaggaaaaaaaaatagatgaaatggaggagttgcagtggaaagttaaatgaggctggaaagttttggggtaatggagtgatcctggaatagtaaaattttcagtgtagctatggaaaaacaatagtaagtttaagaaggcatttgattgttggcttattatagtatcacaagactggctgctgtctacataatccccccagatattttctactcaaatattttccactcttcaaactttagaattgtgaagtgaaccttatagatttgtctaactcctttatttttaagacagagtctcactctgtcgcccaggctggagtgcagtggtgtgaactcggcttcactgcaagctccacctcccgggttcacaccattctcctgtgtcagcctcccgagtagctgggactacaggcgcctgccacacgcctggctaattttttgtgtttttagtagagactgggtttcgccgtgttagccaggatggtctcgatctgctgacctcgtgatctgcccgcctcggcctcccaaagtgctgggattacaggcgtgagccactgcgcctggcctttaactcctctatttttggatcacgaaactaatataggcggcatggtgactcacacctgtaatcccagcactttgtgaggttgaggcagaaggataactcgaggctaggagtt

SEQ ID NO: 20924 - DNA, 1063 bp, Homo sapiens
acgcgcgcctgcacacacacacacacacacacacacacacacccctacctacctacctacctacaactagaagggagaaatgggaaatattaatataggcacaaatctcatatatgctaagcacttaacaaatatctcatttaaatcttataataagcccctgagagaattactgttgtcccattttgtggaagaaactgagtcttagagaagtccaatatgttgcccaagggtaagcaaccagtaaactatagaatcaggattcagatctcagtccttctgcctccaaagctcatgccacactgaatgtggaaggccttaatgctcctccaatctggaattgtattttgtaagccaaagacaccttgatcagagcagaggtatagacttacagccagaagagatactgaaggccgggtgtggtggctcacgcctgtaatccttgcactttggcaggccaatgtgggtggatgcttgagctcaggagttcgagaccagcctgggcaacatggcaaaaccccatctctacttaaaatgcaaagaaaaaattagctgggcgtgatggcatgtgcctgtagtcccagccacctgggagaatgaggtgggagaatcgcatgagcccagaaggtcgacgaggttgcagtgagctgagatcatgccactgcactccagcctgagtgacaaagtaagaccctatctcagaaaaaaaaaaaaagatattgaagataagttaaaactcactatacagttgagaaatttatttttagggttccaaaatgttttaatgatagggctgaaacccaaacccaaattctttgatttgccatcgaaatctcttttcattatcccagccaggcattggtgatggaaataaaataatagtctgctcaaagaatgtctgaggatggagatggaaaaccatttagaaagttgtctgggtatgagtatagataaggacttgaaagagtaatagtggaaatggaaaggaaggaataactatgaaggctgataaaacaggtcaactatgaagacaatatatagtcagtttatgcacatgtttgac

SEQ ID NO: 20925 - DNA, 1064 bp, Homo sapiens
gtttaaaataaataaataaataaaataaaattcaccctttccaaaacacataacataaaatttagcatcttaatcatttttaagtgtacagttgtgtatgtgaagtatatttacattgttggtgcaaagtccatctgttttaaatgattagtatctttattctccaaaaagaatggagccttattctgtttccaacattaagaattgagtttgtttcataactgactgtttacttcctagtgtcggattcagcagtgtacatgcaggcattgtgctggtttctctcacatacctctttctatagtacccacataatttaacctagaatatatccacatttattgcatattgaggcaatttatgacagatttctttgaccatactaaacctttgatataaataaccattcaaaaaagccctgtcactctagtgtaaacagtaggcatcgcatgtgatttctgggcttatgcttttgtaagttcttcacattgactagttcattgtcaactttccttttgatttgagtttaggactcttaacatatctcacatgcaaccatccactaaaattttaagcctggtccttttgggcttttttgtcaaagctttaaaaattattttgacccatgcaaggcttttgccaacaaaagttgcagttcttggtgctccagtgctgatgtcttgttactgaatagattggagaatagggcatgcagactctggaatgaagttatctgtggcaggatattaaattgtactttgtaaactgagtttatttttgtacccattttcttattcacatttcattctcctttagtatttgttaaaatatttcagaaattttaaaaaagttattatatatggccgataattattagtattaaaaaataaaagacctgaagaaaagataatgttgacaagatatctgaaggaaacaacacaaaaaaagcactactgatgagaaatattatgaacaattgtttattatagaaacagaggatatgtttaattcagaataaagcaagagtgaatgatagttgtattttgtagcatttagactggatt

SEQ ID NO: 20926 - DNA, 1034 bp, Homo sapiens
tcagttatttatttatttatttatttatttatttatttatattttgaagtggagtctcgctctgtcgcccaggctagagtgcagcggcgcgatctcggctcattgccagctccacctcccgggttcacgccattctcctgcctcagcctcccaagtagctgggactacaggcgcctgccaccacgcccagctaattatttgtatttttatagagacggggtttcaccgtgttagccaggatggtctcgatctcctgatctcgtgatccgcccgcctcggcctccaaaagtgctgggattataggtgtgagccaccgcgcctggccaggatgtttcagttattaaaacctttaattttaaaattctacttctacaaattctattgactggtgacacatgggagatgctcaataaatatgttttaatgaaatattcattactaagcattaacctattcttctggggaaatagaagatttaattacctttaaacttgttttccagtggcacaagaactctttacaaacaatacaaagaatactctgattaagagcaattcgtatgggatagaccacagattttgtaagagcccagaagagagaagataatcaggactgaaatggagatggctttttgatagaatttgtcccagtggtttgcatagttttaagtgttgggttgacttgaatggaggtgattgttttagaagaaggtcagaagactagatttgcttttctctccaatttgaaatacctcttctattcgaggacacccaggaacattgttgattgttattctctttgttcaggcacacaaggtggggctggttcatagtggctagcaaatctgtttgaatcccagaattttttatgttaagcatcagagactttaaagtacaactagaacctgcagagagaaaggagggagaagagatagataatgtgtttaagaaaggataggtaaatggctactcacctactttggatgatccaaagttattttcaatttttgtttttaaggagattttaggcagggt

SEQ ID NO: 20927 - DNA, 1037 bp, Homo sapiens
gaggtgggtggatcacagggtcaggagatagaccattctggctaacacggtgaaaccccatgtctactaaaaatacaaaacttagccgggtgtggtggcacacgcctgtagtcccagctactcaggaggctgaggcaggagaatcgcttgaacccaagatcgtgccactgcactccagcctgggtgacagagcgagactcgatctccaaaaacaaacaaacaaaaaaagatgagggatcagatgggagaatgactttaagctatatagaaggcagaatgcatgcatcatagacttaaaacatgttgttactgttgtggttggaagtgcaactacccatcagccgctagtcggtccttgctctacctgactgattaaaattctttctttatggttgtcaggatgacctaataggtttaaaaatgtagtgtaagcttcaaactccagttgctgatgtttagtttgcgcatcttaaggatttggaagtatatgtataattgggttttgtgatgttgcatatctgtctagatctgtggactccactagttccaaactgtaattctttataagactgctgatttgacatttagcagtgaccatatgtggactgcactagaaataatgtgcttcttggagctgaatggtgtagcattactatatggcttttctctctagtcttcattgtgtcatctgtagtgagctatagagtttttttgtttcgggaatttttacaacttgtttgcatgggttcacctagtagcattggttcttgcttatagtctttaatacacaatcagcaaagcttacaatccactcaagagacttactattttgtcactgttgaaaatgggctaaatgatgtaaattgaatgtggctgtcaactaaaacaaaattcagtatagaattagtattcatccagtcatggacatacctgtagcatggttttctcttgagacataataggccgtttcctactgtaaaaacttacagccagcttcatacaataaagtaaattttttcctgtgttttggcaggctc

SEQ ID NO: 20928 - DNA, 1028 bp, Homo sapiens
tcctcccacctcagcctcctgagtacctggggctacaggtgtgtcaccaagccctgctaatttttttcatttttgtagagatggggtttctccatgttgcccaggctggtctcaaactcctgagctcaagctatcctcccacctcggcccctcaaagtgttgagattacaggcatgtgccactgtacctggccaagattgccattttctgaaagcgtagcagaagttcatgagatcttaattatgaatcagaaacctatgtaaagttttcatttttgctcttgtgacttagtttctagtattttattaatgaaaatggtttctagcttgaagtagatagattccagttcgtgagttctattaaaattccttccctgaaacaacttggtacttttgcttgtaagtctggcattaattttcttttcatattagcattaccatttagcattaagtgaaagcagattcatggtaattaccaaaggaattacagatgaccaccacaaatactgaaagaagtcattgatttgatattgcagtgaataccagaagatgttgtaataattttccacttataaaaagtgaattgtccatttaactctggaggtctaagcaaatgtgcttaatgcatatcgtattagtcaatgcaaaaagttaaatatgcccaggctgaaagaaggtgtataatgtatggtcgttcttataccaaatgatttctttggaatttaaacaaatatgtttagtattttattcctaatttaggaagaaaaagcaactaaagttgttctgacattgtacacagatgagtagcacgtaactgttatttagtaagccccatagatagtaaggaataaaagttgttagtgagcaaaacaggagtatcctgccatttgctttaattcttcttgtgatagttttgaggtacaataattcctgtgtgcgtgtcactcaagcaaccagaaagtgtctttgtaatacgcatttggtctcatctcatgaagttccagttgtttgttgtcatccttgtgactc

SEQ ID NO: 20929 - DNA, 1163 bp, Homo sapiens
agtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgacaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattcatttgtggtttgtgtttcctttctcagaattcgaaaccaactgaaaatcagctgccaggtaatgtcatattgaggattttaccctatttatataagataatacccaagagcttagtgatatacacagaaaagctaatacgaaaatctcttcctcatacatttcacctgtaagttgatcttggtgggaatacttgagcagagaaatttccaactaaaggtttgggcttaaaagatgccttttttcatagctgatttgaagctcttctgggactactgtggctaaataggtcagcatattcgtggcgtcgcaatctggggaatataggtagcctggcgggggaggctggggtctaagctcaaaagctgggaatgcacccttgacttccctcggttctggaggcctttcctggagtgccttctgcaagggaccctttgc

SEQ ID NO: 20930 - DNA, 1050 bp, Homo sapiens
caacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctccaaatacaagttgagtgcttagtccttcacctgctagaatcaggatacaatcaacatgattatgttccttaacacacttggatttatgcagatgtggtgtgtcctttgctcttttttttcttaagacagagtcttgctcttgtcgctcaggctggagtgcagtggtgtgatttcggctcactgcaacctccgcctcctgggttcaagcgattctcctgcctcagcctcccgagtagctgggattacaggcaccaccaccataccaggctgattttttttgtatttttaatatagacagggcttcatcatgttggccaggctggcaggctggtctcgaactcctcacctcgtgatccgcccacctcagcttcccaaagtgctgtgattacaggcgtgagccaccgcgcctggcctgctcttaaaacccgttattcagaagatttgtaaaagaaataggctttttttttttttttggttaattcaaacgaggggaaaattagatagcattttcccctaaagaaatgttaatgttcattttgtggctttgttttcaagtttcaggagccatgtacatctcagaagtgttacgaagtgattagaaaaggcctctggtaaaagaccttcaaggaccaaccattattattgg

SEQ ID NO: 20931 - DNA, 1065 bp, Homo sapiens
ctcctgagctgctgggattacaggtgcacaccaccgtgcccgggtaatttttgtatttttgtagagacggagtttcaccatgttgaccaggctggtctttaactcctgacctcaactaatctgcccgccttggcctcccaaagtgctgggattacaggcgtgagccaccctacccaactgagatgctgtttattctaacatttgttccactgtgaaccttgaggttagatttcaagtattcaaagcagtagttcctagagatatcataattagtaattaaattaagatttaatatttgttgattttattttggtatttttccacttttatcagggcataccaattcaatcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtg

SEQ ID NO: 20932 - DNA, 1046 bp, Homo sapiens
gttggccaggctggtcttgaactcctgaccttaggtgatccacctgccttggcctcccaaagtgctaggattacaggcgtgagccatcgctccggccctatgtcctgaattttaggcaccttttcaggtcccttatgtagaccatttcctcacatgtgcactgatcagttctgaagactgaggggcccctctgcagatctccagggttttttgtgtgtgagtgagtgaatccttttgaattatgtgcttccgtgaattgcagcattctttaaaaaaaaatttaagaagccattcaagaaaaaatagataaaatgttcagggctgggtgtggtggctcacgcctgtaatcccagcactttgggaggctgaggtgggtggatcacgaggtcaggagatcaagaccatcctggctaacatggtgaaaccccatctctactaaaaatgaaaaaaattagccgggcgtggtggcgggcacctgtagtcccagcttctcgggaggctgaggcgggagaatggcatgaacctgggaggtggagcttgtagtgagccaagatcaggccactgcactccagcctgggcgacggagcaagactctgtctcaaaaaataataataatggttcaggggaaaggaaacttcagtggagcaagaacccacttttctccacagtgagaccacaattggcagtgacatattctgcttagaaatgttaattccagaacctgccttctactcattctacttcttgaaatgatcttaatttctctggaggagtattgtactctgtaacattgtaagccaatccttaatgctttgttaatacatagctgccagggagggggcttgcctagagaatgagtgacccattacagaaatgaggactaatgttttcaaaatgttccccagactgcactcatctcccaggaattatttgacatttcactgagagtaagaatgggtaacttgtggccgggcgtggtgactcacgcctgtaatcttagcactttgggaggccgaggtgagcagatcacctgaggtcaggtgttg

SEQ ID NO: 20933 - DNA, 1038 bp, Homo sapiens
gaatattttagattgtttttattccgtcaaaaagaaacctgatacccgttagcagttactccctccttattccccccataatggttgtacaatattccattatggaggttataccataaattatatatgtttcttttttttttttttttttttttttttgagacggagtctcgatctgtctcccaggctggagtgcagtggcacgatcttggctcactgcaagctccgcctcccaggttcacaccattctcctgcctcagcctcccaagtagctgggactacaggcgcccgccaccatgcccggctaattttttgtatttttagcagagacaggatttcacagtgttagccaggatggtcttgatctcctgaccttgtgatccacctgcctcggcctcccaaagtgctaggattacaggtgttagccaccgcacccaacctaattatatgtgtttcttataataaatgccctgtatttgtttagggtaaattactaaatgtggaattattgatcaaaggatataagcactttaaagttcttgataactgttgccaagatgccttccagaaaagttgtaccagatgacaccattggtgtatgatggtatgggtgttggtgtttttttgttgttttttttttttttttttttttttttttgagacggagtttccctcttgttgcccaggctggagtgcaatggcgcgatcttggctcactgcagcctccacctcccaagttcaagtgattctcctgcatcagcctcccaagtagctgagattacaggcgtgtgccaccacgcccgctaattttgtatttttagtagagacaggatttcgccaatattggtcaggctggtctcgaactcctgacctcaggtgatccgcctgcctcagcctcccaaagtgctgggattacaggcatgagccaccgcacccagccgatggtatgggttgggtttttttaaagaaattttgtatcataaacgtagtcatattggaaaatcatacatttatttttgtcttagacatgttcgtttt

SEQ ID NO: 20934 - DNA, 1045 bp, Homo sapiens
tgcccagctaattttgtattttttagtagagacggggtttcaccatgttggtcaggctggtctccaactcttgacattaggtgatccgcctgcctctgccttccagagtgctgggattacaggtgtgagccaccgcactcgaccagattattagttttgtaagaccgttcctttgagaataggtatgagaagatagattttggctgatatcgttaacctgaaatttagacatagaaaacagttctgagctgttaatatcagctgaatggcaacagttgtttttcaacatactgctacagctgatgagttcagtttgtgttgaaataagaacctagtaaaatgtatttttaaaaatattttttaagatttaaatacaaataattttaaatacaaaaaactagctgggcgtttgagcattgctatttactgcaactctaaagagtgaatgacctgttagtcagtactggctggcatacagttatacattcttgaattttacaagtactgtagttggctgagagcagtccttggcaataaaggtttatctttcagacctgtggaatatattgcccaaagagttttcctaaaacaaggatatgatgatctctttgcagatagcattttactttttttttttttttttagacggagtctcgctccattgcccaggctggagtgcagtggcgtgatctctgctcaccacaagctccacctcccgagttcatgccattctcctgcctcagcctcctgtgtagctgggactacaggcgtccaccaccatgcccggctaattttttgtatttttagtagagactgtttcatcgtgttaaccaggatggtctcgatctcctgatctcatgatccggccacctcggcctcccaaaatgctggggttacagtcgtgagccaccgtgcccggccagcattttacttctaaagaaatgaaatggggccaggagtggtggctgatgcttataatcccagcactttgggaggccaaggcgggtggatcacctgaggtcaggagttcaagaccagcctagcc

SEQ ID NO: 20935 - DNA, 1032 bp, Homo sapiens
cctccgccttctgggttcaagtgattcccctgcctcaacctgagtagttgtgattacaggcatgtgccagcgcacgccaccacgcccagctaattttttgtattttagtagagatggggtttcaccatgttggccagggtaggctcgatcttctgaccttgtgatccgcccacctcggcctcccaaaatgccgggattacaggggtgagccaccgcgcctggctgtttgtttttaagaggcagtatgttgctgtatcacccagactggagtgcagtggtgtgagccatagctcactgcagcctcaaattcctgggtttcagtgatcctcctgccttggcctctcaaagtgctgggattacaggtctgaaccaccacgcttggcccctgtggctttcactgatgtcacttcctcagctgtccgtcttgttacccttttcttagtaatgcctcttctgctgttctgttagccgtccttaccacccatttccattctgaccaggaacaagatcaccatgattgctgagcctcttgagaagggcctggcagaggacatagagaatgaggtggtccagattacgtggaacaggtgagaacagggctctgacgccagggtcgaaaggaggcagggatgccacagtttaactgccgggtctctaagagcacacatctttctggggagcatttatgtctttgcctttgctcttgttctgggcacagtgggtaggatgaagtgactgtcttccaggaagggagggtctgtggctccaggaccagcaatcacagagctggctgacagctccattgtctcctcccttccccaggaagaagctgggagagttcttccagaccaagtacgattgggatctgctggctgcccgttccatctgggcttttggccctgatgcgactggccccaacattctggtggatgatactctgccctctgaggtacagcagaactgatgggaactgggtggcggtctcttacctctggagtggaagaaactacaaagtgttcttttcccaaaagt

SEQ ID NO: 20936 - DNA, 2098 bp, Homo sapiens
cctgacctcatgatccacctgcctcagcctcccaaagtgctgggattataggtgtgagccaccgctcccagcctttttttttttttttttttctctctgtcagccaggctggagtgcaatggcgtgattgcggctcactgcaacctctgcctcccgggttcaagcgattctcctgcctcagcctcccaagtagccagggttataggtgtgcaccaccatgtctggctaattttttgtatttttagtagagatagttttcaccatgttggccaggctggtctcaaactcctgacctcaggtgatccagccacccacctcagcctcccaaagcactgggattataagcgtgagccgccacacccggccttctttgatgcttttgctagccccttacagtcgacaccttgggcagctttttaccatgagcctgcaattggaataagattttcctcttatgtcctcacagaaataccttgtacttttctttcataatgcccatcagtttgtaaccacatacatgtgtggataatgattgtttactgtatctctcccctgctagaatgtatctgttttgctcacccctgctcttggcacgcagcaagtactcagtaaatttttgtggaataggctggatgtggtggctcacacctgtaatcctagcactttggaaggctgaggcaggaggattgcttgagctcaggagttcaagaccagcctagacaacatgaaaaaaccccgtctctacaaaaatacaaaaattagttgggcatgttagtgtgtgcctgtagtcccagctacttggggggctgacgcagaaggatcactggaaccttggaagttcgaggctgcagtgagccaagattgtgccactgcactccagcctggtaacaaagtgagatcctgtctcaaaaaaaaaaaaaaaaaaaaaattagggaatgctctgcctaagtttcactgctgcttattggacattgcttcaggtaccacatcgaggtgaaccgtgttcctgctggcaactgggttctgattgaaggtgttgatcaaccaattgtgaagacagcaaccataaccgaaccccgaggcaatgaggaggtagagtttctgaagagaccaactgggttggcttaagctagatggtcccagggacacacatgagcacaaacgggactaatccacagtcattgccatgtcctggtttcaggcttagccttctagatatgaccctgctggattctccctgtactcagttcagatgcgaggaattaggacgggtgccttttattattttcctcctctctttgttctgccagaatacctgggaagaaatggcccttcaggttacccccactcagcaccaggctcctggttggggaatacatagtctgatcctaagcaagtcctcttctcttctcatacctctgcactttctgtgcctgctcatgccagttgccctcagtcctttgtgctttggatctcaggctcagattttccgacccttgaagttcaataccacatctgttatcaagattgctgtggagccagtcaacccctcagagctgcccaagatgcttgatggcctgcgcaaggtcaacaagagctatccatccctcaccaccaaggtatgcccatggcctgcagcagccgccaagccccactatccccagctgaatgggcagagctgcacaccgcttcccatccatcaggtgttcatgatctgctgcttacaggaagctgtgtcaggagcaagcccagcctatggctgtcatgtcaaggcaggacaagacacgtgtgtgtgtgtatgtgtgtgtgttaaaacaagacctgtgtaggagggggcagtgatggggggtataggacaaggttgtgtgtgtgtgtgtgtgtgcgtatttgtgttccgcagatgtctttatctagacaaaaatacatttcttaatgagtatactttgaattgattttctcgagaagagaaggaaaagtgagttgttactctgatccttgtacactatgagcctgccagtgtacctttccaggtagcaggccaggagggctaaagggctagcttatgtccatgggtatagggtagagtttgacctaaat

SEQ ID NO: 20937 - DNA, 1070 bp, Homo sapiens
gatgctgaggagggaggattgcgtgagcttgagagatcgaggctacagtgaatggtgattgtaccactgtgctccagcctgggcaacaaggcaagaccctgtctcaaaagcaaaagaacctctaagcaagaaaaagtaacataaacatattacttagaaacctgaaggtaaatactctaaaagcagctttaaaagtgttgaaagcagttgcctctagggagcataacttgggggtagagtgcaatggggtagagggctgttctttataagccatacctttatttctatattgggacattccataagataatgtgccagtaaggctagggttgtggatttgatccccttgtacaactcgttttcttataaatgttagtgaactcagatgctcgtggtttctgcatggcttttaagattgaaagttttaacactgtaaaagccaaacacaaaagaataaagagtatggcagtgagggtaaagagcagagttgcttttcttcatttcctttcttttctcttttttaaatgatgtttatgtctgcttgtatttgtgaaattgaggtttttcgtcaaatgtatttctgtcttatcacattagattcatttcctgtgttctaaggtttttgtctctgtcctgtaggtttccccttgtctgtctggtgcagttaacttttccaagattgtgcagaatgttcccagctctgggaaatcaacttgttattgggaattaggggaacagctccatcatgtcactttcttggaccaggctgttggcaaaactgagtgtcttgcacaagtcccttccgagggctggagagtggctgtgataccgagttcctgcccttccccttggcagtgcgtccgggctgctgcagcctggcactgtgttcaccactgtctctgtttcagcatgtattccactgatgagaacctgatcctttccccactcctgggtaacgtctgcttctccagctcccagtacagcatctgcttcacgctgggctcctttgccaagatctatgccgacacctttggtaagcgctggctggcagtctgtctcaccagcttccc

SEQ ID NO: 20938 - DNA, 1035 bp, Homo sapiens
tggaacactttggctaaccttattcgtgttatcattggtgagacagccagcagagggagccagaattgtctttttttaaactgacttttcattttggaatagcagcaaactgaaaagcttcaagaattgttcaaagaacccaccctcatttacttcgtaattctctctctgtacacgttcagacacacacagagagacaggtgtgtacattttccccttgaactgtttgaaagtaaaatatttcagaatgtattttctaagaataaggacattcacctatgtaaccacagtacagttgccaaaatcagaaaatttgacattgatacagtcctgttgtacagatctttttttgcagaccttattcagttttattaatcataccaacaatttccgttatagaattttttcccctaatccagagtgatgcataacatttagttttcatgattttcaagtctctctgaattgaagctgttctttagcctctcttggtcttttatgacattgacacttttgaagagtacagggcacttattttgtagaatgtctttcaatttgggtttgtctaatacttcctcgtgattaagctctggttattagaatctggttattcttctccttatcaaactttatctactagttttgtcatctattgatgattcttggcttgttcctacaatagttgcaaatagtgagtcttctaactcttcttattccttctgttttgttttggttttgagatggagtcttgctctgttgcccaggctggagtgaagtggtgcgatctcagtttactgcaacctctgccttttgggttcaagcaattctcctgtctcagcctcccaaatagctgagattacaggtgcacgccaccacacctggataatttttgtatttttagtagagacagggtttcattcaccatgttggccaggctggtctcgaactcctgacctcaagtgatctgcccacctaggcctcccaaagtgtggagattacaggcgtgagccaccgcttccagccattgttgtttgt

SEQ ID NO: 20939 - DNA, 1050 bp, Homo sapiens
tcctgcctccagattgtcttgaatcccacagaactctacttactgctgattaggctaagctggtctgtgtgtgtggactcatgctctcctgggcatgagtcccaggagtccctctttttatgtagggagcctcccgtaggaaagcttaatgcaaggatatgacactaatgggggatatttttaccctgtggggggttatggcgaggaggaaaggggatattcggaggttcacgggctttgaagtgccccctcagttcaccctaccagttaattgtgctttatcctgcaccaagtgatgacttacttagtatttgcttttcaggacatgtgaatttctctgatgaggtcacagctggcttgcgcatctcagatggagtggtccttttcattgatgctgctgagggggtgagtcagactcagctcccagaatctcatccacctgttatgtttgcccccaccccgcaacaatacccagagcactgagtgagctgggagccagagaacttgaaactctctgggattaaggctcaaatttgctctaaaattaaagcagcaaatgtttcaaaattaattcttaccgggtgtggttgctcacacctgtaatcccagcactttgggaggctgaggtgggtggatcacctgaggtcaggagttcgagaccagcctggccaacgtggcgaaaccccgtctctaccaaaaatacaaaaattagccaggtgtggtgacccatgcctgtaatcccagctactcattaggctgaaacaggagaatcacttgagcctgggagttggaggttgcagtgagccgagattgcgccacttcactccagcctgggtgctagagtgagacattctctcaaaaaacgaagaaaaaaattatcaatgtgggtgcccttgcttcctgctcagtgaagctcaaaatgataagactcattgctattcagaaaacacaaagataaaatgacaaatgtaaataaaaggaagggaggagtgtatgttcttgtaagtggatttttaatattagttgtgtttttccaagagattggagtta

SEQ ID NO: 20940 - DNA, 1753 bp, Homo sapiens
cagtgagctgagataatgccactgcactccagcctgggcgacagagctagactctgtctcaaaaaaaaaaaaaagaagttcctctgtcttcagagagtctttgtgatagaagcgacacagtccccatccctgggtgggaagccaccagctgagaggggcaagatgttctccaaaaccaagggagacggcaggagggtggcctctcattggccagtggtctagttcagacttgtttttagcagtgggagcatattttcagcaaaacataaacaccaatatatgctttctgccacatctgcttgacccctctcttcctccctccccccagggagccctggctctcctgggaccactgcaagaacaccctaaccctggcaagaaggtcttagtcgtggagtcaggggtcttctgcccctcgctgtggtctcaggcatgatactgaccttctctgctgtgtctccccacttgcgagggtgggtcatggggacgtgggagagacctagtgcagtgcctggccatcggcggtggctgataaaagctgctttgaatgaacaaataaatctctctcctgttccccatctcagctgaagagcaatgtgaccagcctggactgtcacatcagccagtatgctaccatctgccaacagctccaggctgaggtgaggagcccgccttgggggcaggctggagggccgacagccagaggcaggagcttgagggtgtggcgggggctctgtctgcccctcccctcctgtgcttagctggggctctcaggggctgggctgcttctgttccaggtagccgctctgaggaagaagctccaagtgtatgaggggggaggccagcccccaccacaggacctcccaggatctcccaagtcgggaccaccaccagaacagtgagttccactgcccattcccgcccccaccctgcagctcagccaggatggggagccaggccctcttctccagtttctggaggactaggactccttgcttctgctccaatccctagggttaagggtttgcacccagtgcctgcccagcaactgactgtcacctagagtgctgtgtccaatgagtaaatggcaccccagcccgtaagagcagggcctactattcgagagaaggtgaacttaggggtgtgtgtcattgtctctcaaaccagaaaatccctgactcctcctaccctcagctactgcccatttgtcacctaagcatctgtcccttatggactctatacgacctgggtgccacagagatcccacccgctccctgctctcccacctggcccacatcctgcctctcaaaccctcctttcccgcttagccttcccagctcccccttgccaccccaccctcccagccagccctgcaccccagagctccctgcagggcctagagcccttcaagaggagagtctggggatggaggcccaggtggagagggccatggaagggaactcttcagaccaggagcagtccccagaggatgaggatgaaggcccagctgaggaggtaggacttgggggtgtgaggcctgggtatcgggagggcttggagctggtgggatattggaaaaattgcctctccctgactcagagtccctttagtcccgtctctatgtggatgtcttgcaccttagtcattaggaggatttcagattctgtgcaggaagaagaaatactcttatcagatccttgtgtgtttggaagtgaccaggacctggtcattctaggagctgtcatttccactc

SEQ ID NO: 20941 - DNA, 1050 bp, Homo sapiens
gtggaactgtacaggcgcctggaggcccgccagcaggagaagcacttcgaggtgctcatcagctaccaggaggtcggctgcccctgccctgggccttgttctcacaaccacccggggggaagtgagcccatggggtggagtgagctggtgtgggacagggtggcaggaaatggagagctggcacccctcaaggagatagatactgctcagtgagatgctgcactagagacacccgcctgttcaccctgctgtggtcatgtaacacagtcctgggaagcgccacttctgtgggtgtctcagatacatcccggcctcagctcccctgtccagccgctagggagaggtttcctgatgggccgctctccctcaggcctcttcctttcttcctttctcaggtgtataatgaacagatccatgacctcctggagcccaaggggccccttgccatccgcgaggaccccgacaagggggtggtggtgcaaggactttctttccaccaggtgtgggattgggctcgggtaggatgatcggccccatgggtccttggggttccctcacaaaactgtttggggatgccctgggtcctgtgatggtggtagcagtggtggtggtagcaagggggtgatgtagattctgaagagcagcccttcctgttaggggaaaagtcctgatccgggaacccacagccccgttcctgggcttctcctctgtagccagcctcagccgagcagctgctggagatactgaccagggggaaccgtaaccgcacgcagcaccccactgatgccaacgcgacttcctcccgctcccatgccatcttccaggtgaggtcatgggtcagagcctgaaaccagtgcccctgatgcccatctccccctcacccctgccatctgccttcagatctttgtgaagcagcaggaccgggttccaggactgacccaggctgtccaggtggccaagatgagcctgattgacctggctggctcagagcgggcatccagcacccatgcgaagggggagcggctgcgggagggggccaacatcaaccgc

SEQ ID NO: 20942 - DNA, 1016 bp, Homo sapiens
tataaattgtttttctacctggccacaaaacaaatctaaacaattatcagagtattgtataaaacataatctttttacataagcaattacgttataaataccacatttacaatttttttttttttttggaagtagagacaagttctccctatgttgcccaggctggtcttgaactcctgacctcaagctattctcctacctcagcttcccaaagccctagaattacaggcatgagccactgtgcccagcccatgtttggatttttttttttttttttttttctgagacagaatttccctcgttgcccaggctggagtgcaatggtaccacctcagctccctgcaacctccgcctccaagattcaagcgattctcctgcctcagcctccggagtagctggcattacaggcacccgccaccacacccggctaattttttgtatttttagtcgggatggggtttcaccgtgttggccaggctggtctcaaactcctgacgtcaggtgatccacccacctcggtctcccaaagtactgagattacaggcgtgagccaccatgcccggcctgaaattttttaaaaatacacttaagtaggtcaaataggaaatcataattgtaattaaaagataattaacatgaagcgattataaaaatactatttataaaacttgtgggatgcagttaaagcgatacttagagggcaacttatagtcttaaatgcttatattagaacattttgtttaagaagctgaaagttaatgaggcaaatatccaactttaataagacagaacagcagagaacatatgtagaatataaaagaagataagactgggcatggtggctcacgcctgtaatcccagcagtttgggaaaccaaggcgggtggacagcttgagcccaggagttcaagaccagcctgggcaatatggtgaaaccccatctctataaaaaaatttaaaattggggggtgtggtggcgtgtgcctgtgattcccagctactcaggagactgaggtg

SEQ ID NO: 20943 - DNA, 1034 bp, Homo sapiens
actccgtctcaaaaaaaagaaaaaatccaacgtgagcatgttaggaagactgagggtccaggtcagtgactgtcagttaatcacacatgtaaactgcagtcaggggcaggtttggttctggctgagccatttgggaaagcaagtttgtagactggaaattgggaagggaccaagatggccagggtgggtaggggaaggggagtatttgaaatcagaggcctggggccagttggcaagaaccttcttccaagctatatgccatggttcaagccctgttcttttttattttattttattttattttatttttagagatggggtctcactatgctggccaaagtggtctcaaactcctggcctcaagcaatcctcccaccttgtcctcccaaagtgctgggattacaggcatgagccaccacacctggcctaagccatgttcttcaggacagcattgcacaggggtggcctgatgcttactttacaggttggggtcagtcaccagaagtgggagggagaacagagggcggtggcttgggatctggcaagaggctggcctagggctgctggagatttgcatgccagcctttggcacatgtggcctccagcctgggcctccgagttgaaggcctggttgcctgtcaccccactctcagtcactacactgagactctccttccacgagggtataggggagcctttttttttttttgagatggagtctcgctctgtcaccaggctggagtgcagtggagcgatctcggctcactgcaacctcccttcccgggttcaagcgattcttctgccctcagcctcccgagtagctgggactacaggaacatgccaccaaacctggctaacttttgtatttttagtagagatcgggtttcactatattggccaggctggtctcaaactcctgacctcatgatatgcctgcctcgccctcccaaagtgctgggaatacaagcgtgagccactgtgcctggctgggggagccttttacactgtgaccatggccaagccccttattctgt

SEQ ID NO: 20944 - DNA, 1047 bp, Homo sapiens
agctggagtccagagtggcatgatctctgctcactgcaacctccgcttcccagattcaagcaattctcctgcctcagccttccgaataggtgggattacaggcatgcaccaccacgcccagctaatttttgtatttttagtagagatggggtttcgccatgttggccaggctggtctcgaactcctggcctcaagtgatccgcccaccttggccttacagccactgcgcctggccccaggggagcatttattcaccactcccaggagagctctgaaccactgaaggggaggaagaaatcaccagtgtgactctcagcctccctggggagctgcaccgttcttggcactgaaactccagcccctctcactcacaagtgtggggactgaggctcagaggagggaaggcacccggggctcagctgtttcttgtatggagtccttaccaccctgggccaggctggagagaagacttcctgcagtcacatgggtagttttatcacagaattcagagaccaggacccaggactttccacttccagtccacagcctttcattttagccatggttctgggcctagctgattcagattcagtgggctggggtagatggagcctgggtgtctgtaccttttgtaagtttcgcagtaaattcagattatagccaggtttagcacttgctgtgaggaatgtactgcctctgtgtaagcggcagtggaatgtgggaagccagatcggattctggagaatgatgacttgaccagagcagaaagagggtcatgaacacaggtgatcaaaggtggtcgtttgttcatgtgggcctgacagggagctgctggcaggtctaggtgtgacttggaggccgctgggtacctaagcctctatttcctccttgctgagctttgggagcaccgtgggctgcaacttcctccctggcagatcccagtagatctgtgcgcagccaagtgagtgggaaggcactcatacagcaggcccagggccagcaccacctgaccattcctgcttacctgtcagcgctctgttctcagat

SEQ ID NO: 20945 - DNA, 1041 bp, Homo sapiens
gtcattacagatcttttttttttttttggagacagagtctcactctgtcacccaggctggagtgcagtggcgcgatctcagctcactgcaacctctgcctcccaggttcaagcgcaaatcctattttatactcaaggaaagagaagctcaggatgctgaattaaattgcctacagccatacagctagttaagggacagagctaatcccaaccaaggtccctttgactctgaaccctctgagaatgtgcagtccctgtgatcctttttttgcataaatggcaacaaagtagtccagtccaaacagcctccctgctcattcatgaaagctggagtgatggtttgtgcttggagagtgctcaagtagagaagagagacctgtcccctccctgcccttggtgttggcaaagggagcagggaggacacagagggaggcagacgccagctcctttccttgtggctctctccaggtaactggcagcctggaggaggtggcggcttaatgggcctagcccacgaagagaacttggacttgaaggtttaaacagcaacctctcaccaataatgaaagattaggagtggggaagccgtatacaaaaatagcacttaatagttaactggaaaacaatatatttttgcaaccactggttcctcgagaaataattgggtcccaaggcaggaaatgactcgttttcatgaatgattatattgatcattggtgcaaaacagatacacccccttaggaaagcagttctgtctggctagtcaggcggccccagtgtgaaatcctgagaggcggcaaggggaggaggacaggggctgcaagccgagggagccaggtcctggcctggcacacgcaggggcgggtctgttgaatgggggatgagaaggaacagaatttgcctccaacataagtcctgagctgtcccaagggaagaaggtgacagagtgagaccctgtctcaaagaagaaaaaaaaagtcacatgaacagaaatgaaagtccaaagcatgacgagtccaaaggagggaaagtaaagggagtg

SEQ ID NO: 20946 - DNA, 1043 bp, Homo sapiens
cctcccaaagtgctgggattacaggcaggcgtgagccgccgtgcccagccagaacttcttttaacttccatttcctcactttgagaaagtgctgctcttacactctagttccgcctgctgggaagctcaccttcctaggcactctctcccacattttcctcatcttttagcccaatatattgtcagtccaggaatgtggaggtgggaagtaatgtggaaaggttttgtgattctcattttaaaatagttgatgttgccaggcacagtggctcacgcctgtaatcctagcacttgtgggaggccgaggcaagcggatcacttgaggtcaggagttcgaaaccagcctggccaacgtggtgaaatcccgtctctactaaaaatacaaaaaaaattagctgggcgtggtggcagtggctgtaatccagctactcgggaggctgaggcaggagaatcgctttaacccaggaggtagaggttgcagtaagccaaaaccgcaccattgcattccagcctgggcaacagagcaaggctccgtctcaaaaacaaaaacaaaaaaagttaatgttgagttccagcttgcccatgagctaaatattttgctgcatggtttatgtattaattcaacaagtatcttttttttttttttttttgagacagagtcttgctctgttgctcaggctggagcgcagtggtgcgatctctgctcactgcaacctccccctcccgggttcaagtgattctccttcttcagcttcccaagtagctgggactacaggcacacgccaccacgcccggctaacttttgtatttttaatagagacagggtttcaccatattggccaggatggtcttgaactcctgacctcaagtgatccatctgcctcagcctcccaaagtgctgggattacagatgtgagccactgtgcctggctaacaagtatcttttaagggcctatttgtcaggccctgtttttggcaccttggatacagcagtacccagatttagagagaggcagattgcaagatatcaacacaaagccaag

SEQ ID NO: 20947 - DNA, 1049 bp, Homo sapiens
cgggaagaaacagttcccatctgactcagggaaagaaaacacaaataaaacacagaactaaatatagtcaactctttctttcttttttttttctgagacggagtctcgctctcttgctctgtcgcccaggctggattgcagtggcgcgattttggctcactgcaagctctgcctcccgggttcacgccattctcctacctcagcctcccaagtagctgggactacaggtgcccgccacctcacccggctaattttttgtatttttagtagagacggggtttcaccgtgttagccagggtgggctcgatctcctgacctcgtgatctgcccgcctcggcctcccaaagtgctgggattacaggcgtgagccaccgcgcccggccaactcaactctgtttttatatcaatggcataagcataagtaattatgatccaaagcagcagataatcctcagtcatttatatttgactttggaaggcagtcaaagatgcccactcagtctgagagctgtcaccacactcaactctccggggtctaagactgctgttcaacgcgattgccctatttgcagctgcagggaaggggggggtcagaggtaagaagaagaataataaagccaggccaggcgctggggcttatgccagtaatcccagcactttgggaagccgaggtgggtggatcacctgaggtcaggagttcgagaccagcctggccaacgtggcgaaaccccgtctctactgaaaatacaaaaaaattagctgggcttagtggtgggcgcctataatcccagctacttgggaggctgagacgcgagaatcttttgaacctgggaggcggaggttgcagtaagccaagattctgccactgcactccagcctgggtgacaaagtgggactctgtctcaaaaaaaataaaaagtaggctgggcgtggtggctcatgcctgtaatcccagcactttgggattacaataataaaataaaagataaaaagatattttgtgtgttatttttatttattattatttttgagactgtctcgctctgtcg

SEQ ID NO: 20948 - DNA, 1067 bp, Homo sapiens
gcccgcagactgtgcccggcaggagactgactacgtgctcaacaatggtgggcagccactggcggaagtggggttgggggagactgcagagagcgaagggtggtgcagggtgggtcctggggcccctgggctctgactgccatccctgtgccctaggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaaggttggtggaggctggtggggatggagagggatgtgggtccaggtcctgcagaccctgttcacctttgtgcctcgaatttcctgccctgaagcaggcccgggctgggccagacccccagggtgcacagaggacctgaggcctggctgtcctccctacagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagca

SEQ ID NO: 20949 - DNA, 1117 bp, Homo sapiens
gaaggagggagatggggtacgggttggggggcgtttagggctccaaagcctaaagccaaacccagtgcaggaggcttcttacaatcggggaggaggggagtcctgtgagggggagggaagcttactgtgggatgaaggcctgggtttggagaggctggaggatggggcagcaggtcctagcgggggagggcaggggagcctctgggcaggtacggcctgacgccccgggtcctcccgccccgccaggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatctgtgagaggccggggagcgccgggcggacagggaggtggggacaggcccggtcctccgccctgacccggccctcctctcagtcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccaatatcctgccggggctgggagggagggccccatccttggagagccctaaccttggagagccccatccttggagagcccccacgcccagggaaggcagggccctgtcctgagggcgcacggtctgggtcggagcccttggtcttcgaaactgagggtggggacacgcgccctggctaggcccaagctcccaccaggaggggtggcgcggcgcctccttcagggaggcctgaggccttctgagggtgaagacagggcctcctgtctttggtaagccccagtcctgcggaggagacactgctaccgtgctcggggagtgcacaggccaaggggaaagtacagcccctaaactggggatcccccagacccaggtgggggtgacttaccagccagttacctgagg

SEQ ID NO: 20950 - DNA, 1472 bp, Homo sapiens
aaatgaggcttcagctctgcactgtaaagccagagggcactgttgctgcctttccaagcagctgtttttctggggctgctgcatgacgtcatagcagaagaaaaaaacacgaagaaaactatttcaaaataaatgtttaatataatttttagaccaaagaaaaactcaatcatacattgtctccagtggaccatatgtgccagaacaggaccaactcagtccagctttgaaggccctgattcagtcctactggtataatctcccttgatttattgatttgtgtatgcttcttatgcaatacaaggtgcattttactcttgaagtccctatcacctccaccatcgccatttaactgcaaaagcatgcttcctaatgggagggttttcttcccccttccctgcagaggttctgaaccttcaaggagtttgacaatcttatgaatctcttgaaccttctccccagaaaaatgtacatacaagtctacaaataatttcatggggttcatggaccccaaggcccacaatggtttctaaggccccaaattaaggaacctctgtgctagtgatttgagcaacgcaattgccctcagaagacactgacacagggcaggtgaaggactgggttaaccaaaatgacaggaggcaatctcataatttctgtttttattttggggcaaaatttagttctcagggcctccctacgtttaagagcagaactactcaagaacctaagcagctatcagcatagtttaagcgatttagaatagggctgtgcaaggggatgtacagggttcctcattcagctgaggacctcatttagctccttaactggaagctttacatttgatctgcagtgaggggacatttctaattttagtttgacccacatggaaaggtggatagctttttttttttgttttggtatagagagcacgtagaattggacaattaggtaaatccttggaatcccccaaacagccatttgctttataaatccagtatttcttacctctgaacgtcttaaagagctgcctcacaaattaatctaaccattgcttgcactaagaagtttgccaagagcctcttccagccttactggggggaaggaagagattactgaaaaccaacttgtaggaatgaaatgaggctgtcagttgtctaacctaacaaactgccaaattaggtttacattttttgttattagacttttgaatggccgaggcagagttaaatttaaaattttggattgtagccactttccactcgcctaaacactcaataccggtttgtttatttttccagcatcaagaaagaaaaccaaggcactagaaagcaagcacacttaagtattgaagataattacatcttaaattttgcctgaactgtatattgtagcatacttaaacccattcaaggaaaaaattggcaaattgaaaattctcccattaaagattgatatttttgcaaactgac

SEQ ID NO: 20951 - DNA, 1050 bp, Homo sapiens
aggcatcacagaagaaagaaccaacagtgtctgtgcatcaggcctcaaagaatatggagtgaattctgctcctttcctttcctcttctgatttcttgggcttatgggtgagccatgtgggtttggctgttgccactgctcgtgtcctcaactcttatgcagagagtagagggcccaatgcctttggggcgtgaataagctgaggagagtgtctaggctgaggaatgaatcaggagtttgacttgccttcaaaggcagagacataactggctcccacttcgtcctccccacacgctgcaggagggagaaggggcaaagtgttagggccatgagctggggtgacagccagagaccaaagtccagggctgggaaggccccctggccagtagtcctggacttagtacagaaccatgatttttgtagaccagagtccagatagaattaggaaaggagggagggagcaagtgcatccgtatgtgtgtgtgtctgtgtgtgcatgtgtgtgtgtgcatgtgtgtctgtgtgggaggtggtgtttggggagagccactgtcaggccaaagtgtcccaagaatagcctcttgaacttggaggctgtcggtgagggtctgagtcatggtgatgtggcacagaaaagccagccacaggaggagctttacagctcccaggccgtgatttgtgcccctgagaggtgagggtcagcctgttttccccatgtccttcacaagttcagctgccatctgctgggtcagcttctcaacagcctccttgttactgtctgcctgccaggctgttggatgagtcatcggggaactgcaaaggagtctctgagcgtggctgcctcagcctcagcttccacttctctgggaagaggggagcctggtgtgctcacagaggggcgctggacagctgcctacctaacaccaatatgaaaggacaactctgggactcgggatgccctgcaccccctctggaggagttctagctcaggatgacctatccagaagcctccgttgggccatgccaggcggagacaggctatcagagcccc

SEQ ID NO: 20952 - DNA, 1030 bp, Homo sapiens
caaaaattagccggatgtggtggctgacgcctgtaactcggaaggttgaggcaggaggatcacttgaactcgggagacggaggttgcagtgagccaagaatgggctgctgcgctccagcctgggcgacagagcgagactccgtctcaaaaaaaaaaaaaaaaaaaagaaaagaaaagaaataaatctaaatgtgctgagatggaatagtattcatagtatcttaagtgaaagatacaatttgtatgacattacatgtgtataatccatgtttcttttaaaaatagtcccaaactaggccaggcacggtggctcacgcctgtaatcccagcactttgggaggccgaggcggctggatcacgaggtcaggagatcaagaccatcctagctaacacggtgaaaccccgtctctactaaaaatacaaaaaaaaaaaaaagtcccaaactatatgtttatatatgtatagtaattggaactagaaggatttacatgaaacttaagtgttttttatgttgcagagaggacgggacggtgccgggattttttttctatatacaattttgttttgtttacatttttacaatgaacaattattttggtattggaaaaaaatttttgagatggagtctcactctgttgcccaagctggggtgcagtggtgcaatctcggctcattacaacctctacctcctgggctcaagtgattctcctgcgttagcctccaaagtagctgggattacaggtgcccaccaccacacccagctaatttttgtatttttagtagagacgagatttccccatgttggccaggctggtcttgaactcctgacctcaagtgatccacccacctcggcctcccaaggtgatgggattacagtcatgagccactgcacctggcctgaaaaaaaatttttaagcaaggttaaagatcacatataagaaaggcaggagaggctagctaggaaaactgtcctcccttgggtttcccagactaggactaaccctgcgattcccacccctttgcgcaagca

SEQ ID NO: 20953 - DNA, 1023 bp, Homo sapiens
atcagaaaagtgaagcctcataaggagaaacagacaggattgctcagaatctaaacccccttttcttgatatctaggtcactgctttttctactaccttgctcatgaaacgataaggattttcttcccccaaacatgtcaattttgaacataacgaaaccagggtagcagctttatttatttattgtaccaatcaattattaattgatattgatttttaattaataaaaggccaaaagatgaatagcctgctgcctggacaggtgtgcttgtgcccattttccagatgtagaaacaaaggcagagagcccgtgatttgtccagagcaacagaacaagtccttggtgtctccgtgtcacatgtggtggctgaggctgtcaggtcagagagacctgggtcaggtcgaggtctgccacggcctgcctgtgtgcccgcaagcaaatcacttcacttctctaatcatcaggtgcctcatctgtgaatgggatcagaaatacttcatggggctgttttgagtagaaaatgagaggagatatgtaaagtgctgagcccagtgcccagcacagaacatagaggctgtaactgttgttgttgttgttgttgttcttgttggtggtgtttggtggtggtagtaatagtagtagtagtagtagtagtaatagtagcagtagtagttgccaattactgcattgtgactaaacctgttttctgtaagatgatgtcaagaagggtcagactgcctgacaggccagagtcattttctcagtaggacctttagggggacagtccttcagtctaaaagcttcagctctcgggttctccctgtcttacactatatactgccctcaccatactccaaatgaggctacaaaggtccaggctctgcccagttgacaatcctaactctgagctggagacacagctaggcctgtctaggggcttcctgtgtcccacacgtgatcaagtaggttcctgcattaatcctggaggtgaggaaagggaaaatactgtatggcatgtagat

SEQ ID NO: 20954 - DNA, 1056 bp, Homo sapiens
cacgtatgtggacacgcaagtgagagtgggcacatgtgggcatgcaggcgtgggagggcatatgcatcttggtgaccgagtctggaggagacagacccaggtggtcaggcgggcagatagtgatgtggtcagaatccttcctgtcctcctcggggctggcacagtccagatgccagctccctgtgatatcacatctgcccagaccccttcctctttgggaactcttcccctcccccccacaagcttcctctttcccattacaccctccctgggcctagagggagtggacaaccactcattgtcctgtttccgccccaggagccactccaggccagcccaggcccccagcactcagcgccccctctgcccaccctgtctgtgcaagcgcgcccctcccccacaggctcagccgtgattctctctgtgcagttcatgctgtggctgggtctggccgtgatcttcctctgtgcagcccacaccatggctatgtctgggcctcggatgcggctcactggtcattagagcactgagtggggcagccagcagtgtttctagaagcataaaaataccctcaacctgaggcccctccaccccacccgccccaactcaggcagcacttccgcagccctgacaggaaatgggctggagtctcagcctcccgccatctcggcaacttcttgtttccctgttgccctgtgccagcactggggtagtgcccctgggctctacccccaaaaccttcccagggctctgtcccggcagttcagaggggccaggatggtggacataatcgccaaagtgaccaggaggcagagtcgagccttgccggcacaggtaggggatgctggggtcaaggggtgcccggtgggcctctaccacaagccctgttaggagctgggtgagctggggcttagagcagggagcctcttggaagttggggctcatacttccttttctctttccttctcggaggccctgcccatccaagaggtggtcagcttggggcaagagtggcagggctgccacctgcttgtggacaggggagggaactggaga

SEQ ID NO: 20955 - DNA, 1033 bp, Homo sapiens
gtgctgggattacaggtgtgagccaccacgcctggccggaaaaatgcatattttctatttaagggatataaggtactatctgcatcaaatcatgtttattgattgtattattcaaactttcatttcctttgtatcctttgcttgggggcaggggtcttttactctaattctgatagagatgtgttatgttaaaccttcctctcacattttctctataaagctcttctggggcttttcctagtttttgctttttatatttaactacgacgctgtcaggaggatgcagatttcgagcgttctttcgttacaaattgtgcttttctatcattacgtggtgtccctctttatcctattctagtgcttaaccttaaatttcacccttctattgtttatatgaccactccttattttactttatcttttttttgtacttgcttagcattcttttatttcctactattatcattttttgaaactactaatttcttgtatatgtcacatcactgttttgttttgtttgagatagggtctccctctgttgcccaggttggagtgcagtggtgtgatcatggctctctgcagcctcagcctccctggctgaggcaattctcctgcctcagcaccttgagaacgtgggaccacatggcccacgtgccaccatgcccagctaattttttttttttttggtattttttgtagtgatggggtttcttcgtgttgcccgccaccactgtatttttattattttcatggatttttgtttgttttttgagatggagtctcgctgtgtcactcaggctggtgtgcagtggtgcgatcttggctcactgcaacctccgcctgccagattcaactgattctcctgccccaacctcctgattaactgggattacaggcacacgccaccacatccaactaatttttgtatttttagtagagatagggtttcaccacattggtcaggctggtctcaaactcctgacctcaagtgatccacctgcctcaccctcccaaagtgctgggattacaggta

SEQ ID NO: 20956 - DNA, 1034 bp, Homo sapiens
ccacctcaggcctcctgcaaaaacacatagcataaacaataccatcagaaagaaaagcaggactgaagccagcggcccacacatccacagaggcagcgggcagagcaagcacagggccatcgttcctgcccttgtttcccagtctaattagtcacccagacctgaaaacatatcctcagggggtggagattttacaattaccattgtttttggtgccctctcccttgcttcatcaagcatcagtcatataataccacagatttgaactcctgcccacaggggacctcccatctcctggcccctatcataggatcactgggcctacctgcactgtggggccaagccctgtctttttcccaagccctcaagcacacgcatgagtgttcatcccgacttggtagggggcttttcacccttacaagatggcaaaagattcacattgcttttttaaaaatttgtttttctttttaaaaatcccaacccttggatagcagggaggtgctggaggggtagagtcaagaagagtgtgagaacagtaatttcccaagactgccctctgtgggactgtatttcagaaaacacactggtggggctacctctcaattcacatgtactgccctagcctctccccatccccggctgacgctcatccataactgcactgttccataacagcagtagaatgttgcagaaagtgctaggattcctccactccatcttcaaagaaaaagtcgctaataaatcacatttggtaggttagtgaatgttaaacacattagtgagcaaaagaaaataggaatgaacaagaattggtcatctacctaactgaacacaaatgaactctggcagttcagtaataggaggtaaagaaccacgctaattgcagaacagcagcccccctaccttcccaggagcagtgtgactgggaagcagccccgtgtgtatgctggtgcaggttctaagcaaagtgagctgcccatcagttccgatgagtttgctgatgctagacatatgacatctgttctcttgctgcc

SEQ ID NO: 20957 - DNA, 1039 bp, Homo sapiens
cagttaaagcactacagagtagccatcttttacaaaaattgttggccacatttttaagttcgcaggcgagggggaacgtctcatactctagccctcctgagcctagaccctctgtgagatgtgtcaccatttcttggacaccacgtgagacattccccctcagattagagatgctcagcctgcatcaacttatctaaagcctacatctggctactctggggcaagtcctgtttacagtgcccattcctggagcttgcctctgtttgtcttttgttcgattacatgatatattacttttcccaacaggccagtgctagcatattggaagagtgatttaataaagctggcaaccttgacgctatgccaccagtccaaccttatttgcctcatttaccatttccattattgtggcagccctccattccagccacagcagcccctcaccataccccagtcacaccacccacatttctgcttttgtctgtgtgtttgtccatctaaaatgcccttatttcactctgcctgtgggagtcctatgcatctcccaccagaaactgctatcataccagagattcactgtgtatttaacaacataggcatacaatctggcaaatttgaaaaactcttaacatacaccccaaatccctgcccaaatttaagaactagggtggacacagtgcttttttccatgtcgcatcttctgtgatggggctacgatatgtgggagcagagaatggggagggtggagcgcatgccagatgaggatctatcagcaatgggagggggcctccactttagcatctccaccctgctcctctcagaggaccgcctttcattgcattcagctgtgatggtagcaagaacacaggcgcaccgaggacgaggagagcgggagccttgtgctctctctgcatctgaggcaggacagcacagggtatggagcagtctgcagagaggccagctcatcagctcatcagggaagcacttgtcttccaccttgggctttgactgagcactgggcaattggaccctggggatc

SEQ ID NO: 20958 - DNA, 1076 bp, Homo sapiens
gccattcagtcaagaaattcactcccttaacctagactgtgctggaaattcattgacaaattttgttctttggttctccatttttcttcagaattcatgcagaccacttgacttccttagcattttcttttgtgggcgtatattaatgtctttggttaagcttcagcttccgtttgcatcaatcctgttgtaatcgtgcctcctgaggcatctttttgcttcccttgcatcagtttccaaaatcctactttctgcttggtaaggggagtatccattttctttaaagcagtggttttcaaacttgcctgcacatcagaattatttggggagaaggataaaaatacagattactgagcttcacctgggattctgtagatttgagttgcatttgggattactttaaacaatttaccagatgatttttgcggcacctccacttcagttttaggaaggactgtttcaaggcagcttttcaaactttaatgaccatagaaatcacctgaagattgtgagaaactgcagttcctaatttagtaggcctgcgtttaggcctgaggttctgaatttctctgaaacgtgataatagcaaatccctcgttgagtagcaaggttgttttttgtttttttcttttttttccaatatcttcatgacattcaatgagtagcagagttcgaagataacttctggaatttcatctaatgtgtattaatttttactcatctggatcttaggggaaataacctatcaggttatagggaagtgtttctcaaagtatggttccccaaacagcacaatctgggaattgttagaaatgcaagttctcggctgggcactgtggctcatgcctgtaatcccagcactttgggaggctgaagcgggtggatcacctgaggtgaggagtttgagaccagcctggctaacatggtgagaccccgtctctattaaaaatacaaaaaaaattagctgggcatggtggtggtacttcttaaaatttttttagagacagagtatccctgtgttgcccaggctggtctctaaatcctgacctcaagcaatcctcctgcctcagcctctt

SEQ ID NO: 20959 - DNA, 1033 bp, Homo sapiens
tggcaacattcagtaggtgcagtttatatgatttactagaaataatggcttcttgctcaatttcactatgttcatagtgcctcttttgaggtctgtgtgtatattctatttatggaagttaaaaagtatttcagaaatgcatatattaatctgtgtggaatttctcttatcctttttcctctctaattcttgcttggatatttgtctcaagagatggtccaacatttaaaatagcgaataatatcttagcccatccaaaaacaatccttcctaaaggtttatgaacttaataacagagcctcaaaatacatgaggactcatagaactccaaggagaaacagacacatccttaacaatattgtagacttcaacactcttctcacagtaatcaagagaacaactagaaagaaagtgcagttttccctgtttttgtagacatgaaaactatttcacacacttctgaaagtctcattcagtaagttactcatttctccaccttatgactgtactgtgctttcaaagtgctgcacaaagaataaaaagttttaaagtggctttactgtaatttcagataaatatttgaacttttgagtctgaattatccaggtgaaatgcattggatttctgatcctctgtaacttggaagattaccgtcttccaggtatattggttgtccttaactgccttaatggcatgagttgtgaatcttctctgtctcggaagaaacctaacagtggaaattgtttatggcaagggtcacaaatttacatgcgcagaaggtcaggaccctctgtaaggtaaaggcatgaagtgcccccttctttattaacacataactgcatttgctgataatatttatttgcctagaattcaggccctttttgcttttacagacagtgctgtcttaaatatgctagagatgtatctttagtcacttaagctggtgtttctgtagggtaggttcctaggagtgggattggattgttgggttacagtgtgtgctatttaaaagactgaaccagattatactctc

SEQ ID NO: 20960 - DNA, 1045 bp, Homo sapiens
aaggtagggttaggactacttaacctctattcccactcccctgcaaactgggggttgtgggaagtgagcagccatctccctgtgtgattttttttttttttccctctgattcactttgccatgtttccttcacatccagatccctgtcggtgttagttccactcttggtctttcacgctccccttgcctgtggaacattgtctggtcctagctgtggttcccattgttcccccttcacccttctctgttaaccttgtgcctgtctcctgtatgatcacatcaccaaaaagggggaggggggagaagactctttttttttggccattttgtaatcgtataaaaatagtagacaactgcttaatggttggggttttttcacaattttcaacattagtgatttttttttctgtttgcaagttaaagggtttgtcattgtttctttaaaaaaaaatacaataatgcaccatatccctatgcataaagtgcttcttctatttataaggttgaaaattctgaataacccttttagcattgaaaaaaaaaacaaaaacaaaaaatggaaaaaaaaaaccttgtattttgtaaatattttcttttcctgctttggagctgtgtaatggcagcgaaacatgtagctgtctttgttctatagaaatgcttttcttcagagaagctgatctttgttaatgtcttgattctgttcgcaaagcacagactagtgcttaaaaaaaaaaaagaaggaaaaattgaaaaaaataaaaaaaaaagttacagaatgctgtgtaccaggcctttcttgacttactgaactgtgtatgcatggtagtgttggcagtttcggagctggctctctgccgccgttctttggggtactctgacttgctctataccttggaaaatctccattctgtcttgtgggaacgccgcaggttgatctgatggccaccagagagagaatggtggtggcttttcactgagggtaagggctgccaggaggagaggggatctgcattgatcatctcttttttctttttgttgagtgaaa

SEQ ID NO: 20961 - DNA, 1292 bp, Homo sapiens
ccacctcccttcccatacctgtacctctcccacttgacaaaagaagagcattccttttggccatattgagtcccactatgggtcttgccccagagtgtaaaaatcttgaggctcggtgtcgtggcccacgtctttaatcccgtcactttgggagaccaaggcaggcagatcacttgaggtcaggagttcgagaccaggtgtggtggctcacgcttgtaatcccagcactttgggaggccaagacgggcggatcatgagatcaggagttcgagaccagcctggccaacatggtgaaaccccttctctactaaaaatacaaaaattagcagggcgtggtggcatatgtctgtaatcccagttatttgggaggagaatcgcttgaacctggaggccagaggtcgcagtgagtcaagatcatgccactgcactccagctcgggcgacagagcaagactgtctcaaaaaaaaaaaaaaaaaaaaaaaaaggtcttggatggtggggacaacaaataaagagatcatttctaagagttctcagcacctgaaggagaatctcccaggtattaagcaaaaaagttttgaattttaaaaataaaatagagataactcaggaactcctatcaaccaagtcttctcttagaattctccaaaaagactgcaacagatctaccaaaccagagggtaccactaaaagattgcaactaagagatttccctctaactcttcgagtggctgggatgggtctgagctcagttacatggtcctattccttgtctgtcttagaataaatactgagttaatatctaaagtctgattagctaaataagtttaaaagaagttttttttttcaattaatgaagctaaatatatttacatgccaaagttttgataaaaatgtttttaaagcattatgtagtattcaaatataatctttacaactatctgaaattatgattttttaaaaatcacatatcaaatgggggtgcatgagcaaagacattttgaaaccactattctagatggaagccagcgctttcataatctggattggtttcattgaattttcacgtaatctcatgatctgtgcccagcctacagaaggtaggaatttcctctcaaatcactggtgggtttttgtttttgttgttgttttgttttgagacagagtctcgcttttgttgcccaggctgtagtgcagtggtgtgatgttggctcactgcagcccccacctcctgggttcaagcagttttgtctcagcctcccaagtagctgggactacagtcgtatgccacc

SEQ ID NO: 20962 - DNA, 1037 bp, Homo sapiens
ccatctaaaaaaaaaaaaaaaaaaaaaaagctgttgttatatcacttgtacttcttaaaatcaatgactaaaacaaagtgttcagtaagttaaactcgttgggaataaagagaaatgagatctatcagtaaataaataggaagccttgaatgcccaaactgatgatttgggtttcagtctataagttttaaatttttgagcagagaagtgttgtaagctattttgggggaggtaaatctgctgtaacatgttttttttttttttttgtttgtttgttttttttttttttttttgagtcggagtcttgatctgtcacccaggctggagtgcaatggcacaatctcagctcactgcagcctccgcctcccgggttcaagcaattttcctgcctcagcctcctgagtagctgggatcacaggcacccacgacgacgcctggctaatatttgtatttttagtagagacaaggtttcaccatgttggccaggctggtctcgaactcctgacttcagctgatccatccgccttggcctcccaaagtgctgggattacaggcgtgagccaccgcgcccggccaatctgtaactattatgtttgggatggattggcacaagagactggaggtggaaagacagactaacagtagtaatcctggaggagataatagtctaaggcctctacaactctgaatgtggaatattttaaatgtaatctaaggaataaccactagggtgtggtaagtgaatatcagagtaaggctcatggagaacatggagtacttcctaaatcataattttattataaaatgacggaattactagttgtaattactgaatagcctatattgctatttattgtgtgtttcatcactttaggggtctagtatggtggatgttagtaattatctaagtgaatgaagaagcactccagtggaaagttcttatatgccattatgttcttttcctggcccagtgcctaagtgaagtaggtgtttataacttaacctaaacgtactaagatttcagatcaataaagtta

SEQ ID NO: 20963 - DNA, 1033 bp, Homo sapiens
ggcttgtaaaaggcagagctaaatttaaactcaggactttttatctgattccaaagcattttttttctaacatactttgctgttgtgtccttttcatcatttcactgaaacatgtttgttgaaatttcacacctggtaaatgaggggaaagaatagggactaagcagtttttaagaggcagggtcttgctctgttgcccaggctgaggtgcaatggccagatcatagttctttgtaacctgaaactcctgggctcaagctatcctcctaccttagccttgcaagtacaagtagctgggaccataggcaagtcccaccatgcttagctaattgttaaagggttttttttattttaaaggatggggtctcgctgtgttgtccaggctggtctcaaactcttgacctcaagtgatcctccttgccttggcctcccagaagcactggcttgactcttacgttgttttttaaaatctcctcttctgactactctttgagattacacagctgtagctgaggatggaaatgttattgaggatgggaggtggaagagcattgaaacttttgaatagggaaggagttgaatgggaactgcagaagcttataacacctttctcttcaaaattttcataaagctgttgaagttctcatcttaatagggttttttaaagcactttagacaacttatcttttccaggtagcccagggtgattcttgtggaactggtctgcagtggggtcactggtttgtcttgagatgcatagggaagattgacctgatagagtgatgtaaggaagtatgtgaaattgcctgttagctgtattgcaaatacagttgagagagggttcatccacagaggagtcacttaggaggtattaaggctgcatgtaactgtgacccattccagttcctttggtccttgtgtaaagcagaagcttgcttcactcttggagttttctaggcctgtgcagcctaagcatgatcctggctctgactcgggacatggcgaaggaaaaggagactcttgacctttttct

SEQ ID NO: 20964 - DNA, 1069 bp, Homo sapiens
tttgtgccctcagtcattctttaactgaaaactagctcaacctttgaggtctatgtcattaaaaattatttcttaagggtttttttttggtgggggtgtggtttttgagggaggcaaatttatataatatataatgatgaacatgacagaatatttttcaatttgatgtggcagaatcgaaatctgccaataaaacttaactatcttacacgtatcatataattcacgattctgttagtaagtggtttgcaaaagcatagaaattgagatgtgagaattttgtattttaccatgtgtaaaagcggaaacgtttttactctggaacatctatagtaccctcagcaagtttccattcaagttgtgtatggttgggattagactgggtgcagtggctcacacctgtaatcccaacattttggaaggctgaggcaggagaatcacctgagcctaggagtttgagaccagcctgggcaacatcgtgaggctccatttctatgaaaaaataaaattagctgggcgtggtggtgcacatctgaggtcccagctactgcagagactgaggtgagagtggttgcttgagctcaggtgattgaggctatagtgagctatgattgcatcactgcccttcagcccgggtgacagtgcaagatcctatctccaaaaaaagaagagctctcaaatatcttgttagtagttttcactttgtaatatagctttattttccctggtttgtgtatacttggactaagagtgtggactataattgcttgactcgctttcagcattagaggccagagttagttttatgaggaggccagagttagttttatgaggtctgttggcaccagatgagaaaaggggttagcttcagtctggaattactttggttttaatcttttgtaaggaaaagttaggatcatagttccagcctgttaccctcattccctctctcttcctgcttccttccttccctttgaacaaatatttgagtacctgccatttgctaggcattgttccaagcacccagagatattatggtgaacaagacaaaaatctctgttttccggat

SEQ ID NO: 20965 - DNA, 2035 bp, Homo sapiens
tggtgccatctcggctcactgcaagctccgtgtcccgagttcacaccattctcctgcctcagcatgcctagtagatgggagtacaggcacgcaccaccacgcccggctaattttttgtgtttttagtagagacggggtttcaccgtgttagccaggatggtcttgatcctctgacctcgtgatccgcctgccttggcctcccaaagtgctgggattacaggcgtgagccactgcgccccgcagtaatggttttttttgactgtatgtctgtttcctttgaggactttacgtgctgagctatttctaataaaatctaaataactaactttaatttttgtgaagtataaaatcctatctcagtttgaagttgggtctagttttcactctgtcgtaagtttttcaggtcagttgacttatttataagaggcttggttccggggattcttctcgtctatgattctatagttagtaacatgagttataaaaccaatcagaaaatgtgccataaatggaaacgtttccaccgtagtttccaactctgaatgctccttatcctctgctttgtcacattggtaactactgtggtgataacttactgtccagcagttatgtggcatttgcctgatgtctgtatgcagcttaagcattttgtggttaccctctgtgatgagcctagagatctctggggtaaatgttaaaagcggtctgggtatgttttttaaatgccttagtatttctgcctgattgcaaagatttatcggttggctttcctaaagttgttggattgtttaagcatactttttgagtagagtcaaagtatcctataaataaactgtttttcattcataatgtcatagtaaagccttgtttttaatttagtttgaaatcacatatagttcactgaaaacccgtatatgcatcatgtaatacatatctaaagttatcttcgttccttgaatgtatactttccttgggatttctgtttagctttcaggagcagtacagtgggggtggggacgggggtaatatagaactgttgacactcgatagctttatactattttctcatctgtagtaaggagacagaaaatctgcactttctttttgctctttaaaaattcttgctttacaggctggacacggtggctcacgtctgtagtcccagtactatgggaggctgagatgggtggatcacctgaggtcagcagtgtgagaccagcctggccaacatggcaaaatcccatctctactaaaaataaaaaaattagctgggtgtggtggcaggcgcgtgtaatcccagctacacgggaggctgaggcaggagaatcgcttgaactcaggaggtggaggttgcagtgagccaagattgtgcattgcactcctgcctgcatgacaagagcgaaactccatctcaaaataaataaataaataaaacttgggtttacaaaaatacctgtttgccaaagaaaaaatgaaaaaaattcgtggactttagtacaaaatttcagtgaaatggacctaaatctggacagatctttagagagtgtctaaatcaaaaggagaaactgttaaaaagaaaaattgttctaaacctcatctaaacagaatccgtgtgatataattcataacctccttctgagaagaaatgaacatttctgttatacacttgtctgataaaccttaatgggattaaggcttctgctggggaactagttacctccccactcagatgactgtcatagtctaataactttaaacaagatattgtcattttttaaaaatctagtttacgaattagccattgccatttcctaatatagctctatcaagagtgtatatgtctttaaattagtatatcagagaccttctttcttgcttgaaagattgtaataaaatactgacatgtggtcttaactaaactgggaaaaatattgtaagctgttatcagcaatgtagaagtcctagggagaatttgatagtagtctaagaacattagaataaagtttttctagttttagttctgcatgttagggaa

SEQ ID NO: 20966 - DNA, 1047 bp, Homo sapiens
ggtggaaggtcctatctccatgttgatggctgctgactagccagggtagtggctgctgaaggttagggaagctgtggcaatttctttccctccctccctccctccctctctccctccctccctctctccctccctccctcctccctccctcctccctccctcctccctccctccctacctcccctcccttcccttcccttccctttctttccttccctttctttccttctaattctcgatttctaattctagttatcttgctgtttcttcctcatctgcagttactttttcgacctgtgtcttgaacctctcagttatccatgagagtcagagtcaacttaactttgcatctgtttcagttttatcacgagattgcagttcagtcacatcttcaggctctatttctaattctggttatcttgctgtgtttttcacatctgcagttactttttcgagcaatgtcttgaacctctcgattatccatgagagtcggagtcaacttcttccaaactcctgttggggttgatattttgaactcctcccatgaatcatgagtgactcaatagaatggtgaatcctttccagaataattttcaatttactttgcccagattcatcagaagaatcactatctatggcagctatagccttacagaatgtattttttaaattataaggcttagaagtggaaattattgcttgatctgtgggctgcacaatggatgttgtgttaacaggcatgataacaggatttatatccttgtacatctctttcagacctctccggcaatggtgcattgtcagtgagcagcagtattttgaaaggaatctttctgagcatgaggtctcaatggtggacttaaaatattcagtaaaacatgctgtcaacagatgttctgacatcctggctttgttgtttcatttatagagcataggcagagtaaatgtagcataatttgtttttattttattttatagagacggggtcttgccgtgttgcccaggctggtctccaactactgggctcaagcagttctccctccttgg

SEQ ID NO: 20967 - DNA, 3217 bp, Homo sapiens
tgagccgccgtgcctagcctactcattttactttttacttacttggcttggcaagggtggtggtggtggtgttgctatctatgtctgagactgcaagctgggaactggtattcaaaacttagtttgtactgcatgatttaggcccttattatgtgttttattgctatcttgcctatcagccctatctcctcagtcaaatttataagcttcttgaggatgtggagcttgtcttttgattactgtatagtgctcagcagaatactgttcacattgcagtaattcatgtgatgaagatgatgggttgtcattgtaatcattttggcaggttcacagtaggcactcaggtttcaggcatagggtgtaccagttatttttgaataatcatgccatggcattcaagttttttaccagtttgcagcttttgcacaattaaggtatgacaaatgtaattttattgagggaaatgcttaatcagtgagctgaactttaatgtaaatttgaaatgaaaaggtcctgtgttctgatttcagattttcagaaactggatgttagatggacatcatgttagccttaataccatgccttaaaatgctacccatattttatttgtattcccattcacccattgatttgaacaaccatttttattcattgtagaagggacttaaataaatgtaaaaaccaggcaaaatttcttctcttttataatacatccttgatcatagatagaattttgtcacttctctgatatttaaaaataagacgggtggcagtttgagtatctataatgaggtgaagatcagcttgtgcttgaaaaccaggacagagggtttcaaagtgtaattgaaaaagactgtggcagtcttcttcatgtgctgggagaatgggaacatttgtcagtttactaaggttttgctttcctcttgtgctttatagaatttcttaaagaaatgtgtttattttacagtgaggactggtaatttcattcctctgtacccctgtaagtggtacagtgaaccacagatgtgttcaaagttagctgttgatatgtgatgagggaggggaaagaggagggacaaactgggatgttattttctatcttctatgtctagatttccttggctggagatgtatttagctgtgcagcagtgactgctgttctgtagagttctaaggcagcattacagggagaagccgtcttgaactgactctctaggtttgttgctattgtagtgttcggttaaaaaattcaagcccttgggaaggaatgtggtggggttaatcaaggtttcttgtttttgttttcgttctatcctttcctgaactgtttgtatgtatgaaacagccttttacaattccaaagcaggtccttttatctgtgctccaaaatgcccactgtgacccccacgtgttaacatgaaggctcaagtttgttgacttctgaaagtgttgtttctttaaaagacttttatttaaatcctctactttaaactttattgctgtaaattggtgattctcaacttgggctgcacattcagatcacgtgggaaacacttaaagggaaaatcccaggacccacccccgattaaattttgatttaatttatctggtgtgggtctccagcattcatgttttaaaagcctccctagttgattcctttttttttttttttttttttggagacaggatctcattcttttgcccaggcatgagttcagtggcaccatctcagctcactgcaccctctacctttctgggcacaagtgattctcccgtctcagcctcctgagcatctgggactacaggcacatgccaccatacctggctaatttttgtatttttagtagagatgggatttcaccatgttgcccgggctggtcttgatgtcctgggctcaaatgatctgcctgtgtcggcctcccaaagtgctagaattacaggtgtgagccactgtgcccagccctccctagatgattctaatgtatggtcactattaaggagtactgccctaagttctgtttttggagagtcctataaatttcttagtagaaaacaggtccacccccacccctaccctctcccacaagggagagttgagactgtccaatctgaatcttattcaaaagcacagaaatataatcttacaattttgcaaatacttagagtaggctttgaattatttttaaagtgatctccaatcttccctttaacagactttgcttgctaaatatattttgtctgtgttttaaaaacactccacactctgactgatttatcagattcctgataccagtaccacaaggacccaaggacctctagctgtgtttggtgaggcaggtctttgtcaatttaagtaatcctgtcagatggtgtagccaatcttgtaactcacgacaaagcactgttgctgagatactgtgatttattttccttaatgagcagtttttttatatatatacgttccattttcagacaggtggtgctttgagttgaatttgcaagttcagtgaaacatggatctcttttttatttaactcccttttcttctcctaaggtgcttaatttccatgcttgacatcgtaccagtatttgccagccaaaataaatgccaatattgtgattctgtagggaaagaagcaggtcatttattaattcaactagaacatactgcactgttcctttgttcaaggacctgaataggacaaacatggcccttgctttcatggtggtcaggtacattctctgaggggatgcagagatgaatagatttttttttcttttcatctctacattctattccattggcaaatcttggctccaccttcagattacattctgaaaataaataacattcctcatttgactgctaccatcaccctagtctaagctattatcatcctttgcctggacaaccttcgcagcctcccagttggcctccttgcttctgaagttactggtcatttatagtgtgtcgataacacatccgtgtccctcctcaaagttcttcaaaggcttcctgtcacacgtagactaaaattcaaactccatatcgtgagctgcaggctctagaggatccaagttctgtctgcttttatttacctcattggtgttgtctttatcacctctcttttggctctctgtgctccagccatgctgtttgccttgctcaacaagctaagtatattcccgcctattttcgattccttctgcctggaaa

SEQ ID NO: 20968 - DNA, 1411 bp, Homo sapiens
tatgtgcatgtttctgtagtttcccaagctaatgggagagatcttcaaaatgatgaaattttattgaaatcaaatagatacattaagaaatggaaatgctgaatagagcctagtttgctctacatgctctttggcaaattgttgggtcactgagacattttaagatagcaatataggccaggtgcagtggctcacacctataatccagcacttttgggaggctgaggcttgagcccaggaggttgagaccagcctgggcaacatagcaggcccctgtcgctaccaaaaaaaaaaaaaaaaaaaaaaaaaagccaggcatggtggggcatgcctgtagtcccagctacttgggaggctcgcttgagccagtaaagtcaaggctgaaatgagccatgattatggctccgtactccagtctgggcaacagagttgagactctgtctcaaaaaaaaaaaaaaaaaaatgtatagttgaggggaaaaaaatctgtcacctttaaagtcttggtataattgaatcttttagaatgtctgcatcaaacctgtggatccttggttgtatctctcgttaatctgggtaagatggagagatttctcatggacttgtgtttgccaaccttccatactatgttttatgttttattgtgaaatattcagagagaccagtgcagtgaaccttcccatgtgtgcattgcccaactgtaacaggcatctactcagagctgttctttttttttttatctagaccaccccttacttggactattttgaagccaattctgtacaacatattatttcatctgtaaatatttcagaatctatttctaaaagataggcttttttttttccccaagttatttctccctgtgcttcttcaaaaaagatttgtagtagaggctgtatagagggcacaaaagagtagaaattaagcacaagtgataccgacttccagaagagactatcaggtagacccagacccataaggggacagcaacgagaattcattattggaagatgtcatactccaacccctactggtctctacaagatttccagacccccctacactttgaatactaaaagtacctcagggtttagttctcaacatcctcctctttcctatctctattcttccgccccatcttctgcccttttttttttggagaccgagtctcactctgttgcccaggctggagtgcagtggcaccaccttagctcactgcagcttccgccttccagattgaagtgattctcctgcctcagcctcctgagtagctgggctgacaggtgcatgccaccgtgctcgattaatttttgtattttttttttggtagaggtggggtttcgccatgttggccaggctggtcttgaactcctgacctcaagtgatccacctgcctcggcctcccaaa

SEQ ID NO: 20969 - DNA, 1048 bp, Homo sapiens
ccattacaggtggagtctctctgatgtgaaatgtttgggaccagaggtgttttggattttggaatctttgcattatacagttatccttcagtattcttggatgacttgttccacgaacttccgtggataccaaatctgacagtgctcaaatccctgatataagatgggatagtatttgtgtataacctatgcacatcctcctgtatgctttgtcatctctagattacttataacacctaatacagtgtaaatgctatgtaaatagttgttacactgtattgcttagggaataatgagaagaaaaagtctgtacatattcagtacagacattgttttttaaatatttttgctgtttgattgattgaatccatgaatacagagggtcagctgtacttaccagttgaacatcccaaatctggaaacccaaaatgcttcaataaacattacctttgagtgtcatgttgacactcagaaagtttcctattttgggaactttttggatcttgggtttgggatgctgaacttgtatttgcatgtgtggaaagagatcaggagtcaaggcaggagtcaggaaatgtggcttctattcttggctaacttgatggtgtagggcagatcacttcactagcctaagctgcagtttgccactgttcactcctgagggtagctggagaggcttgagaacaaattttaacacactacatagtgcagacaccttttcatctgaatttttcctttgaaggatgagtcattcttatgaaacaattttcttttttttttttttttgagacagagtctcgctgtgtcgcccagacctgagtgcagtggcgtgattttggctcactgcaagctccacctcctgggttcacgccattctcctgcctcagcctcctgagtagctgggactacaggcgcccgccaccacgcctggccaattttttgtatttttttttagtagagacggggtttcaccatgatctcgatctcctgaccttgtgatcagcctgccttggcctcccaaagtgctgggattacaggcatgagctac

SEQ ID NO: 20970 - DNA, 1109 bp, Homo sapiens
gcttgctgcagcttcaacctccaggactcaagtggtcctcacaagtagctgggaccacaggagtgcacccttatgccccccttattaaaaaatttttttttctttgtagagatggggttttgctctgttgcccaggctggtctcaaactcctggactcaagcagtcctcctgccttggcctcccaaagtgctgtgattacaggcatgagccactgtgccaggctgttgtaatgtttttatgattctttgaagcagagatatttatcctttggtaaaaatattggagtcaaacttggataagttagaaattataaattgtttaaatttttgtctgttgatcttttgcctttagctttctttctcaacctaaaatagtagaaattcttcatccttccagacactaataggagaattttaaatttccttgtacatgtttttatttttggaaactacccttttaccaatatagtgaaaccttggctctactaaaatacaaaaaaattagccaggtgtgatggcacacacctgtaatcccagctgctcgggaggctgaggctggagaatcgcttgaacctggtaggtggaggttgcagtgagccaaggtcatgccactgcactccagcctgggcacgcagagtgagacttgtctgaaaaaaagagaaataaagaaagaaactacccttttaattcatcagagcgttttttgtttcataatacaaggaagtaagtcctctctaaccctctttccgaaaaagctgactagtatctcaaaaccacttaattttgtattactttctttgggactttggaagttgcataagacatacaggttaacttgtaaagaatatctttccagaatatgggttgccaaatttttactagattcatttagggtattttttgtgaggatactgtattcttgggcattttgttctttttaattccttttatgagtatacactctctgattgtcttttcttatttcgcacccagattttctgcagtagctcagtggaatattttgagcttagtgtaagatagaccgtttgtaaataaatgtaaagtattgcatagaagaatttatttgtcttagacccttaagcagcccc

SEQ ID NO: 20971 - DNA, 1022 bp, Homo sapiens
atataaaaaggaaagagcctaaggagattgaaagtgatggttatgggagagagatgtctatattaatagggtggtcagggaaagcctctctgaggaggtgacagtttgaatgagatctgtatgaagtgtgtgagcaagacctgtgaagatcttgaggaagagcattcaaggtgtagagaacacttgcaaaggccctaagatgggactgagcccggtttgttggattttcatcagtaagcccggggtggcaggagcatgcatgctgatccaggtatagaatgagtggtagaaggtgagatcaggagccctgtaagctgttgtaagcatcgttgttttaatttggtagaaactcagttataactcattcttaaatatttagctttatgcttaaaataatttagaaataaccttggacttccatctttttagaaatagctggaaggttagcactcagtatgttgtattacttctctgtgaaaggatctacagtagactgaacttgtctatgttatgagactgctcatgtctttattctttatattcataatgctgaacacaagatactcgtgttttttttttttttttttgacagaatagggatcttgcagttaacttagctgttcttaaatttctgtttataaaagccataatgcataataatttactgtagtcgttattcctagttttcccaggtaggcagtggtaacatctgtttcacaagataaggaagcagaaatttaacaacaatggcagaatcaggatgtcaatcttgtccttttttccttttcccactttgccatgctgccctctgggtaataagatggagactaatttttgaaggcttaatttgttgagccagtgtcattagtttttaggtaacattttaatacagaataagtgtgtcttggtcttattaacagtgctatgttatgtaaaggaatttagttgtaggaatattttctttgaaacaataatacctgtttttttatctcttgattgtaaagtgctgtgggaaatacaga

SEQ ID NO: 20972 - DNA, 1035 bp, Homo sapiens
ctgcctcagcctcaggagtaactgggactacaggcatgcaccaaacacccggctatcatttttctactctttatcatttcataaagtggtgggttgggaggaacatcagccaggatacccaagtcttctcagctaaacccttcttctgctaaaaactagctataggactaatgtaaccatttttctaattaaagtgagggagctgaccctacgtgacctttaggtctcaaactactttgaaatgtgactgtttatctttaaataacatgaatgaaactattctcatcaccatttttttgcattgggggaagctgaggcaaagaacccagcaaagcactggtataagttgaaacaaaacaggtttcttgacttgtgacttaaagctttggttcttctaatgccttcattcatttctttggttgatttacttttcatagtccattaaagtgattatcttatttcttgatgtatgggatagaaatgtgggaataatttcattgtattcttacagaatttacttcagagctgagtaaactttcatttgttgaacacctttgatttaatgccccttggcttttctcctaatctgcacatgacgtcaagtggcagaagtaggaacttgtgtttttttcttctattctcttctcatttttttcctgagaagaaacgtaggtagtgaaaatcattcttagtgcttgttgtgggattctgaagaaaggaacttaggcatcaggaatttgggtgttacccatttaccgtagatatagttgctatagtgttttctgccaccttgtgattgttgtttttgttctctgaagtgaacgtactcttttatggtagtgttaaagtcatataataagtacttatggagtaagtaaatgtgtaagacacaagagataacagatgaataagctaagtttgtatcctcaagaagtttaaagagtgaagggagtgaagaacttagtaagacaaagatgaatgtttagaacagtgcctggcacttagtgatgttagaaatgaaccttgaaggttggc

SEQ ID NO: 20973 - DNA, 1048 bp, Homo sapiens
ttgtaggaaattacagttgcttttgattgaactttcagcagagagcacacccagtcttcaattttaacacttgagattttcttacattttaaggactgacaattagaaaatgcttcagaatatttaatacatcgcctccaagcacagtctagtttcacaacctgactctcttcctattaaaaaaaaaaaaaagcccattttaagcagatttgttaagctgagttaaatgtattgatgtatttggaataaattcttactgggttgttttttttgttgttttttgttttgttttgttttgagacagttccgctctgtcgcccaggctggagtgcaggagtgcagtagtgcgatctcagctcactgaagcctctggctcctgggttcaggtgattctcgggcctcagcctccctaagtagctgggattacaggtacccgccaccaagtcaggctaatttttttcttttttcttttcttaagtagagactgagtttcaccgtgtcgaccaggctggcctcaaactcctgacctcgtgatccgcccacctcatcttactggtttttctaaatctgttggtttgagaaaattttacataagctttttatgggtggcactccaaattggcatggtggagacagagacgtttcattcctgtcactcccaattcagcatctatgtacttaattaaataaagcagtactatattataacatacttaaagatacatgttaaataagtgcatttatctccttaggaatatcagatttgagagagagcatgaggagttggaaaagaggggcaggataattgactagcagatctttcattttctctttgctagaggctggcttactagagaaggctgaaaaagatgaatatgtgggaagaattggtgtttccttgactgtattaaaaggtgatgaagattttcactggagtgtttggttgttgagacagctatgatttttaaaagtaaattttctggtttcccaattttgtttatattatctgcatggatattgtatctgaaatgaaactttttttttctat

SEQ ID NO: 20974 - DNA, 1287 bp, Homo sapiens
ggcagtttagacaacagcctcaagtagtgcttttgttaaaaatatacatgtttttaaaagtgcttgtatttctaatattcttttctcctttctcttctagtctgttctctggggaggcagtaaggggccgtggagctggcctcggcctcggcatcgggagaggctggacttcctgtctctctgtgctgaatggctgcgatggcgcccgctctcactgacgcagcagctgaagcacaccatatccggttcaaactggctcccccatcctctaccttgtcccctggcagtgccgaaaataacggcaacgccaacatccttattgctgccaacggaaccaaaagaaaagccattgctgcagaggatcccagcctagatttccgaaataatcctaccaaggaagacttgggaaagctgcaaccactggtggcatcttatctctgctctgatgtaacatctgttccctcaaaggagtctttgaagttgcaaggggtcttcagcaagcagacagtccttaaatctcatcctctcttatctcagtcctatgaactccgagctgagctgttggggagacagccagttttggagttttccttagaaaatcttagaaccatgaatacgagtggtcagacagctctgccacaagcacctgtaaatgggttggctaagaaattgactaaaagttcaacacattctgatcatgacaattccacttccctcaatgggggaaaacgggctctcacttcatctgctcttcatgggggtgaaatgggaggatctgaatctggggacttgaaggggggtatgaccaattgcactcttccacatagaagccttgatgtagaacacacaactttgtatagcaataatagcactgcaaacaaatcctctgtcaattccatggaacagccggcacttcaaggaagcagtagattatcacctggtacagactccagctctaacttggggggtgtcaaattggagggtaaaaagtctcccctgtcttccattcttttcagtgctttagattctgacacaaggataacagctttactgcggcgacaggctgacattgagagccgtgcccgcagattacaaaagcgcttacaggttgtgcaagccaagcaggttgagaggcatatacaacatcagctgggtggatttttggagaagactttgagcaaactgccaaacttggaatccttgagaccacggagccagttgatgctgactcgaaaggctgaagctgccttgagaaaagctgccagtgagaccaccacttcagaggga

SEQ ID NO: 20975 - DNA, 1050 bp, Homo sapiens
cgaatgtggcagcttaggcctgtaatcccagcactttggaaggccgaggtgggcggatcatgaggtcaggagattgtgaccatcctggccaacatggtgaaaccctgtctctactaaaaatacaaaaattagccaggcgtggtggcacgtgcctgtagtcccagctacacgggaggctgaggcaggagaatcacttgaacccaggaggcagaggttacagtgagctgagatcataccactgcactccagcgtggcgacagagcaagactctgttaaacacacacacacacatccacacccaccaaataaaatattgggaaaatgtttaagttcatgattgttgatacaagttttcaaaaacactaatctttgcctaaaaaattcagattttattattggcagcaaatatcgtcagtggtcttccttgaagtgacaggttcactttgttcatttgcaaggaaatgtctgctagtgaagcaggtttcaaataatgtttgtcagtagttctgccaagtaaaaatcgtgttccatgaacaaagctctagttcattttgcaactcagttgtactgtgctttttcctgagaattcataaagcagcagagtgctttatgcatactttccctttcatcacaaagaatatttttaaaaaatgcactaaaggctcaagataattcataatttttgctgttcatcaaggacatcttaagtggaactcccttaaaaaaagaaaaactgagtggagagtataatgactattagtatagtttggtgcctcttccttgatttgtgctaataatgtaccagcagttttgttcacctttgtttttgtactctgattgcaaatgtcaacacagtgtaaaaggcagataatattctagtattgctatgaaaatacctttgatttcacgaacctccaaaatagcctgtgagatccccagaagtccagagaccacactttaaagaacaactggcttagttctttacgtatgtttcctttggctcccagaccacatagatcaagggggatcaaacagaggcaaatgactgag

SEQ ID NO: 20976 - DNA, 1100 bp, Homo sapiens
gaagtaatacatgtttatggtggagactttacataagccaagaaacaaaagacaaaagaatcttaaccaatgactttttaaagcaaaattgagatgatactgtgttttgttttgtaactttttttcatttaataatgaagcaagcacttttctatgttagtaaatatagctctgccacacttagggttgcacagtattccattgtatggatatttaataatttaaccgagtttttggcattcagttttctttttattataaacaacatcatgaaatattaaaagtaagtctagacataacagggaaaagattaaagtactaaacttaggtggtggtttatggcaattgtagctaattgcaaactaggtgcattaaaaagccatggaaattcattccttctatgtttcctttttgtttccagtgtaataaaagtgcaaataatactgggtggttgctccaggtacgtggccaagtaattgaaagtatcttatttcatcatcatagcatccttgtcgggaaggctctgttacttgtagatgaggagacttaaagaacagaatagttaagtaacctacaggaggtggagccaggatgggaactgagatttgctcacttgagtcagtgctcctcttacttatgaatatctttgggagtaatgttgaatcttagcatagtatttcgagtcaataaaggtatgtcaagtcaataaatggtatttctttggtatagaaatctcaagatttaggaattaggaatgggaattttttcggaaaaagtggtcactttttcctgttctctgcactctctctcctcccccacccccttacttagatgattgttttagtaactacactatgctgtgtatcctatggggatattgagaccaaggataaagtgcaaatcaaataaactattgtctttgaagtgtatatgttaatgtcaagttcatagacatcatttcagagaagtcttggagtagatgggatttttttttttttttttaagatggagtcttgctcttgttgccccggctggagtgcagtggtgcaatcttggctaattgcaacctctgctgcctgggttcaggtgattctcatgtc

SEQ ID NO: 20977 - DNA, 1061 bp, Homo sapiens
agcaggaggaagttttggatttggtgttggggcagggaatgggttttgaatatgggatgcttgaagtagttgtataggcaatgctgaattctactcatttctttctttttgtttttttggagacagtctcattctgtcgcctacgctggagtgcagtggtgccatctcagctcactgcagccgctgcctcccagattcaggtgattcttgtacctcagccttctgaatagctgggattacaggcaaagacggggtttcgctgtgttggccaggctggtctcaaactcctgacctcaagtgatcttcctgccttggcctcccaaagtgctggaattacaggcgtgagccacctctcccggccctactccttcccttccttccctccctccttccttctttccctccttttcttctctcacctcctctcccctctcccctgtctcctctctcctctctcctctctcctcccctctcctcttttccttcttttgagacagaatcttgctctgtaacccaggctggagtgcagtggcgtgataacagctcactgcgacctccacccgccaggctcaagtgaccctcccactatgcccagctaattattatttttttagagactgggtctcagtgtgttgtctaggctagtctcaaactcctcctgggctcaggcgatcctcctgccttggcctcccaaggtgctgggcttataagtgtgagctaccatggtaggccatcatttaaaaaaaaaaaattagtgtttttgtttgggtggcttttttagatgggggctatgttgcctaggctggccttgaactccttgcctgaagccatcctcctgcctcctgagtaactggaaatacaggcgcctgccactgcacccagctcctactcattctttaggtttcagcctggatgttcttttttctgaaaagcattttctgactccgcctacttctcagcctgtatgaggattgcctccatcccccaaatcacacagtagtgtctctctttactgctgcttgtcatccttgtatgtacttactgtggtgctttgaatactc

SEQ ID NO: 20978 - DNA, 1051 bp, Homo sapiens
cccccgcccggaaagtcagggcggctccgggcgtcggggggaggagagcggcgggcccgggccggagccgccgtcgcgcgcccccgcccgccgctggccctcggcgcccaggccggggggctgtttgcaaactgcgcccattttgtggggctgaatccgcccgggctacgctcctccatcacgtggtaggtgctgctgctgctcctctcctcctcctcctgctgccctttctccttctcctcgctctccctgtggctcccatttctctctctctttgttagttgtaactagaaaggcagggcagggtagaaaaatcccccggaactttaaatggcctctccgggcttccctgctgcgggtccgggctgggagtcgccccaagggcgggggtgtgcgggggcccttccccaggagctgccgcctcgttcgccagcttttcctttggcgttctatttaaaaaggcggcctgaagaacatgatttattcccgtaaaagaaccccccaaacaaactctggctctcgccttgaacttctcttgactgcaaaaggcctttctctgctcgaaacacacatcttggcgcgttgcacggtttgtatcacaactctgattgtttcatttattatttttgttgcctgtaaattcaggtcacttacgttttcagatgtagtctccctcaggcggactttttttttttttaaactaaagaggaagagggatttatttgcttttaagtgagttggaatcttaactgcctttttgggggcctgttttccggctgacggtcttttgattcttagcaaatagtttgttttccatacgataaacagcgctactcccgtgtcttacttaaaaatcctcgttttccaatgttggaatcccaatgtggatttatagagaaacgtgctacttaactattgcttactgattgctttaggggagaaggggtgacatgatggcgccactttaaattgctctctttccttttcctcggtcccccccacccccctttatcctggaggtcactggagcattttctgtgacttattaata

SEQ ID NO: 20979 - DNA, 1044 bp, Homo sapiens
agtgctagtattagagatgtgagccaccacgtctggcctgaaggacttcttataccaaagaagatacagtttcatttaactattttattttattttttctgatgctggttaaagttggttcatttgggacacatttcattagataaaattgtgtttaaatgtgatagtgagaatttggaatatggtggaaaatattgaatattatattctataatttttgtcagtctaattcagaaacaaaaaagattgcagttgagaaaatcatacatgatttctttgtaaatgagttacagagataagacaggacctttagcatttcctgaattccagtcatgttctcggtaacttatggtctcttttataatattgtacccatgacaatttatacgttagatttcaggttttatcttctgcctggaaggattacattcaggggttttagccatgcatatttatctataaatggtctaaaccagtacctctttatctttccttaaagtacttttcagggtctagggctgtttggagctgtttgttacaagcaggacatatctctctgaggactccttttctatcttgaaacagtgagaattctgccttttgctctgtatacattgaatatcccttatccgaaatgcttgggaccagaagttttttggatttcagatttttcagattttgggatgtttgcatgtacataatgtactatcttggagatgggatccaaatctaaacatgaaattctatgtttcatgtacacattatgcacatagcctgaagataatttcttttttttacctttttctttaagagatgatgtctcatactgttgcccaggctggagtgcagtaatgtgatcctagctcacagcagcctagaactcctgggctcaagtcattctcctgcctcagcctcccaggtagctggtactaactggtacagatgcacggtgccaagcccagctaatttttttgtttgtttgagatggggtctgattctgttactcaggttggagtgcagtagcgccatctctgctcactgtag

SEQ ID NO: 20980 - DNA, 1409 bp, Homo sapiens
agatcacgccactactctccagcctgggccacagagcgagactccgtctcaaaaaacaacaacaacaacaacaacaacaaaaaacaaataaaacgcttgtcccccttgccttctccatcacagctctgttaagtatgagtttagatacacagtattttcttttttattaccgtgtataatttgtatttgtagcagcagcccagaagacaggcaagcgtatggttctagctcacttttttttactgggcacttgatggtggtggtaatttatctgtcagcagggggagctgcagttgctgatatttaaatgattccatctcagctggttttccacagaaagtttgtcggccaagagaaagaaaagttttgctggcaaagaacatgatcagagttcataaggaagaaatacaaatgaccaagaagcatatgagaaacatttttatcctgataagtaatcaaaggaatgcagattaaatgacatactctttttttaacctatcagatttacagttgactgtgctgtcgaaggtggtgaggggacaatctctgaaactgctagtggagtgtgcattgggcctagtttttttgaaagatattttggcaacatatattggcaaaattaaaaacgttctttaattcagtaattgcacatctaggaatttatcctaaaggggaaaaattaagatacatagaaagatttgtgaacaaagatgttcattgtaacattattcatattagtgagaattgagaataaacctaaatgagcagcaagatttataggaaaataaatcatggtatatttaaggatggacatttacaaccatggaatagtatttgaaagaatttttctggccgggtgcggtggctcatgcccgtaattccagcacttcaggaggccgaggtgggcggattatgaggtcaggagatcgagaccatcctggccaacatggtgaaaccccatctctactaaaaatacaaaaattagctgggcgtggtggcacgtgcctgaaatcccagctactcaggaggctgaggcaggagaattgcttggaccagggagttggaggttgcagtgagctgagatggtgccactgcactccagcctgttgacagagcaagtctctgtctaaaaaaaaaaaaagaatttttaatgtcttaggatgttgagtaaatgataaatgaaaaattcagggtgcagagctatataaggagcattctaagtgtataaagataaggaatgtatatatgttctagtataatatgtatgtatatattacacacacatacatactgaggtaaaagaatggaaggaagtctataccaaccagcctccttgagtctgtctgtccggggtctgtccaaccaattgttctgtctaaattggcaccaagtgatgttttcaggtgaaa

SEQ ID NO: 20981 - DNA, 1034 bp, Homo sapiens
aagtgttgagcaccagtgttggtggcctctgtcctctttaggaagcaggcaaggggattgagatcaatacattggatttcattttatagtttcctaggttttaacgaatgtatttggtacacaaagccctacttttaaagatatttccagtgtttaaggttttacctctaaatctctctgaacctgggttgtaatacagtaacctcagaagttctactagaggtctctggcatggcaggaatagagaaaggaaatcagctccatatcgtgagttaccacctgttactacttaagaatgcagttaggtggttgccttaatattatgttccttaccaatcctttgctcagtgggaaacatcttctaagtgtaaaccaattttggggggtaatgttttcttcctatttttattacttagaaaccttaaaaattacagtgttcgtctggtcagaaaaaaaggtcctttttgcggggaggatagcattgagtttgtgggctggaaaataaaagtggggagagggaactttattctctttttcattggtgaatatccttaaaacatttctaagatgtagtttcagattggagctacttaatttaagtaaaaagaaatgataggttaattaaagtgcatattttggagcccaaatgtttattttatatagatcttatattttgtttccaattatcttattgtagaatgaactctgtcgttctgtcaggcattgcgtaaatgttagactgagtatgtgcttgtttccatgcgtatagaaaatagcgtcacactcactcagtcttcacaaatgaaaatgccagaggaggcaagtaacaaggaagaataactccaagccaaaactcctcaatttaaggcactctcgttaattagaagttctcatggaaattattatttatccctttttctctgtgttaggggtctgtacctttttaaagcctgaatatttctagccacgactaagcaatgtcagtgatgttactagggtctagttgtcagggttagggctaaggagtgggtgag

SEQ ID NO: 20982 - DNA, 1057 bp, Homo sapiens
atccccctctccgagaaacacccaagaatgatcaataaatatgaagggaactcagaggccggcagcatcctccatatgctgaacgcaggtaccctgggcccccttatttctttgtctgtactttgtctctgtgtctttttcttttccaagtctctcgttccacttaacgagaaacacccacaggtgtggaggggcaacccaccccttcaccacaccaaggtcttccgaccaagctttgagtaccattattgcagaggaagctcatcttaggtaacttattactagagcagaaatcacctaatataaagtatttcatgtatcgcatttaaaactgacttttgggttcattgatgtagtgactcaactgggaatcttaaatggaattagtgttttcactgacaataagaatgcctactttttcattataggcccataagatggcccagcctttccttgaaccagtagaccctaatgatgcaccagattattatggtgttattaaggaacctgtgggtacacatgagttgaatttgaagttttttcagaagtctcagtgtatattttattaaccataaaattaatatcttagaatacttttagcaaggctggtgggggtataaattggtatggtcactttggagggtaaattgatagtatctattacagttgaattgtgcatactcggttattttattttatttttttgagatggagtctcaccctgttgccaggctggagtgcagtggtgtgatctcacctcaatacaacctctgcctcccaggttcaagcgattctcctgcctcagcctcccgcgtagttgggactacaggcacgtgccatcacacccgactaattttggtagttttagtagagatgaggtttcactgtgttggccaggatggtctcaaactcctgacctcaggtgatccgctcgcttcggcctcccaaaatgctgggataacaggcatgagccaccgcgcccagcccccacagtgatcttcctttgaggaaaagccacggggtgctttctctcttctgtagcaaggaagatggtttc

SEQ ID NO: 20983 - DNA, 1076 bp, Homo sapiens
acctcaggcctaaacccaggcctactaaatcaggatctgcagtttctcacaatcttcaggtgatttctatggtcattaaagtttgaaaagctgcctcgaaacagtccttcctaaaactgaagtggaggtgccacaaaaatcatctggtaaattgtttaaagtaatcccaaatgcaactcaaatctacagaatcccaggtgaagctcagtaatctgtatttttatccttctccccaaataattctgatgtgcaggcaagtttgaaaaccactgctttaaagaaaatggatactccccttaccaagcagaaagtaggattttggaaactgatgcaagggaagcaaaaagatgcctcaggaggcacgattacaacaggattgatgcaaacggaagctgaagcttaaccaaagacattaatatacgcccacaaaagaaaatgctaaggaagtcaagtggtctgcatgaattctgaagaaaaatggagaaccaaagaacaaaatttgtcaatgaacttccagcacagtctaggttaagggagtgaatttcttgactgaatggcacagactctgtaccacctgattggctgttaccttaatggaggaattatattacaatgtataggtactttaattagaatgacctggcagttactgaggcaaaattttccgctcctttgtattctgtaatacaagaaggatctacatggatgttctgttctctgaactgtctggatgaaccggtcaacggcactcatcataccttagtttttaaatctgcattgtggtcataatctgttatttaattaatttctcgtatttttataaaaactttgcctatatattttagacagaaattgccttactttgctgaaatgctgagaaatcctagacagttttcaaggctgggctcaaatgtcacctctactaccctttgctgtgcctcctggcactgtgcttctgacactttgtacggtcctccatgacagcgtgagcacaattatattacaggcaattactcatgcccccctggctcatctgttgactcctttagagcacagatcatgttttatttattgta

SEQ ID NO: 20984 - DNA, 1050 bp, Homo sapiens
tttacactcactgggatggctatgagaagagacagacaacgacagtgttgacaaagacccggggaaattgaaaccctcaaacactgcagatggaagtgtaaaatggagcagccactgtggaaatcagcctgacaggtcctcaaaaagttaaacataagagttgccatatgatctagcaattctgctagggatgcaccctagaattaaaaacatgtccacacaaaaagtagtacatgcatgtccatagcagcattattcataaaagccaaaataaagtagaaacaaccaaatgtccactaagtgatgaatggatgaacggatatagtgatggctccatacaatggaatatcactcagccttgcaaaggaatgatccatgctgcagcatgggaggaccttagaaacaacatgcttcgtgaaaagaaactagacacaaaaggccacatactgtatgattcgtttatatgaaagatctagaataggcaaatccatagggactcaaagtagattagtagttacctgggcctgagggaagacagcactggggagtgatggctaatgggtaccatgtttttttgggggatgatgaaaatgttctggggttagataatggtgattgtttgctatacaaccttgagaatatactaaccaccactgaattgtacactttataatactgcgttgatggtatgtggatcaagtctcaatttaacacaaagaagcatgttgtgctgtatagaacaccaggtgccagaagaccaaacatgctggcagatggaaagaagaggagtgaagattcactctcccttgaccaagatcagagtgagtcagtggcgaggctgggagccacacagcttgtcctgccttgtgatccccctcctcttcctattccagatggtttttcagtgccattaacttgttttgtaacactaatattcaataagatgatgttacaaagagaaagaatgtgagtgccacatgactggttaagtatggattctcaaactagggctttaaatatccttcgtgatttttttttggcatgaaaagt

SEQ ID NO: 20985 - DNA, 1030 bp, Homo sapiens
catccccttgtcttctggtaatagaatttccttcttgtttttcttttgggatgagccaccttcgctccctgggattcctctgggattgagttaccgcctcaagcgatcctcccacctcagcctcccaagtcgctaagaccacaggtgcatgccactatgcctggctaatgttttgtattttctgtagagccggcgttttgccctgttgcccaggagtttttcctttaatgttctcctgctacttactaatttgctttgtcaccctctgagctcataagagcagagagatagcaacaggacctaagtagctctaagctgtgaaaaaatattaaatatgaaatcatggtagctattagcttaatttgttttaggcaaattgcaaagtaattttttgggaaccactgtcccactgcagtgattccatatggggattcctaatttccagtttgtttttaaaataatttgtgaacacctaatacaaacacatgatatgaaattcaagaggtacaaaaggacatacagccctgcaccctcccaatttccctccccgaaggcaaccaccattaccagtttctcgtgtgtgcttccagaagtattctgtgccagttttgtccaacagaacttcaatgatgaaaacagtcacccgtgctgcccagtttggtagccattagccacatggggcagttgagcacttgatatgtggctagtgtgtcttaggagctaactttaaaaaaagttttttttttttttttaagacacaggtcttgctctgtttaccaggctggagtgcagaggtgtgaacatggcctcaaactcctatttatttattttttgagacagggcctcactctgttgtccaggctggagtgtagtggtgcagtcatggctcactacaaccttgacctcctgggttcaagaaatcctcccacctcagcctcctaagttgctgggactacagatgcatgccaccatgtttggctgatttttacatttttaaattttttggccaagtgcggtggctcacacctgt

SEQ ID NO: 20986 - DNA, 1794 bp, Homo sapiens
acctgttggctttatcggactacgtgttttcccatccagatttgaaacagcatcttaatgttttacctaatatttacattttaactaaattttaatgagatgacacatttctatatatttattaattatttgccttttatgtgaattttctatttctattaagattgtcattttttcttttgacctgtttcttttttttttgagacagagttttgctcttcttgcccaggctggagtgcaatggcatgatgttggctcaccacaacctccacttcctgggttcaagtgattctcctgcctcagcctcctgtgtagctgggattacaggcatgctccaccacgaccgactaattttgcatttttagtagagacgggatttctccatgttgttcatgttggtttcgaactcccaacctcaggtgatctgcctgcctccgcctcccaaagtgctgggattacaggttgtgagccactatgcccggcctctcttaatctatttctgagagttctgttacatattctgatgtttaatcttcagttatatgtattagatatcttccaccaaagtacagtttgccttttaattttattagattttctattgcatgttgaaaagtaggtgatatttttgtgtcttatctaagaaatacttcctgctctaagtcccgaagatgttcttttaagtttggctgttcatgtttagcaatttgaagtgccaaaattttgtaattatatcatgaagaagggaactaattttactttttccttctaaagaactggccagtttagtactattgaatagtttcattttttccccactgatctgattaaaagaaaatttcccggtatcttttatgtatctagttctacgttttgaggctctctacagttttgcagcaaatctggctatctggtaatgtgtatttgcatcatgccttcttccaaatttcttgctgttggtcctttatgtcatgtgaacttttggatctgtttctcagctttcattaaaaatactgtaggcaatttgactggaatttctttgaatttatagatgttcatgagaatcaccatccttaaaaaatgtatcctaccatttgtatagagcttcatgctttcaggcattactgttttctctataaagattttaaatatatcattagttttgtcgttgttatgaatgatacttaaaaaatgaatattttctacttttttattagttttcaaatattctttactgaacacttttgctaaattctttattagttttaatagttcttattgtcagttggatttcctgtatagattattcttaatatatgttttattttaacatggacaatatttttatctctagagaaattaatgcaatttcagagaaaccgtgtgccgcaggatcaggatggtagaaggcagttccacttaatttgggaaatacctatttgaaagtttatatccatgtgcatcctgaggagtggggggtatctgtctctgtctgttttgggtttttcttgacactagagttagtctctgcaagggcctttagaagttaaattccaccctccacccccaagtctggtatagatattactactactcttggacttcactcaatttatttctttttaggagacacaggtcagaatggagatgggctgcagaccgggcagctattgtcagctgctggaactggcttcaggctcatgtttctgacttggaatatcaaattcgtcagcaaacagacatttacaaacagatatgtgctaataagggataggtgtctggtgttttttagta

SEQ ID NO: 20987 - DNA, 1035 bp, Homo sapiens
ccatgtttaaatttaattagaattaatttttgtgtatagtgtgagatacagtggtccaacttcattctaccgcatgtgaatattcagttgtcccagcatggtttgttgaaaagaccattgtttgtttcttgtagagatggggtcttgctttgttgcccaggctagtctcgaactcctggcctcaagcagtcctcttgcttcggcctcccaaagtgctgggactacaggtgtcagccacagcacttggcttaaaaagaccattctttcctccactgaattctcttggcattcttgtcaaaaaaatcaattgactgtcagtgtaagggtttatttctgaacccacaattatattccattgatctgcatgtttatccttataccactaccacactgtcttgatttccgtagctttgaattatgttttcaaatcaggaagtgtgagtcctccagctttgtttttccttttcaagattcttttgggtatactgggatcccattggtggttctgtagatcaatttagggaatattgccattttaacagtgttacatcttctaatccattctcatccatgaacataggatgtctttccttttttttttttttttttttgagacacagttttgctctgtcatccaggctggagtgaagtacagtagtgcaatcacagctcactgcagccttaagtaggttcaagtgatcttccctcctcagccccccaagcagctaggactacaggtgcatgccaccacacctagctcatttttgtattttttgtagagacgaggtcttgccatgttgcctagtctggtcttgaacttctgggctcaagcagtccacccacttcagtctaccaaagtgccaggattgcaggtgtgagccatcacacctggcctttccgtttagttaggatttctttaacttcttttggcaatttttatatatttcagagtataagattgtcactgcttttgttaaatttatttctgattattctttttttgttttgagacagagtctcattctgtcacccagg

SEQ ID NO: 20988 - DNA, 1124 bp, Homo sapiens
taagtctgttactttgttatttctaagtgtttcttatattacttttcctcttcattgtagattatattttcctgctgttttctatgcctagtgtttttttttttgtttgtttgtttgtttgtttgtttgtttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggctgcctagtgttttttaattggatgtcagttattataaattttactttttttctttgagacagggtcttttactctgatgcccaggctagagtacagtggtgtgattatagctcagtgcagcctcaaactcctgggctcaagaagtcctcccacttcaggctcctgggtagctggaactataggcacgtgccacatatggctaatttttttttagttttgcagagatggggtcttgctgtgttgctcaggctgttctcaaactcctggcctcaagcaatcctcccacctcacccacccgagttgttgggattacaggtgtgagccactgtgcctggctataaattttacattgttgattactggatatttttgcattcctttaggtattttaaagttttattctgagatgcagtaaagttgcttggaaacagcttgatcccttcaggtcttaccttttaaattttgtccagacaaaagtagccttagtctggactaatcttgtcccaccattgaggaagtaccctttgagtactctcctcaaaaacctgtttagtatgaggtttcttcactctgcctattgaaagtatgagctattcccagcttggagtgagatccagtaattattctgtctgcttcttttcagtaatactttccccagctttgggtagtttcttcactatagtactataatgtaattctgatgctaactac

SEQ ID NO: 20989 - DNA, 1034 bp, Homo sapiens
ctgtctgcccaactcttgcacaacacaagtacctaatcatagtttatctcacagacagcctgagacagttcttacggaaacaccccaggacacaattgtaagtgtcttatattctagtgttcaaaatattatgaaaactacaaagaatgatctgaactaaataatatattgtgaatgacttggtagaaattttctgtttcaggaattaaacagattgaatttagaatcttccaattcaaagtactccttgaatacagattcctcagtgtcttatattgattcagctgtaatttcacctgatactgtcccactgggaacaggaacttccatattatctaaacaggttcaaaataaaccaaaaactggtcgaagtttattaggaggaccagcagctcttagtccattaaccccaaggtaagtcaaacaagatactttcaaatgtgctataataccaaatgatcttatgataactcatattgttagtaatgcagattattacaacagcaacttctaaatcactgtggaaacaggggcattctgttttcagaaaatgaagtaaaaactggcaaatagtgatgttgccaggtgcggtggctcatgcctgtaatcccagcaccttgggaggccaaggcaggcagatcacctgaggtcaggagttcaagaacagcctggccaacatggtgaaaccctgtctctactaaaaatacaaaaattagctgggcatggtggcgggcgcctgtaatcccagctactcaggaggctgagacaggagaattgcttgaacccgggaggcggaggttgtagtgagccgagatggagccactacactccatcctgggcgacagaccaagactccaactcaaaaaaaattgatattgaatattggactggccaggcgcagtggctcacgcctgtaatcccagcactttgggagaccaaggtgggcagatcacgaggtcaggagatcgagaccatcctggccaacatggcgaaaccccgtctctactaaaaatacaaaaaactagccgggtgtg

SEQ ID NO: 20990 - DNA, 1084 bp, Homo sapiens
ggggcctctctcaagcacaaggttttgaagattatgccggtgcagaagcagacccgtgccagccagggcaccaggttcgaggcgtttgttgccatcgaggactacaatggccacgtcggtctgggtgttaaatgctccaaggaggtggccactgccatctgcagggccatcaacatcctggccaaactctcgattgtccccgtgcgcagaggctactgggggaacaagattggcaagccctacgccgtcccttgcaaggtgacaggccactgcggctctgtgctggtgcgcctcgtcgcacccccaggagcacgggcatcgtcttggcacgtgtgcccaagaagctgctcatgatgactggtatcgatgactgctacacctcagccaggggctgcactgccaccctgggcaacttcaccaaggccacctttgatgccatctctaagacctacaactacctgaccccggacctctggaaggagactgtattcaccaagtctccctatcgggaattcactgaccacctcgtcaagacccacactagagtctccgtacagaggacccgggctccagctgtggctacaacatagggtttttacacaagaaaaataaagtgaattaagcctggaaaaaaaacaacaacaaataaaaacctggtcatttatgctatatttaaagcatttaaatcactttcagaattaccactgggaatgttgtattaaaaattaaggccaagcgtggtggatcacgcctgtaattccagcattttgggaggctgtggtgggcagatcacttgagctcatgagttcgagacctgcctgggcaatatggcaaaaccccatctcgacgaaaatacaaaaaggccaggtgcggtggctcacacctgtaatcccagcattttggaaggccaagacaggtaaatcaccagagctcatgagttcaagacccgcctgggcatcaatggtgaagcctggtctctacaaaatatgcaaaaattagccggatatggtggtgcgcacctatagtctcagctgttcaggaggctgaggtaggaggatggctttagcgtaggaagtaggggttg

SEQ ID NO: 20991 - DNA, 1031 bp, Homo sapiens
gaaaccttgtctctactaaaaataaaaaagttagccgggcatggtggtgcacgtctgtaatctcagctacttgggagtctgaggcacgagaattgcttgaacctgggaggcagaggttacagtgagtcgagatcacaccattgcactccaacctgggtgacagagtgagactccatctcaaaaaaattaaataaataaataattcatgggttgaagaggaagtctcacaggagattttaaaaatatattgaactgaatgaaagggataataaatatgacatattaaaaactatgatgttgctaaagtcttacagcgaaatttatagcactaaatgtttgttataaaagaacagtttcaactctgctatctaagctttcactgtaagaaactagaaaaagaagagcacagtaaatccaagcaaacagaaagaaggaaataataaaaagtagaaatcagtgaaattgcaaacagaaaaacaatagagaaaatcatagaaaccaaagctggtccttggaaagattggtaaaactgccgaaagtgaccccaaaaaagaaagagagagaacaccattacttatatcaggaatgaaagaaggaatatcactacctaccctgaggacagtgaaaggatgtgtatgctgaaaacttaaaacaactctatgcacatgaatttaacaacttagatgaaatgggccaatttcttaataagccacactaccaaaactcacctaagaaatagaaatctgaataatcctaaaattatgaaagaaactttaatttgtagttaaaagtcttccctaatgctacataatctcttccagaaaacagaacaagaagaaatactcctctactcatgaggccacatttccttgattccaaaatgaaatactgttctaaaaaggaaaactataggccactattccttaagaatacatgtatacacaaaaatcttcaaaaaaaattaggaaatcagatgtatcagtgatatataaaaataatactatttctcagaaaattgaaactagaattac

SEQ ID NO: 20992 - DNA, 1113 bp, Homo sapiens
ttctatcctcccgaaagatttattagaaaaatattacctaaaaacaagatcctttactggtagtctgtttaaaggcaggggtgtttctgtgtgtgtatgcttttcttaaatatttacagagaataccatgattgtcttcattgtattatttccttggtttcttgtagagaaaagtaatcaagatctaaggaactgactttgctataagcaaaccgtttctccataattcaaatttgaattaataagtgattgttttgtgttaaaatagcaagcctaatttttttttttgctaaacttgtttattgcatgataaactgattatcattcaatatactgaacaatagcctttttaaaaaatgtctgtttttagtacactcagaagaagccttgtttttactggcaacctgttattaccgctcaggaaaggcatataaagcatatagactcttgaaaggacacagttgtactacaccgcaatgcaaatacctgcttgcaaaatgttgtgttgatctcagcaagtaagttttaaaatattttctagctattttgttttacttacactgttgaattttggataaaattcctttcagattaaactctgattccctttcttccctgttttccatctatttcagtaacattcgaaatgtttacactgttgcctatggcattatttatattatggagatttcattgttatggtaataaataatagagtttaactctggagaaacttaagttataaccgattcttattggtttcttaaatgatcacaaatatttcgttttctttgctttcagtgttagaccaatttgagtaagcctgaaaacccaccagctcacttgagattaaggctcccttgtgtttaggtgattgtatagtttcctttcaagatcattttattgagtacttcttttgcacattacagttaaaccaagtcagctgtccctataccaaatttggaggcatttagagatacagatagttaggttctattcaattcttttctgtactgtaagagatggaataatggtaaaagggactaaacggtcacatgtgtaaacggtgttagatatttgtaaaagcctgtatgtataattggcttgtaggtt

SEQ ID NO: 20993 - DNA, 1004 bp, Homo sapiens
ttttttacccttattagatatgatacactctaatattttccattgagtggttttgttgttgttgttttaacgtaggctgataaccactaaattgacatcacagtccactagtgagttgagatttgctgttttggaaaaactgtcctaattttaccatctccctccaataaattcccttcccccattgtaagcatgtatttttctttcccaccaccaatacctgatccccttgaccaaggtttttctcttttgttaattaactgttaagaatgaatagaaataagtgctatacaacaaatagaaatagtgttagactatgaggaaaaaaatacattaatgcaactactatgatagctctttggagatatgtgtgtgtgtgtgtgtgtgtgtacacacacatataaaataagagttatgttcagaaaatcaaccagacataagttttgtgtgcatttttttcataagtaattgctacctatggaactctatgagactaagaggattgtaactagtgaaaggaaaagaaagagaaacagctgaaaaccttgtgtcaacatgtattcctaggttattttgagggtcctagcccagagttcaaaattgcttaaggtctactgttttatcttaaattaatgtgggttttacatcccacactgcaaaatgtttttgtttgtttgtttcagatagggtctccctctgtcacccaggctgcagtgcagtggcccaatctcggctgactgcctcccaggttcaggcaattctcctgcatcagcctcctgagtagctgggattataagcgcctgcggccacgcccacctaatttttgtatttttagtagagatggagtttcaccatgttggctaagctggactcaaactcctagcctcaagtgatctgtccacctcggcctcccaaagtgctgggaatacaggcgggagccactgtatccggtctttattttttaatattagtactttttaaacatttttttttaagtcaagatc

SEQ ID NO: 20994 - DNA, 1034 bp, Homo sapiens
aaggaatggaaggcttagaaagaagattatacaatagattaatctactccattcacttatgcaaaagtgatgtttattgtgaataatctatttaaaaatattttcattgatacctaggcaggccccatattttgctgtatttttaaaaatttttgttgagtcagaatctcactctgtcgcccaggctagagtacagtggcacaatcatagctcactgcagccttgaactcctggactgaagtgatcctcctgcctcagcctcccaaagagctggagttacagatgtgagccactgtactcggccactgtcttctatttctagtatttcctttttgtttttgtttattattaaagaataggcagtttctagtttattatagttaggctcttaaaaattgtaaattcatggtttagaattcaattagattttcccatagaattggtggcaagattcccagattagtccacataaagctgtttaatccacgttatttatgtacctgatacaatgcttggcacttggaaagttgctcagtaaatgttagtttctttcaatatagaacctcaccattcggtttaaccatatttatatgaggaaagattttagaattaagtgtagtaagagcagatactatcctggctcagtaataataacaataattctatcacttattgatttcttactgtatactaggtactctaagtatttaatattagttactaatttaatcttcaataatcctatcaaatagacattgctattgccattttctggatgaagaactgagactaatgtccacaggcggtaactagtaatctgtctgattccgctttcccaagagtagcaattaccacttctctgatttgcaaccatagtaggcatcactaatccattacagtactcattcccactgaaccaacctcagaattcttggcaacagttttcttggtggacaatatcagttgatatgctagatgtaacctgtttgctcaggggcctcctatgtcactagtagcagtttctatatttggag

SEQ ID NO: 20995 - DNA, 1049 bp, Homo sapiens
cacactagcctaagtgacttcagtgagagctttttgaatatttataaaagtcacctggtgaaattggtttttaaaaaagaagcaaagagattttatatagatttagcaattattcctaggggtaagacttcacagaagtgttggatgaagttgtaaataagcctttcgaaaattaatttaataagcaatatagcaattgggtactatatacatgatactgttttagagatcattagatggtgaaggagtactcttggctggggataaaatgttcagggacagcatctaacatggattcaaagagtaacatattttggctactcaatgagaaatttagatttaatgtgcattggtaatgaataaccattatatgagcagaagagtttttgagcagaggaattatgtaataaaagcaccactttgggaatatttatctggtgctgttggaaagggaggaagagacaagagttagacatacagactagtagaataatccaactgcatgatcatgtagaccagggctgcttaatctgagcactattgacatttggggcaagctaatactttgttggaagctgtgcattgtagaatgttttgtagcatccctggcttctaaccactggatgacccctccatttgtgacaaccaaaaataccctctagacattgctaaatgttggggcattaattgggagtaagaaggcaaaattgcccagagtaagaaccactgacgtgcatctaaactaaatcagtatcctagaaattcaattataatgtataatatgaaatttcaacagtgatttttttctttgtatcttcttacattgtctgaagcctttattatccatttattttatggtttttaaaaaagggcagctgactgggcacagtggctcacgcttgtaatcccagcactttcagaggctgaggcagacagatcacttgagccaaggagttcaagaccaacaaataaaataaaataaagacagcttttttgacaaaaacaagaacacaaaatgtataaaaaatttaacaaaaacaagtaaacaa

SEQ ID NO: 20996 - DNA, 1101 bp, Homo sapiens
attcccagcacaagacacttaccccataagcatcaacaatgagctggaggacattgctggaatccatggacagaaccccaactgtggtccctgggatgagctcactatagttctagaaaggaaaacaaagatgtccagagcttaccaaaggaagctggtggtctccaaaagccctccccaaatcccactgagagtcctgagatgaagattggaggaaggtacgggatatttcaattgtcactgccaggaatatatctagcagtttttcagccctgagcaaaagtagaggaaacctctcacacccctcaccacctcccctccaccaccacaaacaccaacacatacctagtaagttcaagattgcaggaaaaaggcccagagtgcaatctttagctcctggggagtggattaggggagactctttcctgattggggactgtatccaatgctagcacaggctggctacctggggcacccaccatcacagggcccactccaggaagcccgaaggcacagtcacctgatagagattgactacattttcagtcactgcaaagatcaaattgatgtttttctgggatagcttctcagtcatcagccccaaagagggataatcctaggaaaatgaaggatgtagaggttaatgacgtctcatgtacatctctagggtctaaagcttagaacttatcttgcttgggctgtggctcagagtgtggtggtgcttaaaccatttcacttcatgctgaaagtgagacaagagcctgggcaacatagcaagaccccatctctacaaaaaaattttttttatttgccagatgtggtggtaagtgcctatagtcctagctactggggaggctgaggcaggatcacttcagcccaggagttggaggttacagtgagctatgattgcaccactgcactccagcctgggcagcagagcaagactctgtctctaaaaaaaaaaggggggtgacagtgagataagaagggtaagtagcacagaagtctacttgtgaactccagggatagacgaagaggtacaggccagtggtgtcaaaactaagcacctctttcttcctgcttgaatttaatgcactaata

SEQ ID NO: 20997 - DNA, 1138 bp, Homo sapiens
aagcacagcaaatactaagacagaggggaaaaaaggatatatacctctaagtatatcatagtgagtgactacacaaaaagatattccatgttctaatatctgaaacctgtgaatgtcaccttatttggagaaaatgtatttgcagatgtaatcaagttaagatcttgaaatgaaatatacaatgacagacgtgcttgtaagagaaaggaaggagatgagatacagacacaggaaaagaggccatgtgaagactcatgggaagatggaggcagagattggagttatgctgccacaaaccaaagaacacctagggttcctgttaaaaaagcaaaaatgttagcagagagcacagtaaaaaagacaaaaaataagtttaatagggaaaaaacacaaatttttcataaattcctgaaaagattccttgttctattttttttttaaggagaagaaaaaggagaattaagaacagaagaggagaagcaagaccaggtagtgatatttaagactgtgacatttcaacacttggactaaaaaatttaagggaatgtttgagggctaaggaaaatatttgaaggtaaaagaaaaatttccaaatctttatttacctcagttcttttactgtgctgttgtacttgtaaactctttctcccaacttttttttctcctgaaaaatcagaggacttttcttctccacaaaagattattgatgtttcaaatctaaatgacacagaaattggaatcattcttgaatttctttttacttattcttttcaacttttaattatggaaattttctaacatatacaaaagtatacagaatcccatcacccagtttcaacagtggtcaatcctattccatctatatcccatccctgttcccatcccttattatttttgaaataaatcacagtatattatttccatctgtaaagattttaatagaaatctctacaaggtgtctttttttgtagagattgggctgggtacggaggtgcacacctgtaatcccagaactttgggaggccaaggtgggcagattgcttgaggtcagaagttcaagacgagcctggcaaacatggtgaaaaaccccatctctactaaaaataccaaaaaaatagacagacgttgtgacacatgc

SEQ ID NO: 20998 - DNA, 1050 bp, Homo sapiens
actcaagaggctgaggcaggagaatcgcttgaacccaggacgcagaggttgcagtgagctgagatcacgccactgcactccagcctgggtgacagagcgtgactctgtctcaaaaaaaatggacacagagagcaatggaacagaataaagaacccagaaataaagtcacatatttacacccaactgatcaactgttggtttacacccaacaaagcaacaaagccaacaaagcagtcaagaatatacactgaggaaaggataccctcttcaataaatggtgctgggaaaagtggataaccatatgcagaagaatgaaactaaacccctatctctcatcatatacaaaaaacaactcaagctggattaaagacttaaacataagacctgaaactaaaaaactgtttgatgataacatagggagaagtctacaggacattggtctaggcaaagattttatgactaagatctcaaaagcaccagcaacaaaaacaaacatagacaaatgagactatattaaactaaaaagcttctgcacagccaaagaaataacagattgaagagacaacatcttgaatgggagaaaatatttgcaaactattcatctgagaagggattaatatccagaatttataaggaattcaaggaattcaaacaacagtaaaaaaaaaaaaaaaaaaaaacaaccattaaaaactgggcaaagagccagacgcggtggctcacgcttgtaatctcagcactctgggaggctgaggcaggtggatcacctgaggtcaggagttcaagaccagcctgaccaacatggtgaaccctctctctactaaaaatacaaaactagctgggcatggtggcatatgcctgtaatcccagctacttgggaggctgaggcaggagaatcacttgagcccaggaggcagaggttgcagtgagccaagatcgcaccactgcactccagcctgggcaacaagagcaaaactccgcctcaaaaaaaaaaaaaaaaaaaacaaacaacaacaacaacaaaaaactgggcaaagaatatgcataaac

SEQ ID NO: 20999 - DNA, 1036 bp, Homo sapiens
tacacttctttatggtgaacttctgagtggcaaaactatcttttccatattaccacacttacagcttaacataaagcctagtacatattaatggttcataaatgttactgaatacattggaagatagaaagaaatggggacagatgtaaccagaaattctcatattagtactcaggcactagaaggcatcatttttcctaagttgaaagacattttaaatcttttccccaaaacgaatgctatacatggttctagccctctataagtgcgctaatgaaaaataaaattatgatagcttttaattcacttgcatgtagaagacattctagaattaggggtcattagaggagattaaagccaaatatagcagcaggaagccaggcatttatttgtcggatgacctgcaggataactagctctataagagactaaaagagtgtttacgctcttctaaaatctgtcaaactatttggtccacaaaaagcagaagacatgatattcttacgtacctaatttttcagagaagcattccgtgttgctcatcatagtatcaatgaattctttaaaattcactttttttgtttctacaggaaaaagaaacacatttttttggcatcttttaagtattattatgaaaaatattgaattatataaaatacgttatatattcagaaatatataattatatccatcaggtaatactaaccaataaaaatatatgggtataaaggggaaaagcaaatcaatttacagtagagaagtaaacgctgaaaaacaccaagaaaacgggtcaaaattcttccagtccctctcaagcatacataatatttttaacttttatttatttttatttttatttatttatttatttatttatttatttatttatttttgagaaagagtctcactctgtcacccacgctagagtgcagcggtgcaatctcagctcactgcaacctccacctcccaggttcaagcgattctcccacctcagcctcccaagcagctgggattacaggcacgtcaccatgcccag

SEQ ID NO: 21000 - DNA, 1095 bp, Homo sapiens
ttagatttgaagcctctttcctgaaatctgcaaatttagagagagacattacacaatgaggaatggcatcctgatcttaccctgtttgaaaggaaaccaatggatagattgaatacttcttttcccactaacatttatcattgataaccattcccttcttctcaaaagttgttccctggctcccaaaatatccattctctcctcactctttgcttactacttgggctccttcatggttatcttccaccaactccttaaatgtggcagtttctaatgtcacagatgcttcctttctccctaaggggagaagttaatccccagccggtctattcaataaaatccttaattattagtctaaattgtccttcttgatctcttacctacctatatactatctagtcccagaatttttcctaagaacattatacccattacttaattaaatgtaattaatgaatgggtattacattatacccattcactccacatacttcctacagagatgcaagttggtgtagagatctgaggaacaaacgatagaaataaaatctgtccatttgcatagatggactctattgtattaaagaacagtttagaataactcacagctagcccaggtattaccctgaaacaaacagaggttagaatacacataaattatatttgccttaatttgtatttttgttttaagcaggataaacaaaacaaataacctataaaaagtactttcaaaataataggtttgggcaattttacatgataactctaaacaggattgctgaacctaggcactattaatatttttggccagataattattggggggggcaagggtattatcctgtaaattgtaggatgtttagcagcaacccttgcctctattcactagatgccagtagtcctctcccatcagttgtgataaccaacactgtctctagatattgccaaatattctctggtgtgaggtggggggcaatgggggatttgattatactttttattttgtatttatttatttacttgagatggagtcttgttctgtcgccccgactggagtgcaatgacgtgatcttggctcactgtaacctctgcccc

SEQ ID NO: 21001 - DNA, 1026 bp, Homo sapiens
tcatctaattctcaaacccattcacattctgctatttgtcctggtaataccatttttagcaaaatgatacatattttgtgaatgctataaagaaggcaccaagattaactttttaataaatgaatattcaattgaaataacatcatttatttaaaaggccatcctttccttgctccattgcagtggtacctttgttgtaaaggcgatgggcatattatgtgtagatctctttctggactctgtattctactctattggtttttgtgtcaataccacactgtcttaattacagtaactttgttatgataacatgataagcactatgttagagacttaccatttaatacctggccaaataatcaaagacaataaaggtaaaatatggatattgggaagcattcaaagactcaaaaattatatctcccatgctgttttactttggaacctaatgcaaaatgtgcttcagtaaaataaagagtaaatcatgacagggattcagtaaacatgtgagccatagaacactactaaagagaaatcctgggatgacagctgtttagcgggtgtaggggagaaacaatccaaatcagaacatctaaagtacataaaactgtgtttgagtgttttgaaaatgttaatattcaaacattttttattatgatttcaaaaatcatagtcaatgtttgactaacatttcaaacatgactgtgtcagaaatgtttaaagtccaagaagtgaaattacctatgcaacatcatacaaccggtcagtaggaaaaaaaaaattcaggtacctaaaatatgactacaatgttgtttttcatatacacacaccaccaatttgcaacccttttttaaagcttttaaacattttttttatttctaaacaaactcaaactctcagaaaagttgcaagtaccgtacaaaaattttttgtctgaaacatgggaaaaagtaataggtctataggaaaacatatgttttttaaaaagataattgttaactccagaagaaaggggaagggagagat

SEQ ID NO: 21002 - DNA, 1048 bp, Homo sapiens
catgcagaaaaagcatttgacaaatccagcatctctttatgattaaaaccctcagcaaaataggcatacaagggacataccttaatgtaataaaagccatctatgacaaacccacagccgacataatactgaatggcaaaaagctgaaagcattccctctgagaactggaacaagacaaggatgcccactctcaccactcctcttcaacatagtactggaagtcctagccagagtaatatggcaagagaaagaaaggcatcgaaactggtaaagaggaagtcaaacggtcactatttgcagatgatgattgtttacctcaaaaaccctaaggactcctcctgaaggttcctagaactgataaaagaatcagcaaagcttccagatacaagattactgtacacaaatcagtagttcttctatacaccaacagtgaccaagtggagaaccaaatcaagaactcaaccccttttacaatagctgcaaaaaaaacaaaaacaaaaacaaaaaaatcttaggaatatactgaaccaaggagtcaaaagacctacttgtagttttttaaggaatctccatgttgttttccatagtggttttattagtttacactcccaccagtagcgtaaaagtgttcccttttcaccacatccatgccgacatcaatttaattatggccattcttgtaggagtaaggtggtatctcactgtggttttaatttgcatttccctgacaaatagtgatgttgtgcatttttttcatatgtttgttggccatttgtatatcttcttttgagaactgtctattcatatcctttgcccactttttgatggttttgtttttttcttgctgacttgtttgagttctttgtagattcttgatattagccctttgtcagatgtagagtttgtgaatattttctctcattctgtgggttgtctgtttgctgattatttcttttgctttgcagaaactttttagtttaattaagtcccatctatttatttttgttttggttgcatttgcttttgggttcttggtcatgaactctt

SEQ ID NO: 21003 - DNA, 1035 bp, Homo sapiens
cccatatgactccaatctcggttcaagaagagttcacaagctttaagcttccttccacgcagcgactctctctctccctccctccctccctccctccctccctctctctctctctctctctctctctctccctctctctctcccctctctcttcctgcttctctcctcttttctcctctctctcttttctttcagcagccagatccagggctgaattttctccgcggctgctaagaaagtctcaacctttctctgtcttcctttcttgttatttttctttctcccattaatttttttaagtcctggaagatggcctatcccctctctcggggcttccccagctattgttactctcctggctctccctggggtgtgcttggcaaggtggggttcttgcggggggctcatctcccttctccagcgagaccctggggggaagccggcagccaccgtctccctccctccctcccgaggagccatatggaacctgaatttttccaacatggaggcaagggaaatagatctgtttggcttggtagagttgttccccaccccctcttgttctggatcccagatcttgggtccccttagcacctttctctcttcccactgtcccgtccgccaggcctcggcgccctccaacccggagccctgctgagcaaagtcccgaagcggagtttctaaggcgccttttaattcggttacctccagctcccaaaacttgctgccgcccgcggggctcggccctcggccggctggtgtgctgggaacctgcctccgataaccgttttggtgtcctgatcgcttgctcttcttcgcctccttgggccatcgtaggtggctggtagcttgtcgccagtcgccgcggcagcagcgaccggctgaggcagcctggcagcagcagccagggactacccgggtgcacaaaccttcccagccctgtctgcaccaccggcggagtctccattctttcctatcgcgtctctggctccttcgctttccacactcgcctggcctccgtcccgcgatggtttg

SEQ ID NO: 21004 - DNA, 1575 bp, Homo sapiens
gaactttcacctccattccacatctcctccctcaaactcccagccttaacaagcggatgcttcccctactaatctccttcctcccccatcttacaggaaagaacaagaaaaggaaaaagagaaagcaagttcctaccagcctaagcagctttagaaaactcgagggaaaaggggagatgcaaatctttctcgcccgtctgatccttcctattgccccctcgccattgctctgttccctccattgccgccctccctgtccccactcctgtcctgcccagaactctctcccttcccctcccttctctgccgggtcggacatatggaacccatttcgctggtgacattgaagagtcgccggtgtgcccgccttccgccatggcgcccccggcgctccctacgcctcgccgtgcccctgtcagttgccgctcctctcgcctggcaacttggcccgctctcaaagcccgagttcagctcggtgccagacgagcccggggttcccgcagccctgcgcggcccggacggagtgggagcttctcaggaaactggcgtctgccgcgcccggagtgccagatccgcgcgctcctggggccctggaggccgaacaaagccgggggcgggggcgggggcggggtgggggcgagcgcatccgggcctctcccccagctcggcgggacgctcgggggttgctgggggttgctgcgggttgagcgactaggatgcggctggctgcggcggcggagccccagcctgggccgagggtccggggcctggcagtcggcccccgcgcgcacccagcgcccggccgcccgccgttgcccgcgccctagcggaagaccgcacaggtaagtgtggggtgcggagccggggcgctcggggcctggcgggggtgcagaggtgggtggctgagacccccgcccccaggcctctctcctgggacaggccgggatccgaattgaagacgaagatgagagcaactttgaaaggcagggtgggggcttcaagggggtaaagggacctgggggtggaggacgagtgtggaggaatgtggagctgtttgggtgggcgtgtggacatgatcttgttaggggatgggagagccctcccgctcagaaagggcgttgaggcccaggagggttttccagggcagttgggggctgtgggtactgagggaaatgtgaggggcatctgttaggggcagtggggttggggggcgaccgctgggtcagcttccacaacccagctgccaccattgcccaaccctttagcacctagcgggttatttgaaggcaaaactacaagggattgcactgaggctgagtgttaagcccagaaggtaggaaagggggtgatttatggcttcagagaagctgtgtttactcctgcctgctctggaaaccaaaaaccaaacagagcagaggccagagaagcccctctccttggagtgggaagcgatgccagcctgacgcactgggatttattttcccagatgagggagaatagtgggaactgtccctttgcaggcgcacagtgtggtgggtgtatgcaaagggagcatgtaagcaggcacatgtgtag

SEQ ID NO: 21005 - DNA, 1455 bp, Homo sapiens
ttgctgttctttttcttgtccttaaaaattatttctccgttttagagattgctgtcttcccacatccagcatttctctctcctctctctgctctctctctattttcattttagactttagcagagtgtttttctctggaggaccatttttaatggatttgtggccagaacgtttcagggagttgccctcgctggagccgggagcagggcccacatcgggatcaggctgaattcaataccagtctgtgttttgtatctggacaatcaaagctgaccacctcccctacagagtccaggcctggccggcgcccccaccccatgaggccagagcagattccagtgctcttagctggggcagaagctgtgcagctgccactgtagctggaacctccgaggccgacaccggggtggctgtttctttggggcttgttaagacaaccgggtcctcaaccttctctccactgagttgcttttggtttagaccccttcgaacaagccgggggaggcccctcagacccctgctcccgtaccctgaagctcattcttcctggattccctgcctgccccggaggctgtggtcctggctgcctccagagctgctgaggacagataaggctgcgacttcttcaggaatgtcttttctgcttccctttgcatccccaccccccatcccatgccccggccgagaactctgattctagttgcacgtaactggtcaagtttggatggggggttgtttttgttttattttgtttatatttgagttgaaggggtctgtgtgtgtctctctctttaggcctggggaatagatagtccctggtatttaaccctttaacaggcatagccatcccccatctttttcccactgatcagcctccattgtttgttgattggaagctcggggtgctaacacctgggaaatagggatcctggggctgccaggctgacttcaaagcttttcttttcttttccctcctctcctgttcaaatctccagctgtcttcactggtgggtttgggaagggggggaaatgagacagggtgtgacataggtagagagaggctgacagtccgattcttttgtgtagaaaccttagtcccagtctttgtctctagaatctattttcaaacggtcagtcgcatttgatttcctatagtagtaacaacacaacagggaaaaaagtcccccttgcggttattctcaactctggaagctccagagtaatctcttcaccctgtcccttttttgccccttcaaaaggtaccagaaaagatcaaaacgagaataaagccagaagccccattatttatccacttataccatggacttatgaagtgtttattttcaaagtggctccttcagaaattttgtccattatttaggaagagagggagtgggtctcactcaagtaaatatccccaggagttggggaaaaaatggagttggggagggaacc

SEQ ID NO: 21006 - DNA, 1026 bp, Homo sapiens
gagctctctatccactgcccaagcctgacttacaggaaatccttaacaggctttaagagcagagtcaccctggtttgaagacatatcatcccaagaatgatgagggcatttgtatcccttagaaaggagacacaggtcatctcccaaaggatccccagcaccactgaaaatataaagaagtgctggaggcacagcttccacagtcttccactctacaaggcaacggagttgacagacatgcagacaaagagctctgcaagggagagtctgacctgggtctccaggggaaccccattcctattgtgcccctggcctcactctaatatacttccctttctgaaagcccttctggaagctagaaccccagatagtaaggcctgctcctgaaaaattgtttctttgccccctctcatgtcagttctgtaggctctaacatctactaggcatatctggtcggattttccaggatggcaaagagcaaattggggtgcccacttccacctcagtgaacaaactcttgaagggtctcctccagctctaagcaggtcctggagaagatgccctaggctgggctttcctcttctccacttcaggctccctgagctgaaccccagtcctgtctgaaccccagtcaggacaagctgcgggaggcaatgagaggtgtgaagggatttctgatgccaagaactctctcctctgccccagacctctgtcctctcctcctgccctcccaggctgtctccctctaagagagctgctctactctctccagggctttgctctccctcctctcccacctgctttctctccctgccagtccaggcttcaacctcttgagctataagccaagccggtaccctctggccaaatcttcaacctggggcaggccccaggaggtgacagctggagattaaggctgcagtttctcttttccctctgaggccagcctggccaccactcggtggacaattcaattttgattttttttgttttgttttatttggttatttgttttgttttgtttct

SEQ ID NO: 21007 - DNA, 1251 bp, Homo sapiens
tagaggagctgacgaggttaaggggcctggtggtgctggggacaaacactgtggctgcagccctcaccctctttcggcgcctctggagcagctctttatagctttcctgcggcgaggtgactttctggtggctataaggcccgactcaaggagctgctctataggaggccctgagggagccagccctagaaggtccttggcccctctgagattttgcttttgggcaatccaaaggacatgtagagaagtcaagctggtacatggtattgaaacacttcagggccctcaggttgtcccctggacctgcgggtaggaaaccgggagagtgggttcagcactactgctcactcccctaaagatcaaagaggatgccgctcctttgcataatgaaaatgaagtctttgtactttgatttggaggggccgattttagggcaaagtgtctcatctaaacagcctccctcaacctatgggagtgatcactcagtacccctgggaacatttatttatgttccccaaacccagagaaacagagtccaggacgagaattgagttgaaatattttcatcccaccccaccccagccaaagttgggggtggtgggagaaggtgctcatcacctcaaagagctgagggagagggctttatagcttagaggaaattggaagcctggacaatgtctcagcaccctcccacacacaccacaccacaccacacacacacacacacacacacacacacgcaaatatccctcctgaggttacctatcaagaattttactcccgaactgaacacaacttaggaaacattttcctgggagctggaatgtgttagcttgcccacaggactgcagactcacagcatagaaaattacaattataaatcctgcctgtggggtatctgtacaatccctctgttatgtactcaagaattggtacacacttctatccatctctctgaacacacacttcctcattgaggcagggagagacaccccagactggcggatggctgagcccgctgtgtatttacatattcccccaaggagacagacagagggcggtggaccgaaccacagacagattcgtagggatctggctccagaaaggagtcggtctctggcctgccctgcccgcctgctctttttcccaaacaaacggatcagacgaataaacgctcataaatacctctgggcttagataagagcgatgaggcgctattttctttcatgcccgactccaggcgcccaggcc

SEQ ID NO: 21008 - DNA, 1001 bp, Homo sapiens
ggtgtgtgatggttataaaaatgtacacacaaccttttgggtaactgatcttcttacacgagcagaatcagaaacctccatcactcacagaggttatgcatgcatccacatatgcacgattagatcctgcatacacgaacgcccaagcacagcaagtttcatagttgggcagatttatttattacatattctatatacagtatagagcagagtgcatttgcacactgggttccccatacagaaatattgatttgaaatatacatataggacacacacatctatttacattaaacacgcgtaaatttcagctaagcttattaattaaaaacaaactatttttccccattctcacttattgtttttctttcttctcccatttccttcccttcctctagattttctctctcttcttactgacaaggacccttccaaaagtcacccccacagcataggcactcaccggctggtcggcctctgctcttcaaacctcggcctcactgttggctgctctgggccccagtgtggccaggagctgcgcttttttccctgcttgcccttctccaagctaccagctactggccccagctgtgttcaggcgaggctccagtgcagggaatggcaaaaggctgcaagggaaggcagggttttccttctttctgtttaggattgggggtggggtatggagcagttttgctctcttaggataaggtgacccccactgaagcaacccctttactaagtgtctttggaagctgggctccaggagccacaatcctgtttgctatcctccttcatggtgggtaccattgtctggggagaaaacaaggcttttttggtgggagggagtccacagtctctcagctgaccctttaatcatttgcctgagctggagttgaactccagtttggggcagcagtgctttccagaaagcttggctggggtgggactccttgcttggtgcatttacctggacggcaaagagctgggatgcagactacag

SEQ ID NO: 21009 - DNA, 1058 bp, Homo sapiens
agcggatggggccttgattagctgtggatttctgtcccagcgcactcatttaaccgtgtttctcttggttggcagagggcgccaaaggcgacgtgccggccgccagctccaggccgagccccgagcgcctgcaggaacacgccccttcacccggcgcgggacgcagagctgcgagagaatcttgttcagcgcggactcaacgccagggcgccgcctagaggttggtctctgtctcggcctcacccgccgggagaccacagagctgcttccccagccgcccgccgccagaaattggaaaaaaaaaaaaaaaaaaaaaaaaaatccagctggggtctaggaactcggcttctggcacctctgaattctccgagactgtctcctccctccccgcctgtaatgaaccctgtgaagggagacaggccaggaagtcccagaaatatttattcttgtgactctcacaaaatggaaaagggtctcaatttttgtttctttaaggaacttgtgttctgcgtctgtgtctacactgcctcctctcaccaaccaaattgtctagcccccctccagttacgctagaactctgctttatcttcaaggaagaaagggagtggggagaagttacctctaaaccctccagcatggccatcaattttctgaataatttggaggtcaacatgcttttggaaaagtgtttggaaaacgtttgggggtgaaaagaaatgttgcctaactggcctttactcacggagtgaccatcatctcagctagttagtgtatgagcggcaccagcaccccggccatgggtgtctgtgctgagcctctgaaagttgacttatcctttggggagccctcggaaagacacagctggtatctatgggaatggctttggggtgtcctttggcaccatacagataattttgtttttttaattggaatccatggcctgggttcttgggatgggggtagggggaagccacaaagcccctggaaatgtatgcaaaacatatgggtgtgcaggtgcatcatcctaaggctatggcctcttcagtttttccaaagag

SEQ ID NO: 21010 - DNA, 1042 bp, Homo sapiens
ctgcgggagttagccagataatgctctccctgtcctacccgtccccaccaatttgccttttacctgccgcagagcttgcttgaaccaaaggggtttgcggtcttctcctcctcaacttgcgatccccaggccttcgcggcccgggaaagaatccagccaacccttctgcctttgtctgaccttcggggaaaagaggcgtgggcgcctgggtcaagttcacggacctggtctgtgtcttttaggacaagcgggggcaccgttcccattctgacgaggagggttctaagcatttgggacagtgtgggggcgaaaatgaagctgcgagaaaggactttcaatcttaatctgttgccctagtctcacatcccctccccctcccgcagccctgtagaggagaaataattagatccgaagggaagcctttgatttggaaaaatgcgaaggtctcatggaatgagcttcccagaaatggtctttggcacttgggtagttttgcgttgagttcggtgccggcgtttatgaaagttaaggatttgcagtattcggcacagcggtttctgtggaattcgattcagagcaaacgagatcacatctacattgctttccaaaaagcttcagactcaacacattgaaataattttccccaacatcctggttcctacccaccccccccccctttttttttttacagggcctgatgcaaaatgatgttcctgccccttaaaaaaaaaaaaaaagagcctcaaagtggaaaaaaaaactatcccgatcgcagcaagtagaacacgggtcttaaaacacagagctacttttaaaacttttttataaacagccccttttaaattaaaaaaattgtttcaacgtgtatgttttataatttttaaccactgttaatagttactttttgttccccttcccctcaacctagttatacacaacctaatttggtttgaaaacatactgtacattttctgtgtcctaagcaattcctcaagttattgcagtcttctaagtgctatttttagattgcataatatgcaat

SEQ ID NO: 21011 - DNA, 1132 bp, Homo sapiens
ggctcaagcagtccttccgccttggcctcctaaagtgctcgggattacaggcgtcagccaccgtgcttggcctaaaaaattatttttttagcagacatttattgagtgtttaatatgtggcaggcattttgtatactttggctttattcctttcaacactcagtgaagtagtaggtactattatttatttatttttattttttttttggtttggagtcttgctctgtcgcccaggctggagtgcagtggcgcgatctcggctcactgcaagctccacctccaaggtttacaccattctcctgccctagcctcccaagtagctggactacaggcgcccaccaccacgcctggctaattttttatattttttgtagagatggggtttcactgtgttagccaggatggtcttgaactcctgaccttatgatccatccgccttggcctcccaaagtgctgggattacaggcgtaagccaccgcacctggccttaggtactattattaatctggtctgatagatggaaaaacagacttacagaggttcagtgaattacatggggtcatgctgagagcaagtcgcataattgggactgtaaaccaaatctgacttctgagaacaagtgctaaccactacgtgacactcccacacttatattttaccttgtactaattatggtcccttggtacctgttgcccccaccccccccccttttttttttctgtgagagggagtcttgctctgtcacccagactggagtgcggtggcctgatctcagctcactgcaaccctgcctcccagtttcaagggattcttgtgcctcagcctcctgagtagttgggactacaccacgtccggctaattttgtattttcagtaattcctacctctcaaagtttcccagaggattaactatgacatttccagaagtttttgtaaagtgtgggccaccatgcccagctgctttttatatttttaatagagactgggtttcgccctgttggccatgctggtctcgaactcctaatctcaagtgatccaccccactcagcctcccaagtgctgggattacaggtataagcatccccatcccctcttaacacacatacgcacacaacgtgtacacccttggggct

SEQ ID NO: 21012 - DNA, 1052 bp, Homo sapiens
ccttatccaaacaattcaactgtctaaacctttcatctgtaaaatggggataacataattatttacctaatgatattggacagaaaccacccattttgagcatattatttccagctctaggaactgagtctattcttgcataagtatggtcaatcatgtttgctacccggaataacttaattcaaaggtagctaaacagtgatctctgtttaacagtttctgggaaaatggaggcagtgatttgctgaaggccacacagcaaatatttctgtagctatgttctttccactatattccactatgctaggctttacccctcttccccagcagcacaagttaaatgacttcgtagcatttttcaaattcaggcaaaggccaaggccaaacagctcgtttagttggttgtgtaaaggtttgaaggcacttagtagatttagtttgaaaacctcactgaagccaaaataggtgtgggggttgcttacctaccctttgtctatggaacctccctgttctcaaactgctcttcttcccttttccctccaggaacacctgctgaaggaagggttggcgtggctggacttacaggccccaggggaggcccactactggctgccagctctcttcactgacctctactcccaggagattacagctgaggaggccagagaagccctcccctgactgcatgtggaagggcacacagcagcaggcagggaggaggcggaggtggcaaataaacctgggcaattttgtttatacaaaaaatagaaaaaaagttccaagtttttctttcttccctcattcttttatttttgaaaagtgccttcacgttgcatttttattggaggaaaacctcgctcgttcagtaagcataatctgattaacacagagaacggcaagcacatataaaatgatttttgtaggtcatctgcaagttcatggaagagctgggcctagaatgtgggttgtttcctggcctgtctagtctttgtagctgtgagacatagattacagcctatgctaattcaaaccttttaaataaaatgttcctt

SEQ ID NO: 21013 - DNA, 1035 bp, Homo sapiens
cgccagcacgcccggctaagttttgtatttttggcagagatggggtttcaccatattggccaggctggtctcaaactcctgaccttgtgatccgcccacctcagcctccgaaagtgctgggattacaggcgtgagccaccacgtccaactgccttattttgttctgaataaatttacagtattgggcagcaattctggattctagacttgagaccacagaatcaaccatttcatgaggttgtactgtaattatacactggaatattcaggtagtcatctttgatttttcattcaagtaaatatagccataagaaaatatctgctatacaggaaaaccagtattaagcaaataccaccatccttaacagaaacaaaaatatatatatatattatttttaaaaattagcattgtcatacagtacaattcttagtgaagtgtattgtggaacaatttagaaacttcctttttttcccctagattaaggatactttccttgacttgagacttgtggtcttcaggaaaactactcagaatataatgactcctcatcagtatcatattgtatataaataatgaaatgcattaagaatattcacaacattgaacccaggaggcggagcttgcagtgagccgagattgcgccactgcgctccagcctgggcaacagagcgagactccatctcaaaaaaaaaaaaaaaaagaatattcacaacattaatgcttctgaatagaagaactgcaggattaagccttaaacatatatgtgcaacacgtttaacatgcttaagactcaaactcagggttgaaaatttggttggggtcctctttgtaagataaaagttgcattatgtggtatgttctcttccatatatgctacagcaccccatgaattcttcaaaactttttacctacttgttatctgtttatgaaaaaaagaattatggagaagtttgagttctcagcccttatctgtacatgtctgttaaagacaacaaaggctgcatttaagcattatatagataacaaattgaggc

SEQ ID NO: 21014 - DNA, 1021 bp, Homo sapiens
caccctcaccacccacaccaccttcccatccctccagtccctcacctcccgccacctccagctctctttaagagtgagcctttaaatcatagaggccagagtgaggacaactttctgcggcacctggcagagaagaacagttcagcacagcatcattaacatccgtctccttagtgtgttctccaggagacacgtccccatgtgtgagcgtgcacagagggagtcggtgagcatttccttagttctcagactctcctccgcctctaccaagagcttcgccagtgtcactgaatcaacagatccaagggaatgaacaagaagactaccttgagctcacagagggactgtcatctaaaccaggggaaccactgaactaaagcccaatttgcttgcattttctgatgacttttataagtttcaaatactcagacttgtggaattttataatttcatatcagctgatgaggtatgcttgcttttatatcccagacttctcctcaaagaggggataggcctggtttcctttgtactaatcgggaaggctgtgagattaatccagagcattaattgtatcactgtgtatggtaaggaattcttttcagcttttggtgccagctacagagttgagctggccatgtttcacagtatatcaagcattatagagaaagacagaaattttcttctttgtgtagctctcctaacgcactctttattttactacagaaattattttagagtttttgtatagacttctttggtagtctgtttctaaaatgaaatgtatttcaataagcagtgtaattttttcagtgtagctgaacctatgttgtaaaatagaaaaaaatttttataatcatcaaaatgtgattcttaaagatgcatataacttctataattcaaagctattcttacatccgtacaactcaaaaggtgcttcagagactagatgtatctgagagggtctccagaccaggttactgcaaaaatgaggttttgctttcaggatttggcgtaaatactt

SEQ ID NO: 21015 - DNA, 1067 bp, Homo sapiens
atctcaaaataataataattattattatttaagccctgtttcttgtgatttaaatgcatgctctaaaaaggaaatagtggtattacctgatttttttcctctttgcttttctttgtagataagatgctcccaagtcccttgcagctctcttcagaagaaaaatcactagtgctctgctcttgccataataccaaacctttttgactcatgctttggtgctgcaacactggaagaattgcacacagtttccaggaatatctttttttcatttgagtgattctttgtggatgagaaaagatttgagtcttaataattaccttgttttaaagctatttctttatagtctgaactgtttaataaattgggccacttaccaatgagccacacagccagttcttgtcaggagctggttgaaaactgtgctgtgcatgtagcaggaatggcacaagaagatagccgtcgtggtcaagtgccatcttccttttatcatggtgccaaccaagaacttgacctgtccaccaaagtgtacaaaagggaatcaggaagtccttattctgtgttagtggacaccaagatgagcaaaccgcatctccatgaaacagaagaacagccatatttcagggagacaagagcagtgtctgacgtgcatgctgttaaggaagaccgggagaattctgatgacacagaggaggaagaggaagaagtctcttacaaaagggagcagatcatagtggaggtaaaccttaataatcaaacattaaatgtatctaaaggggaaaagggtgtctcttctcagtccaaagagactcctgttcttaagacaagcagtgaggaggaagaggaagagagtgaggaagaggccacagatgacagcaatgactatggagagaatgaaaagcagaagaaaaaggagaagatagtagagaaagtcagcgttacacaaaggagaaccaggagagctgcctctgttgccgcagctaccacttcccctactcccagaactacaagaggtcgtaggaagagtgtagagccacctaagcgtaagaagcgggccacaaaggagccca

SEQ ID NO: 21016 - DNA, 1034 bp, Homo sapiens
tattcacaagattgtgcaaccatcacctatgtctaattccagaacattttcattgcccccaaaagaaacctggagcccatcagcagtcactcccccctcctccctactcccagctcctgttaatgacgatttactttctgtctctatttgcttattctggctgtttcatataaatagagtcatacaactaggtagcctgttatgtctggcttctttcacttagcataatgctttcggggtttttccatcttgtaccacatatcagtactacattcccttttttttttttttggagatcgagtcttgctctgtctcccaagctggagtgcagtggcaagatctcagctcactgcaacctctgcctcctgagttcaagcaattctcctgcttcagcctctcaagtagttggaaccacaggtgcatgccaccactctcagctaaattttgtatttttggtagagatggggtttcaccatgttgcccacgctggtctcgaactcctgaactctagcaattcacctgccttagcctcccgtagttctgggattacaggcctaagtcaccatgcccggccatttcttctttttgagacagggtctcactctgttgcccagactggagtgtagtggaatgatcatggctcactgcagcctcaacctcccaggctcaagcaatattcccaccttagcctcctgagtggctaggactacaaatgtgcaccgctacacccagctaatttttgaaaaactttttgtagagacgaggtcttgctatgttgaccaggctggttgcaaactcctgggctcaagtgatcatcccaccacagcctcccaaagtgctgggattacaggcatgagccactacacctgacttcttcattcctttttatagcagataatattccattgtatgattatatattttgtttatccactcatcagttgatgtatatttggattgccttttggctattataaataatgcttctgtgaacatttgtttacaagttttcgtatgaacatgtttttggttct

SEQ ID NO: 21017 - DNA, 1084 bp, Homo sapiens
caagaagacgagagatttgtttgcttgtgaaaaaaaaaaaatatattgactgatcttctcaactaaagtacaaacactattagtagtatatatatttacaaatggaatttatatgaaataacttgatattttaaattacagtttgtccattggagttaaacagtattgtgatggtgtatgttatatctgtaagctaaaattatatagctaatattgcagttaacattgacaacctgtgaacttagggtcttttggctgatggctaactttttgtttgtttttttgtttttgagacagtcctgcgctgtcacccaggctggagtggtgtgatcacagtggtgtgatcctaactcactgcagccttgaactcctgggctcaagtgatcctcctgcctcagccccctgagtagctgggcttacagacatgtgccatggcacctggctaatttttgtactttttcctgtataggtgggctctcactatgttgcccaggctggcctcaaaactcctgagctcaagcaatcctcccatctcagcctcccaaagtgctgggattacaggcatgagtcactacatcagactacatgcttattttaaaactaaggattctagaaaaatatgaagaaaaaaaaatatggccttttccacctttacttctatcctgagacatctctcaatatgagcgcacatatatatatatgtatgtccgtggttttgagtagtgaaattgcatgacaccatcctcacatgttctttaatcttttttatatggtcatatttctatgtcagttattataaatctgcatcataattcagatggttatacagtatgcctgtgtctgtatgtaccattatttatgttataataaataatgctataatgaatgttcttgtatacactttttttatacttaccatcttctggtggtgaattcttcaatggctacatccaaaaatatgcacgtttcacggttaggaaaatagtgctgaattcccatagtgttatgatctgtaatcagccatgccagttaatgtcagaagtcagtcaggttttcttggtattagccagtttgggatttgtgc

SEQ ID NO: 21018 - DNA, 1032 bp, Homo sapiens
tgtctcatgggcgcttggtccatattgttgacatctgtaagcaagccgtgacagtgctttggctccaggcaggcctgaattgtccaggggaaagtataattctctccctggatcctttaaatggtccaagtaatgagaagcagaacataggatcagtctgttaaccccttatatgtgttacacatttgacagagtgcttttacgtctgttttctccttcaattttccccaacatttccgcaaggcccagaaagcaaatgaaattgtccccattctcatagacagggaaataagctcaggttggctaaggcttagagaggccacatcattagtaaatagcccagatctttggactgatagtctaacaccgtttccaccagacccgaactaacctctccaaggctgactcctgacttggccacaatcaccagagcatgtaaaggcctcaccctacaattcttagcattgccctgtctattgtcttaaaatgttcagtgttgcaaactttgcatggcacctgttagacatataatctgaattatgtatatctgagggcattcaggggataccaaaaagctgctatcactgaagcctcttaagaaattataaactctttatgatgctctattgggttctctgccaaggaaaccaggcatacctgcaccttgccctctgggatcttataatcagcagatttgcttataaattgtagcaaatttggagccaggcacagtggtgcgtgtcagctactcaagaggctgaggcaggagaaatgcttaagctcaggagcttgagtctagcctgggccacatagcaagaccttgtctctaaaaataaaaaataaaaattgccaggcgtaatggctcacacctgtaattctagcattttgggaggctgaggcagttggatcacttgagcccaggagtttgagaccagcctgggaaatatggcgaaaccccagctctacaaaaagtacagagattagctgggcgtggtggtctgtgcctgtgtagtcccagctacttggaaggtg

SEQ ID NO: 21019 - DNA, 1072 bp, Homo sapiens
acctaagaaatacctgtaaactgggaaaatcttaaaagtactgacttgaacacataatactatgcttgtttctaggttttccttatatacaacagttacaaagtagttcagctcttaattagagaaatatttggctatgccagaaatgtgttctacatcttagcctggtatagaaaaaatttagttatatgcctagtcatgtttttacatatgtacatatttacactggtctgtatttaataaatgttagttatcttttctccatacatccagaatccaacccagtgtcagatacaaaaacaatagatcaaatataagtagatgctaaggatttccctcacttaatatattggaattttattataatatatagtatttaacttgaggcaaggcgtagtggctcacgcctgtaatttgggaggccaaggtgggtgaggagttcgagaccagcctgaccaacacagtgaaaccccgtctctactaaaaatacaaaaattacctgggcatgttggtgggcgcctgtaatcccagctacttgggaggctaaggcgggagaattgcttgaacccgggaggtggaggttgcagtgagccgagaccatgccattgcactccagcctgggcaacaagaatgaaactctgtctggaaaaaaaaaaaaagaagaatttaacttgaaataacttaagagtttagcttgggttcctgacagctgctgtaatggtacttctataaccaggattgacttattctgggaaatgtacttttctcactattgtcttgtggattcaggaactccccccatagctctgtacgtttcccttttcttccgttttcttggatttgaaaagatttttaatcagggaagggtataaatagttttgtaatgtactcaataaattcttaaagttggagtgacttgatagttttctttttaaaatgttttattgttttaaaagtatgcctggattcctatagctacattcattcaacaactcctaaactttaatttattaactagaactcattagggaaaaatgatcccaaaagagaaggagtctaattgctcaaccaa

SEQ ID NO: 21020 - DNA, 1051 bp, Homo sapiens
gtttggattttcagccagatagtctttcaagtatataataatcttaggggaaaccattttaatgaagcttatggaatttgtctcatgtagtagtacatacagcttaacatttttttcaagcacttgaatatattttgaaaatctgtcacaatctgaggggggcaaaaatctgagctttaaaaattgcatttgggcaggtcctgcctttctagaaaaggcatagaagagaaagttcatactgagaattctccattctagctttgtatcttttggtcattaaagggtctctctaaagaggaagagacctccctacccccaaaaatttaaatttttttttttttttttttttttgagacggagtttcactcttgttgcccaggctggagtgcactggcatgatttcggctcaccgcaacctccgccttcccagttcaagtgattctcctgcctcagcctccaaagtagctgggattacaggcatgcaccacaatgcccggctaattttgtacttttagtagaggcggggtttctcaatgttggtcaggctggtcttgaactcccgacttcaggtgatttgcctgcctcagcctcccaaactgctgggattacaggcatgagccaccgcacccggccttaaatatgttttatggtagagaagggaagggaatagtgttaactgacttttctttttaacaaatacctgctgagtgactataagcaaaagcatagtagaaagacagggaggggtatgttccaaaatgagtgggggattaaagcagtattatatgtttggtgcttagaagaggaagagttctttggggaagctggggtgagattcaggactgtcttcgtgaaggttacctttgagctgggctttgaagggtgggtattttgaaggttggatttccattggcagagatggggaagggaattgaggcagaaggaatgtcatgagtgaaaatgtggaggtggggaagctcagtgttagtatagggtgtgtactgaaaatgatgaagagcatagcatggctgaagcagaagatgggataatg

SEQ ID NO: 21021 - DNA, 1032 bp, Homo sapiens
atactctcctcagtcccatttcctacacccggattacgtggcctgcgaatgccagagccgaatcagccgtcccttctccctatctcaagcattcagaagacacaaacgcgccccctgccttcagcccccccatcatttcccagccccatcccccttgccaaatactgagctgtcgcctgcggcgagatgggtgactgcgcatgcgcgagtgtgaacgcgctcgggctgcttcttcgctgccccgggggcgcatgcgcatcgcggtgttgcagggacctgcgggataaagagccggtggagcacgagtccgccttcttcccaggctgtgggctagacttgctgccagataatgagcctgttgctcctgtccaaaggggagaatttaaattatgtgaaagacttaacggacaaagcactattctcatctggtgttgccctagagactcccaggctacaaacgcctcgcagagccagcgtgtcccacactgacccttcttttgaaactgtcactgtatcttctagttctaggattacttttccattcctatactcccatcgttgtgcttgtaccttttagtaccaacttaccctaaatttaggagtgggtgctccatcccatcacttattctggcaggggattttggaagccttgctaaagaagactaagggtcataaatggaactaagtgaggcatttcattttagtaaaattcttaattcgcagaactagataagagagataaagggcaccggccttcttactttgtgtgacctatttgccttttttttggtcaaagatcttccttagcacttttcattttatctgtaccttattggtgctctgtaacatgaaaacaaatcggaaagcaatctgaaactgttggtggacaataacttattcagtggaggttttaagtaatgtgatgtttctttcacgttggcagataacaaaaagaaatgtaaataacgaactttgaagtacaatagtatttcagtgatctaggacctgggttttcagttagcgattatatgt

SEQ ID NO: 21022 - DNA, 1055 bp, Homo sapiens
ttggaaagggccctgttggccacttcactgcaggctgcaccctttctttcccagctattatcgctgaccctggatggactgactggtgtttcccaggaccacatgcgggctcattaccaaacaggctccaaccacatgatgctgaacatcaacctttggtcgacattgctgctgggaatgggtgagagccagttctgctgttcttcccatgtatcaccagagggcaggctgccctcatccttttgatccctctagctgttagttgcccagaccaagggcctgaattagttccaagatgcccttttgttcaagcccttgagaaaccttcctggaaaaacctgcaccagcaggatttgtttgctacttgttactggcacaatgaaggagagtcgtgtgtcagttgtcatgggaagacactcagtagtaaaacacagggaggtacctgggaactttccctttcatgagggaaatgagacacacgtagtgctcacaggaaacagagttagctgtacactgaagacagttcaaatgtgaatgatttgctttgaaatcagtgcttcctaacttttcaaatttgggcacatgtagaaagtattttttatacagcacactggggttaatggtggaggctgctgatggctgaaggtgactaatgcgaggggcttccttgagctaaggatgtgtgggtcagcatctctacagcatctgaggatttctgcttgtaatcactttggtagaagtaactcattaactttcaagcctttctcacaaaattctctttagtttctctaatcagagaaaaatatgagaagaatcaatgatgagacgatgcaaacccacaccatacactttcccgcgtcccacctcccttgcagttctttaacaggccatgtgcaggagtgtctgtgtgtgtgtgtgtgtgtgtgtgtgtgcgcacattttgtgtgcacaaaatgcgccgtacatttgttgacatgtcttctcaggaatcctgttcactggggagctctgggagttcttgagctttgctgaaaggtaccctgccatcatctata

SEQ ID NO: 21023 - DNA, 1029 bp, Homo sapiens
gtgtgtgtgtgtgtgtgtgtgtgtgtgtgtgtgtagcgggggggagacctgggcagttttgccccctacctttctttctactccctccacccctctacccaccaaggctgttttgtccggggcattgcagccaacgtggcagtggggtgagggctacagtcaagtgcatggtggcaagtaccccactttctgaacagcactgaaatgggttcttaataacagcttgatgtggtggctgtggggaaactagggagaagcaaacttaaccttgctttgatactcaaatctgtgaggatcccacaaatgcaagtacttaggaaggggaaaaggaacctacttgcatgaggaggttggcaataagttgaaagtgaggcttgcatttgattcacaccagatgtgaaaagatcattgcacacttccaaagccggagcctctaccaaatgtacaaaaatcatgattcctgccgtcttaacggttaatgacattctctaaaccagagtctcttgagcttctgatgattaccaagcctagttactgcacatctccttcctgcttctgcagggctattacagaagtagtagctactacagggctactccttgctaggtaggaatgggcttaagaggatctctgagatagaaagcccccaagtctttctggacttttcactgtatatgttagcatcacatcttgggatgcagaaacttggtcaaatctggtagcaagatggtgaccaagtagtaaaagtatgtttagaatccggtggtgtagagtaaggcaatgcccagactaactcatgcctatcatgagttataaagcaaaccacaagactacaaacctgttggttttgtttgggcttccttgaaaccccgggaagttggtagaacaagaaccggaaccttagtcacttttagtggaaaacaacagaaagcctacctgtatagtagctggaaactgattagcaatcattttaagatcagttattttgtgtctattatagaactaatattaaaaggacaattgctggtg

SEQ ID NO: 21024 - DNA, 1033 bp, Homo sapiens
tggggtcgatgctgccgatgtgtttgggatgggctgggttggtgctgccatcaaagatgagggctgcaggcaggaagggaggatgctgttggctgggctgcagtctgtcccagcgctccctcttcccccgggctttcctcctctttctactttcacctccaatgcctctgtaggctccagtcctaaagctgccccactcccccgcttctgtcctcccttccctgacccctgacccctccagccctggcttaggccgtttttaaacctttgcaaacctgaaacagacgtcttttcagaggtctctccccacatcacatctccacattgcatttattcttttctttgactataacattctaagagaactcttaccaccttgctttggaaattatttgagcatgaggaacttgtttaatttatgactggctacaacttctcaaaaatcatagtgaatcctcctggaataagaaactctaaacaacaaattgtttttgaacataatgagagtttttataaatactaaattaaacattcttttaaagatgtgacataattttacattttgcaaacactgaaaacaaaacgttttgaaatggaaaatcaatgagaaagaaaaattttatttttccatgttggagccattaactccatagttactggagtaactattcaaagactccctttgtggggttctgaagagtggtctaggtcccctcagcagcccggccctgggccccagcaccgccccccccaccgcccgctccccgccgctgtggccggcacccactgtgctggttgatgagcatgcggatggagatgcggctgaggtagaagcggtccaggaagtactggatgttctggttggagacggggtcatcgccgtaggtgtccttgtactcaagcacgccttgtgccatggtgggcaccacgtcgttgtgccggttccggatggtgaccagggcgtcagtgaacctgtggggcagggcagatgttcacatgggacacccccagactcttctccgcttctgactcc

SEQ ID NO: 21025 - DNA, 1028 bp, Homo sapiens
ggggtcccctccggagcgcctccccgcaccgcagcgcctacgaggcgggcatccaggcgctgaagccgcccgacgcgcccgggcccgacgaggcacccaagggggcccaccacaagaaatatggctccaacgtccaccgcatcaaaagtatgttcctgcagatgggcacgacggcggggccctcgggcgaggcgggcggcggcgcgggcctggccgaggccccacgggcgtccgagcgcggcgtgcgcctgtcgctgccgcgggccagcagcctgaacgagaacgtggaccacagcgccctgctgaagctgggcaccagcgtgtcggagcgcgtgagccgcttcgactccaagcccgcgccctccgcgcagcctgcgccgccgccgcacccgccgtcccggctgcaggagacgcggaagctgttcgaacggagcgccccagcgcgcaggcggcgacaaggagcgcggcgcggcggctgctgaggcaggagcgcgccggcctgcaggaccggaagctggacgtcgtggtgcgcttcaacggcagcaccgaggcgctggacaagctggacgctgacgccgtgtcccccacggtcagccagctcagcgccgtcttcgagaaggccgactcgaggaccggcctccaccgcgggcccgggctccccagggccgcaggggttccccaggtcaactcgaagctggtcagcaagcggtcccgggtgttccagcccccgccgccgccgccgcccgccccgtcgggggatgccccggccgagaaagagcgatgccccgcagggcagcagcccccgcagcaccgagtggcccctgcccggccgccccccaagccccgggaggtgcgcaagattaagccggtggaggtggaggagagcggggagtcggaggccgagtcggcgcccggggaggtgatccaggccgaggttacggtccacgcggccctggagaatggcagcaccgtggcaactgcagccagccccgcgcccgaggagccaaaggcccaagcggccccggaga

SEQ ID NO: 21026 - DNA, 1029 bp, Homo sapiens
taaatgacttaatgtgtattaaagggcttacatgggtattagctaatgcagtagtatgattgttttattagcatatgcattatccatatagctttggtttatattttccatagagcctaaactttatagatcactatctaaatgaaaatttacatcaaactagtgttttaatatgacagttctagtgttgtttaagtctaagtgaagatttagggcatcttcctgggttttgggatttgtgcagtgtggcttctgaccagctgcatagacatggctccaggtaacagtccctgggactgagcagtggcccatgttggctgttggagctttcttttccctcatttgttatgagtcaataaagaagcagaaggtttggacgtgctagccagtgggaaagggaacctgagatggagctctctgatcaccctttcagccccagggcccggctctgtgtgagaagtctgtcccaaaattctgggacggaccacctcgctgaccagctgaccagctgaccaggtctgtgtgttgcaggtgggtgttgggaagaataaatgtctgtatgccctggaagaggggatagtccgctacactaaggaggtctacgtgcctcatcccagaaacacggaggctgtggatctgatcaccaggctgcccaagggtgctgtgctctacaagacttttgtccacgtggttcctgccaagcctgagggcaccttcaaactggtagctatgctttgatgtcctgttgaggccatcggacagagactggagcccaggtgacaggagatggtgataccagaagtcaagggttggggtggcgacacggcctcccgaggaagaggtctgcttgatggtgactctgcaggagactctgaagtgactgctgggaaaccctttgggagacctgacctggggccaaaaataaagtgagccagcgtcatgaacgcatgctatttagggacacacctggatggaactgcctggtgatctgttggtccttacccaggttctctagtgcacaccaacggg

SEQ ID NO: 21027 - DNA, 1058 bp, Homo sapiens
atgcacaggcggcacttagggcccctgaccaggttcctgaagcaggacttgaacccaggtgccctgactccagctcttggacttccagatggaccctgtcctggcttgggggcaagggaggtgcaaggataggaggttctagtccaacgaggtcacaacctcaaagccctcagcaaactgtcaagggctttatggaaggcgggccattctgagtattcctcagatcctggaagcccccatgactgggggcaggagagtcagggactgtctagccgctgccctcaggtagggggatgaaggggaatgccatgtgtctgggtgcagggtagaggacgttcctgaacctggtctcatttcattctcagatcaaacaatggaggtaggtgagcttatccccactgtacagatgaggaaactgaggttcagagaactggttgcccaggtcacacagcttggaggaagcagaatatagaatgctatctgactccaaacccatgcttccactatcgcgccatcctatcaggcagctaacgaatgataatgaatctataacaacgttattatctgagctaacttgttgagcacctcctatgtgccgggtgttgcgccttgcgtgttacattccttatgtctgaatcttcataacacccctcggaggtaggtattatgaaccatggcttggattgcagagccaggaatggaagtcgggccacctccccatcccagccacacaccggggcttactcacagttgtaggaggacggggagccccgggagcggctgtagtcctcgccgtagcggcggctgaagcccagctgcccactgccaatgccgatgccctccagtgccatgcgctccttggtcttgagggcgtgggttcgctcctgccgcagccgctcctcatccttgagcagggccatcacctgcttgaccttctcgcgcacgttgacgccctggtccttgccgtcgcggtcgatgtactggaagtccttgagtgtctggatggtgtagaggttctcgcggcactggtgggccacccgctcggagcccgtcttgag

SEQ ID NO: 21028 - DNA, 1046 bp, Homo sapiens
attaatgttaaaagagcagccactgttttgttgaaacaaacagcttaacttcagaaataagaactagcacacttagacaaacaggagagcaggggtttgaagccagctgtcgaagagcatccctgctgtcttaagaagctttttccccatagtgcctatagtttccaaagaaactcaacttcctaactgtgttaacttaattttattagaacactacagttgagtgagaacgtgcagaagatgtcaacagaagagaatgttgtgctaagataatggcctcctgctgctgcctaaatgctgaaatgaggttgagatgtttttcaaggctaacttcatggactcactctgtttagtgacttaattgtatcccaccaattactgctggtgacttactcacccttgtacagtgtttgcatagcagagtgaaggttacttattaccctctttctctcaagtgctttaaagaagaaacctccctggtgtttcttttctttttttttttgagacggagtcttgctttgttgcccaggctgaagtgcagtggcataatctcagctcactgaaacctctgcctcccgggttcaaacgattctcctgcctcagcctcccaagtagctgggattacaagcatgtgccaccatgcccagctaatttctgtattttagtagagacaaggtttcaccatgttggccaggctggtctcgaactcctggcctcaagtgatccacctgccttggcctcccaaagtgctccgattacaggtgtgagccacccggcccagcccctcccttgtgtttcaaccaatcggaagtgaatttaactagatgtagtaaccttttttttctttacttctaaaacagttacagtttactaataaagttaagtctggttctgtcctagaggaaataaattcactattaattcatgtcttaagttacttgggttaaaacactttcagccacccagattaattaaagtggagcagtggagcccctggctgggagatggcctccagaggagcagctgcagggcatgttctgggctta

SEQ ID NO: 21029 - DNA, 1035 bp, Homo sapiens
gcacattgaggggcatactgaagcatgaaagagtggtaaatttcacattttcagatgtcctcaaaacatttattcagtatctgttgctcataatgctttatgacaataattaaactcacagtcactgcatataagtgggtagagcagataaaaaggaccaaataagatattagcatcatcagatgtacaatggtgtggaacagtggcaaggatggtcgtatgcttctctacatgattaaaaagcttagcatcactccttctaagcaagaatgcaaaattctggctcatatatcacaccagaggggtctttgggagaaagggctgtcaccttggggttcctgaaacatggctttaatgtgaagtgggattaagattttttgtaggacgtctcaggtacagagatacccaaagagactggaatggtgtttcagaaacttggatttcctcatcagttgtattgtcatgatggtctctcattcacaggattgttggaaagaaccaatgagatcacataaagatgtagtactcgacagttaacagatacttgtatgcttcccccacagaggcctcgatttattttcctgctattctttctcatcaagctgactttcccctgcgtttggccagccccagacaagtgacagtgggtttgagttccaaattcaggagagcattttcagctgtttgcctgttggtgcattttggcctgataggcttctgagcaagcaggcttttactatgtatgccgtctacatttctgtcttggagagtttgcctggggctgttcataaggaactaggagcagaaatctggcatgtgattcttacagacatctcaaacgttgatccttcctgaaggagcctagctggagaagagcagaaacggggcagatgcctctaggcaggccttgactgatttaaagtcccagtcctgggcttcactcgattaagggtttatcagaccttcccacccatattaaagccatgtttctgggaccccgcagtgacagccgtttcttcccaaagacccctctgg

SEQ ID NO: 21030 - DNA, 1092 bp, Homo sapiens
gaaataaggaatacttgaaggtttctcctttttttacacttgagtcatgtgcaaggttgaaccatatgaaattgccagtgttcaaccattgctgatctgcaaaagcgacaatatcatatgcctcaacctaacacttactcttaaatgcaggttaaaatctctgtgaggcaaagggataatattctctaggaactcacttttgagagtatttttctctaacccatgtggatctaaattttaaaaataggaatgaatctcttaattgcagcttgtggagagtataaaacattttgagcacaatatgcagcacataacttttcagattgtgtttgcatagaaaaggttaaaatcaattctttcagttactgtattgttcatttcttgtaaaggtcttcctacatttgagacgagaccctttaacataggctgccttagtaacaaaataaaacagatgtgtcataatattaactgtcctaaagaacatgtgtcttgcaaatgccatggaactgaatatttatttccttgtgagtattatgaccgttaccaaaggactcaaccagatttagggctcttcttaattgatcatgttcagaaagggactcatttggtcccactttgtaacatgggaagagtagaagagaaaattaaatgtggaaatcataaatgcttttctaacagggttatgctattctgtaacactaaatgtctgtcttttctcttaaaagattaagttttattaattttgtcatacatttctctatttgaatatatcttaaccattttatgttccaaattcgttttttgtccaagacattctatcagaattttacttgcctctataatctgaaaaatgggttctagaatgtcccacttgctgtctcttagaggctgagcttcatttctatgagcaaagagctcatttagcaatgtagttatttcagtatttatttctattatggaatccctggggttcagaatgtaactttgtacatgagatatatataaatatgtatatgaacatgtatgaggtctagtgtgttttgttttgtttttaccgttcctggggatctgaacttggtttttatttgcaag

SEQ ID NO: 21031 - DNA, 1071 bp, Homo sapiens
agttttgggcatcttgttcatggactaaccacgagcattacatctgactcacatcattctatattttatgtgttcagcctaacttgagtcttcttatcattcactaggtgatgaaggtggagaatcagaacttcttggagaggatcttccacttgaaccttctgtcaccaaagcagaaaggagtcacttgatagtgtggcaagtgatgtatggcaatgagtgagcccatgggaaacaggtggagatggggaagccgtctcttctgcatggtttattttccctctatccttttatttaatgctcttttgtgagataagtttcaccacataatgtgtgagcattttttcctgttaactttatattacaaaatccgttctaccataacaatacagaggaactagctgtgttactgcaccagtgttataggtaacttcagtatattatgaacaaatcaaagaatgtttacttcctgcaaactggtgaattatagaaagcaatccagatgtggtttactctgccacagtctaatgtcattcacttcatttgatggggtcacttgttagctgtcactaataatggaattaatgggaaacacttgataaatgaaactgtaccgttaaatacaatagctgagttttccccagtgtattgtaaaattgacacacactaatacaagatggattatcaggatgtatctaaatgtcccgagagggttaaaagctaactgtaaattactttaactttcactttcaaatctgacaaatcttgtttatatggtatataaaactttgttttcatcagatttgggggggttttatattaaagaaattaagactacactatttaaataaacgtttcctgtttctgacttattagagctctaaagtttatgaggcctacttctctgaatattctgatgggttttttttgagaccagtctcattttcatactgacatgtctgaaagatttattatttataaagcttaggacatactctgggaagcttagaagatacttcagcactgggaggattttttaaaggaaatgtgttttgtatttcttgtaccaga

SEQ ID NO: 21032 - DNA, 1063 bp, Homo sapiens
tttaccaaccccctcaagggaaatattcttactgtgagggagaaaaatcagaagataaactataaagaaagactttatttgcaaatatacccatttactttaaactgtataatggttagttttctaacatgtgcattaaaaacaaaacaagaaacaactaagattcaaatttgttttttttttaactaaaattattttttaaatgaatagatgtgtttaaaaaataagcttacttattgctagactggcaaaatcccctactccatttactgaggtacttaaaaataactagcatgctgtatctctttttttcccagctttgtcttgaattggcattgccatccttgttttatctcaactggctgtagcttttagataatatcataaggattaaccagtaacctcttacattcattactgttttctaggggaaaatatttggtatttggtttttctgttgcagcaaataaaacctcaggtgtaccaggaaatcgtcctggaagtgtaatccgtgtatatggtgatgaaaacagtgataaagtgactccagggacatttataccctattgttcaatggcacatgcacagctttgcttccatgggcaccgggatgctgtgaaattctttgtggcagtcccaggtatgttagattattctgttgagatgttccatgtaattgtctctcttctgtcatctcttggttccactacctaatagtctaaggctaagtactcgaattgcaggtaatttcaatatatacgaaggaagttctgtaatggaggtgtgactaaggtgctatagggatacttgaatgaagttactttggaatatctctcccacccccaaagataaatttgttgatttttctttaggagacttgcttacttttgaaaagcagtagtattattttatcatcgtggattgccaaaaatggtcttgacctaataagagaaatcactagaaagaagcttctatcatcaaggctgcatggaggaagagagaatgcactctggtacctttagcagcttaataggaaaaagcagtgaactaggaggcctggggg

SEQ ID NO: 21033 - DNA, 1035 bp, Homo sapiens
agaaaatccagccatgcaggaaaaaaaaaggtcaagcatttggcagttgtaagtattgaaaaacaaagatgttagacagcacatgagacaagaaaattacagtcaaaatttatttccaagaatgattttatgtccattttctttccttcattttttttttttaaactaggggtaatggttaagtagctaaactgaactttttttttttttttaatatatagtgtgccaactcggtaaggctcttctcaaggacaaaaaatatgatatcgtaagctgcatcatgttgactgtgcatttgttgcaatcctctgccaaatttaaataatggggaattatttagagacttgaaaatgacctggatccccattaaataagtttctgattggctggttttgtgattgtaagaaactttacaaagtgaagatgagaaatttagtgcttgtagggtttgagtaatattgtgtatgtattgagcttgagttatgtttgtgctagaagtactatgtgtttactgtgattaaaacttacccttttttggtgaatctgctatttaatggaagtgtcaattaaaaaagaaatagacccgaaagtagttgtttaaattgagcttaatcagaaaatgtataaaatgtgtgttaacatggtaatatgtgttccagtacttgattataataagctgtttttagaactggcatactaagcttccattcacatcacacagccataaccttgcggtttaacaatcgctcttaccttgcaccaagtaggagctagcaaaaaaaccaaaatatatttattcagtaggagaagtttcctctatttaagagcttcttgctttcattatacaaattgctagttaaagaacaggcacccgccattctaagcaatagtttctcttcactgaatgtctgagtttggctacgagttactgctaaggctacagcgtatgactacaaaaactgtttttgccaatttctaactcattgccttgtaaaagtactctgaaattttcttcaacattaaagtttgtggaaa

SEQ ID NO: 21034 - DNA, 1093 bp, Homo sapiens
agagtaagctctgtacattgccagttaatcttttaatgataattttaaaatgttgttgctgttgtatcattgatgcaaaaagaccaacaatagaagtacaatacaaggaaattcacaacatattatagtgggacagactgagtcacatttaggtgatggtgaggacgcagtagcagtatattcatgcacccaaagacgtgcaagccaagtaggataatatatggatcatacggtgaattttctaagcccactgaggactttgtaccttttcaaaaatgtcctgtataccctccagtttacagaattatctgtcttgtctactggcttcatggctaatgtaaactttagaaactatattataggatttgtttttcctgtagcacacatttcaatttttttcctttttataaatatttacacttcattgtgtttagttaatggtttctctacatcttgtcaatttctttgtttcctctctctcattttaaagtaaatgagtttagttcttgctttctgaaaacaatctaattgagattctcattcatttttctcttgggctgcttacgtaggggaatattctggtgtgtatgattttgaatattttaatattactgctttttaagctaggtgttcttggctgctgttctcatctaatgctttctcatcatttttttctgctcaactatttttttgcctttcatatattttcagcttccacgcttatctaactgcttgagagtttatagcaaacatagttactatataaactgttttcaaccagtctacattcttatttcttctgtctctataactttgttaaaaagttaacattcccagccattgtatctacaaaggaataaaaatttagcattagtgtttaaagcaaatatcttgccgaagatcattttggagttagaatttggaaacttttttgggacttttattttgttttgtttggtttcagtttgtagataatacataggtagatgattaatctatttctgatatttaattctttctggtgtaagtaccctgatctttgagaaaattagaatatagacaaaatatgagtccaggtacacagaatatgtag

SEQ ID NO: 21035 - DNA, 1055 bp, Homo sapiens
ccggccgggcgcagtggctcacatctctaaacccagcactttgggaggctgaggcaggcggatcacctgaggtcaggagttcgagaccagcctgaccaacatggagaaacctcgtctctactaaaaatacaaaattagctgggcatggtggcgcatgcctgtaatcccagctactcgggaggctgaggcaggagaatcacttgaacctgggaggcagaggttgcggtgagccaagattgcgccattgcactacagcctggggcaacaagagcgaaacttcgtctcaaaaaaaaaaaaaaaaaagaaaagaaaaagaaaagggctcaacccctaaaatcagagcttttcccttctcagctctcatgctgtatctctgggatctagttgtcagaaatatagcccacacattgggctattttaaagagtgtaaaatatttttatgtggtaagtataaaagggaagtaagttacatataagtaaatttcattttatttggatagcctaggataaatttaaaacataattttcttctaagtagatctaaattaaccacttccttgtagcctgaaaccttgggattgctgaggtatcatggtccctttcctgttttaggttcagctctctcctggttatttttttttttttttttttttttttctcttttcaccccatgatatctagactgtctcctggttattttatttcatgctcccagatccacaaatgaatttggaaagtaggcctttgccacacttcatatgttgtgaacttttaaattactaaatacaattttttctgaggtgaaaataacctgccttttgtggggagtgggggactggaataataaggaggaagaagaaataatttctctatatttaagaggtaaatgagaattccaagattgacctcaaattatttatttttgacatagtttcaaaggcatatcactttctcatatagatgaactcaatattctctagggctttctgaatccgccgtcttaatgggttttaagtgctttcatcaacactgtttatcagaaatacagactgttt

SEQ ID NO: 21036 - DNA, 1064 bp, Homo sapiens
tcgcaaacttagatttggtgttaaaatttaccctcttggccaggtgtggtggctcacacctgtaatcctagcactttgggaggccgaagcaggcagatcatgtgaggtcaggagttcaagaccagcctggccaacatggtgaaaccttgtctctactacaaatacaaaaattagccagacgtggtggtaatgcctgtaatcccagctacttgggaggctgaggcaggagaattgcttgaacctgggaggcagagcttgcagtgagccgagatcgtcccactgtacttcagtctgggcaacacagcaagacacaaacaaacaaaaactaccctcttattgtactgccttcctgcttttgaattttccccctaaatcaaagttctgtttttaaattttatttccttgtgcatacaactttgactaaatgtagtctctcaacccctttgcttcacctcatttttaagaaggcattgggatagttttactagtccttttagattgttaggaatggaagaacacaccctttgtattaagtgaagacacatttcaaaagtggctgaagtttcttggaataaaaatgaactacagaattaaagacttacttagcaaaactgaaattttcccactttaattaatgagctcattgtttttattctaacttacattcttaccagtagaggtaggaattccaggaggcaccaaacctttagtgtatcatttctttctagtttctacacttttgagttaatgacccaggatgacccgttagtaggcttgtttccaccctctaaaagctcttcgatttggaatcttgtgtgcatcaacaaaggatgtgtttctcgttgaaattctgttagtattaaaattgtaactcttgttcattgaaacttctcacaaagcattggaaattcagtaatcttttatagaattatttgaccttcttatttggaaaaaaccgacaatggttttctcatatgtactgtgcttgaaaggaactcatatagtggttctgtagaaaaacagagctttcttacttgggtggtggggagaaagatattttgagt

SEQ ID NO: 21037 - DNA, 1080 bp, Homo sapiens
acaaaacaaaaaaacacactacacctttagttccactagacatttttcttttccctccctccctcccttctttctttttctttttgttttttttttatttttaaattctctttcttcctttcttttctttctttccttccttccctttcctccctcccttcgttctttcctttcttccttcctctctttttctctctctcttcagttgtttattgctgaattgactcctgaatgtgtgaattaatatgcatacctgagaaaattgagaattgcagttctgagaccagaagcaatggacctggtggacccaagaatagattatctgaagcgtgtcctattttactttctcacttctcttttctgtctaacaacactggtgctccctcccactcactttttttttttttaacctgagtgatactgtgaggccttattaatatttaaattgttatgtataatttttgttcttttttgtgtgtttatagactatagtgcatatcattttattccagacatcaggaaatgctttagggtatgggattttcttgtgggtatgaggaagaaaggacaatgggctcattgcctgctcagagaattaagtacaaaggcggcctgagtcctgtaattcttaataactcagatgactgagtcaggcaggccagagttctggccccaaagctagtgacaacttgaaaagttagtcattgaccagacaatcaacttggagtttacctatgaaatcatgatatggtgaggattaaatggagaaaaaatggctgtaactgcactgactgacttataattggtgctcaataaataatagctgccattttgttgttattgttctctcttttcttttccccctcagtcatttttggttgtcagttctttcctttaaagtgctagtttggttgagttagaattgatttcattatatagataattttggaatgtcagaatactatatctgtaattacattggactagtcattaaaagaaagtttagaataagataatagagaatcagtctgtagaatggctattgggggagaactatttttgcattttgcttgtcattct

SEQ ID NO: 21038 - DNA, 1161 bp, Homo sapiens
atcattgattgccaaggtttgggagatggtagggagggatgaataggtggagcacaggatttttaaggcagtgaacttattttgtttgatactataatggtggtcacatgtcatatttttgtcaaaagctgtagagtatacaacaccacgagtgtaccctaatgtaattgatatattttgggtgataagcatgtgtcagtgtaggttcatcgattgtaaaaggtataccactctgattctggatgttgatggtaggggaggttgcgtgtgtagggggctgcaaatacatggaaattctctgtactttcattcaattttgctgtgaccctaaaacggctctaaaaataaagtctattaaaaattaaaagggacaagtcatctgtaactccaggtagtttgcatgtgctaaatgccctttttctgtgataaatggttgctattaaataaaaaaatatagatatgtatgtatattatttatatgagattagtaaatataaccatttcaccttttgaaagagatggttagagaatggattgatagtttatcaaatgttatttctgaggtgaaagtaagactgtgttgccaaatggaagtaaatttagcaaaaagtaaccctgatgggttagaaagctgtgaatggaggctgaaggaattaatgatagaaataattcaaaatgcttaaggagaacaaaatgattactagaactttaaggaatttttatggatgaacctaagcttatgtgaacaatggtcatattcatttagataaatattggaaatctcccaaaattaatggtatattctgttatatgtctccttcccacaagcctttttttttttttttttttttttttggagacagagctttcgctcttgttgcccagactagagtgcaatgttgtgatctcacctcactgcaacctccacctcccaggttaaagtgattctcctgcctcagccttctgagtagctaggattacaggcgtgcaccaccatgcccagctaatttttgtagtattagtagaggggtttcaccatgttggccaggctggtctcgaactgctgacctcaggtgatcagcccgccttggcctcccacagtgctgggattacaagtttgagccaccgctcctggcctaatctcactattaagtggtgtac

SEQ ID NO: 21039 - DNA, 1032 bp, Homo sapiens
tgctctgtagcccaggctggagtgcagtggtgcgatctcggctcactgcaacttccacctcccgggtcccggttcaagcaactctccttccttagcctcccaagtggctgggattacaggaacgtgccaccatgcccagctaatttttgtatttttagtggagacagggtttcagcatgttggccaggttggtcttgaactcctgaccttgtgatctgctctcctcagcctcgcaaagtgctaggattacaggcgtgagccaccacacccagccttaagatgctttttaaacatccaattgaagttttctagtaggcagttggacatacaaatctggaattcaggtctgggctagagatagaaattcagaagttgtcagcatatagttcgtacttaacgccatgaaactggacgcgatcactagggaataagtgtaaacaaggaagagaagatgtgtccaaggacggagcatgccaatgttaagaagttggggagaaaaggaggtactaccaaagaagaccaagaacgagcagcaaacaagaaaacatcctggtagccaaattaaaaaaaaaaaaaaaaagttttaaggagagcggatcacttgtcagatgttgctgatacaacaatcaagatgaagactgagatttaatgattgcacttagtgttactatccttgatgagaacaggtttggtaagttagatttgagtggtggagttattcctaggacatgtccttttcttaggaatttaaactccatggttcaggtgaatctatgactattaatcacacaaccatttaacaaatatttattgattattccatcattcttttgttctctattgtacatgttatagatttttaagttgtctggaagtcaagatgcatatgcaagtatacaaaagggtttatatatttgtagtaagatatgtatatcatatggaatgcctataacatgaagtggaaacaattattttgttatttttttcttctatatttgggagttttttaaacttaatttttatagaaaaact

SEQ ID NO: 21040 - DNA, 1029 bp, Homo sapiens
aatttttgtatttttagtagagaccgggtttcagcatattggccaggatggtcttgatctcctgaccttgtgatccgcccgccttggcctcccaaattgctgggattactggcgtgagccactgtgcccggcccaaagtaaccaattctttaaacccatccggctgggcacagtggctcatgcctatagtcccagcactttgggaggccgaggggggcggatcacctgaggtcagaagttcagaccagcctgacaacacagagaaaccccgtctctactaaaaatacagaaaattagtctggcgtggtggcagatgcctgtaatctcagctactggggaggctgagttaggagaatcggttgaaccctggaggcagacgttgcagtgagccgagatcacaccactgcactccaacctgggcaacaagagcgaaactccgtctcaaataaataaataaataagtaaaaacccatttacccccacaggcttgtgagactggttggaagaagtgctgctaggcagggcctgtgtgtttggaaaaaaaaatcactcagggtgtttgtgattataactgtctcacccttccctctaattcagaaaccattgcttaagagtggaaaaaaaaaaccacgaactgtctgtcttctgctctcacaccaaaaacaatcagcccgctgtatttgtagttcatgagcatggtgattgggtgttcatgcaggtgtgtgagatatgccacccttgaaccttgttacaacactggcacattctcagacctgaaaaaaaaaacacacataacacagaagacttctgtgaccaaatatgtggggtagggcaggtgcagtggctcatgcctataatcccagtgctttgggaggctgaggcaggtggattgcttgagcccaggagtttgaaaccagcctgagcaacatgatgaaaccctgtctctacagaaaaatacaaaaattagctgagcatggtggcatgtgcctgtagtcccaactacttggaaggctgaggcaggaggattgc

SEQ ID NO: 21041 - DNA, 1062 bp, Homo sapiens
atccgcccgcctcggccttccaaagtgctgggattacaggcgtgagccaccgcacccggcctatttatttatttttgagatggcgttttgctcttgttacccaggctggagtgcaatggtgtgaactcgcctcgccatcacctccacctcccgggttcaagcgattctcctgtctcagcctctggagtagctgggattacaggcaagcgccaccacacctggctaattttgtagttttagtagagatggtgtttcttcatgttggtcagactggtcttgatctcgcgaccttgggtgatccgtccaccttggactcccaaagtgctagaattacaggtgtaagccaccacgcctggccttacagatactttcattgagtgccaactatgtgcatgatactgtgctcattgggcatacagtggtgagtaaaacagacaaggtccttctctcatggaactgatagcctactttaaggccagatctctctctggagtttcagattcatcttatgattgtttattgggtgtgaatatctcccagcgtgtccaaaactgaacttatttcccaaacctggttctcttttcttccctatcttcatgaaggataccaccatctacctggccagaaatcaggttaccatccctaactcttcctcattcccattgctgctttcttttgttttcaacttttaaatattgctggaatctcattactttctaaatccatttatactactgtggtacaggacaccaatatcgctcaccctgaatgcaaactccatagacctggaagtttgtcattcaccactatatcccagtagctagcacgttgaaagtgccagggaaatttttctgaatagatgaatggacaactgaaactagtccataactgatttttctgcttccagtatggccaacctataaaccgcccatctctccaaaatggaaatctgatcagatcattccacaagcccttagtggctttttctcaaattcctgggctcaagtggtcctctcacttcagcttctcaaaatgctgagaatacagatgtgaggcaccgtg

SEQ ID NO: 21042 - DNA, 1039 bp, Homo sapiens
aggctggtctcgaatttgtgagctcaagtgatctgcctgcctcggcctcccaaagtgctgggattacaagcgtgagccaccacgtccagctagggttttttttttttttttgtaaggttagtaaactttttcagtaaatccaccaccacccctcccagctttttattaggtaaactttcaaacatatagaaaaatggaaagtacatttgtcatttgtatacccactatatagattcagtagttgttgttttatttatctgtctgtatatgtggatgtgtgggtgtggatacacatatacacacatacacatatttaattgctgaaccattttaaattgcagacatactttgcccctcagtacttaacatatttaaattacagacattatgatactttgcctctcagtacttaacatatttatctcctaaaaaatgagaatattctgccatataaccaccatattatttacgtttgagaacatttccaaggccgagtgtagtagctaatgcctgtaatcccagcactttgggaggctgaggtgggcggaacacttgagctcatgagttgaagatcagcctgggtaacatagcaaaaccttgtctctacaaaaaatataaaaattagcgtggtgtggtggtgtgtgcctatagtcccagctacttggggggccgaggcaggaggatcgcaccagcctaggaagtcaaggctgaggtaagatgtgttcatgccactgtgctccagcctgggcaacacagtgagactctgtcaaaaagaaaagaaaagaaaaaaaagaacctttgtaatatcatctaatattaatttgaattaatttttaagagcacagtatgtgtcagttattatatagctaactagcttcttaatatgtttataatgaattaatgaaactcatctgggaggaagtgtttgcattttagttacttttctataagaaatttaaatttgaggccggacgcagtggctcacgcctgtaatcccagcactttggaaggccgaggtgggcagatcacgaggtcaaga

SEQ ID NO: 21043 - DNA, 1057 bp, Homo sapiens
aaaatcacaaaagaacgctacgcatggtggctcatgcctgtaatttcagcactttgggaggccgaggtggtggattgcctgaggtcaggagttcaagaccagccctgaccaacatggtgaaaccccgtctctactaaaaatacaaaaattaactgggcatggtggcggacgcctgtaatccaagctactccggaggcagaggaaggaaaatcacttgtacctgggaggcggaggttgtagtgagccaatatcttgccattgaactccagcctgagctacagagtgagactgtgtcttcaaaagaaaaaacaaaacaaaaaaaaatcacaaaagaggacaccaaactgggtatagtaccaaactggttcagagggtagattagtagattgactattcactggattgctgaagtgtgtgccataggtcacacatccagttctgtgcttgagagagtacaggattcctgcttcttgaaatctttaccttacctttaactacatgctgcttacttatgttgtactgaactttgcttctcaggagaactgatgttagaacctacccaagttattttgctctgctctgcactcaatgaatacagctgttatctaaataagttattaggttgtggtcagaaatatctgcatagaccagtttaataatgtatgtaatgttatatatatttaaaaagctgttatttggaaatgggtatatataagttctgttttttactttgaaatcttgaccagtgatatttgattattgctttgaacatagcactgtgttttcttttctttttttttttgagacggagtcttgctctgtcaccctggctggagtgcagtggcgggatctcggctcactgcaacctccgcctcctggattcaagcgattctcctgcctcagcctcccgtgtagctgggactacaggcgcccgccaccacacccggctaattttttgtatttttagtagagatggggtttcactgcgttagccaggatggtctcaatctgacctcgtgatctgcccgcctcggcctcccaaagtggtgggattaca

SEQ ID NO: 21044 - DNA, 1064 bp, Homo sapiens
tccacctgccttggcctcccaaagtgctgggattacaggtgtgagacactgtgcccggccaacctatttgctttttcttttctttcttttttttttttttttttgatatggcatttcacacttgttgcccaggctggagcgcaatggtgcgatctcagctcactgcaacctccgcctcccagatacaaaggattctcctgcctcagcctcctgagtagctgggattacaggcatgtgccaccatggccagctaattttgtatttgtagtaaagatggggtttctccatgttggtcaggctggtctcgaactcccaacctcaggtgatccgccggcctcggcctcccaaagtgctgggattatgggtgtgagccaccacgcccggcagcggccaacattttttcatatttttaaaaataccattttttttttctgaactgtttgtttttgtgatttttttttcctttggttgggtttttttttttttcttttttttagagatgaggttcaggctggagtgcagttgtgcaatcatggcccacagcagccttgacctccagggctcaagtagatcccacttcctcagcctctgagcagctgtgactacaggcatgcgccaccatgcctggctaatttttaattttttttgtagaaacagggtctcgttatgttatgcaagctgaactcactatgttgcccagtctggtctggaactcctgggctcaagtggatcctcctgccttgtggatcctgccaaagttttttttttttttttttttttttttttgttgagacagagtctggctctgtcgccagtctggagtgcagtggagtgtcttggcttgctgcaacctccaccacctgggttcaagcgattctcttgcttcagcctcctgagtagctgggactacaggcgcgcgccatcacacccagctaatttttgtatttttagtggagatggggtttcaccatgttggccaggatggtcttgatctcgacctcaagtcatctgcctgccccagcctcccaaagtgctaggattacaggtgtgagccactgcgcctg

SEQ ID NO: 21045 - DNA, 1029 bp, Homo sapiens
ctgtgagtgctttgtttgcgccttttttttttttttttttttttttgagacggagtcttgctctgtcacccaggctggagtgcagtggcacaatcttgactcactgcagcctccgcctcccgggttcaagcgattctgcctcagcctcttgagtagctgggattacaagcacgtgccaccacgcctggctaatttttttgtatttttggtagagacggggtttcaccattttagccaggatagtctcaatctcctgacctcgtgatctgcccgcctcagcctcccaaagtgctgggattacaggcatgagccaccgtgccggcctgtttgtgtctttaatgcggagaccaagagtcttttataccaaagtaagtgcctcagggtatttacagcaaaagtgatttgaaagcatggaaattatccatcaccagagagagtaaagtaaattctgagcacctctgtggaaacttaggtgggtatgtagatagaatgttttaggaatgtgtgaggtgctatgatctcttgcttgcaggaattctcagcaaggcatcaaaaatttaatctttatattgataggacatattttgaataccttctgactttttcctttgcttttatttgaatttctagtgtggagctagtctgctgttttagggattctttaaaaacaacctaaagaagggctaattttagatagatttggaccggtttcagatgctaatcaagaaatctgtcatcttatcgcccatcactctctcctttgggctgcctgtgacacacctctccattctttaaccaagacccgtctgatgcctttgcccatgctctagaatgctctccttagaattttacatagctagctcctcactttctactctgtttcaatttcactttttcagccagaacatcctgttgactctatccagaataagccctgtgaacctattgaataatttattttaaaatcagtgacttttaaatttaaattctttttggagacagagtctcaatcgcctaggctggggtgta

SEQ ID NO: 21046 - DNA, 1046 bp, Homo sapiens
agaactaactgcacagtcttgtttgctgtacctttgaacagtctgatgggtgtttgctatgattatatgcataacgtattcacttttctgtctttggtctgttaaatttttgatcaccagtaccaaaaccagtaccaaataaaataaattgccatctctcaaaagattattcttggccaggcgcagtggcttacgcctgtaatcccagcactttgggaggttatcccatgtggggaatcacctgaggcaggtgaatcacctgagatcaggagtttgaaaccagctggccaaaatgaggaaaccacatctctactgaaaatacaaaaattagccaggtgtggtggtgcacgcctgtaaatcccagctacttgggaggctgaggcaggagaatcacttgaacctgggaggtggaggttgcagtgagccgaaattgtgccactgcactccagtctaggtgacagagcgagactatcttaaaaaaaaaaaaaaaaaaaaaaaagattattctttaaattagcaagtaagatgtcagcagccattatttttaaactaattgcttgtaactaaaatcaagacatgggccaggcacggtggctcacgcctgtaatcccagcactttgggaggctaaggtgggagggtcacgaggtcaggagttcaagaccagcctgaccaacatggtgaaaccccatctctactaaaaaaataaagacatgaattatttttctgactgtactatttgactttaaaagttgtagcaattttaatattgttccacatgatgacactgccattgcttcatgaaaaacttaagtggcatactacctatccagatactctgctgagttctcattctcatcagttgatttttttctctgtatgagcagtttccaatttacaccccatatatgtgtatcctctccatttattaatgaaaagatacataatagagaaaaatgaagaacttttacccttgatctggagccagatgcctgcaggggctggtggttacctgtgtgagtattgtgggcaacctgggcagtgagct

SEQ ID NO: 21047 - DNA, 1016 bp, Homo sapiens
taaaaactctgtatgtgataaatcagaaagaaagaagtcaaagtgttaccaagtaggatttggagcctagctgaaactagataggtaaatagtaagcactcagcccagtttcatgatgccgtgacagcaggcagctatagctatggtcaaacgcactgcttttcccagacctctgaggtcagttataggtaatcctgcttttgtttctggaacacactagaatttacatagatttttttcattagaacttctgttatttaacataactcaatagagaagcatgtttcactttgaagagacctttatataatagattttcctttcttttagaatgtcaaagtattatttttataatagtggtatctaatttcaagtacttagaattctcttcattgaaaaggtgctagctgacggattcctgatgattgggatcgatggctcagaagcagcagacggatctgactggttctgttaccatgcaacctctccttctattttccctgtcggtttctgtgaaattaacatgattgaacttactccacccagaggtacttcatcctaatataaacactgggttttaattgttgctttcttcttacatggtttttgtttacaacatttaacacagccctagatttcctgagtacgtatataatgtgtgtggataaacatatacatacaggagctgtaggttgctctaaaaatataaagtactgtattctagcgtactttaataaattacagtagtatagaatttttcctgagcatctgtgtattttataatatgaattggtattctcaaactctgttgagtcagtaatgtaggctcaacaggctatggcatacatgatttttttctttttttcccaataaagacagggtcttgctctgttgcccaggctggagtgcagtggcacaatcatagctcacggtaacttcaactcctgggcccaaggaatcctcccacctcagcctccctagtagctgaaactacagctgaaaggcacaaccatgtc

SEQ ID NO: 21048 - DNA, 1050 bp, Homo sapiens
ctcaaaaaaaaaatttttttaaaacagtgattcctgaaacaccttgatcatgttaaaaagaaaaaaaaaggctgggccctttttttattacaattacaggtggctcacacctgtaattccagcactttagaagggcagatcatgaggtcaggagttcaagaccagcctggtcaacatgatgaaactaaaaatacaaaaaaattagctgggcctggggccaggcacctgtaatcccagttcttgggaggctgaggcaggagaatgcttgaacccaagacacagaggttgcagtgagctgagattgtgctattgcactccagcctgggcaacaagagcaaaactctgtctcaaaaaaaagaaaaaaataaagactgcgtgcagtgcctcatgcctgtaatcccagcactttgggactccaaggcaggtggatcacttgaggtcaggagttcaagaccagcctggccaacatgataaaaccccatctccatacaaaaattagccaggtgtggtggtgtgtacctataatcccagctactcgaaaggctaaggcaagagaatcacttgaacctgggaggtggaggttgcagtgagctgagatcgagccactgcacttcggcctaggcatagagcgagactccatctcaaacaacaacaacaaaaatcacgtggattcccatgatcgactccatgtctacatgaccggaatcacagtcaaggccaggcttggtggctcatgcctgcagttccagcactttgggacgctgagctgggaggatcctttcagttccagatcccacccatgtgacaacagtctctgtgtctgttaattctgattactgagaaagagtctgaatagctgagctaagcctttggtttggttccatatgtgatacatacaagtccctagtctagtcacctgtatttagaagaatgaagaaaggaatcccatgtaagtggggtagttctgtccagaggtcttaggcaaagctctcaagcttgagagtagtaaatttagtgtacatgtttaccatatagaaataacgagagaaa

SEQ ID NO: 21049 - DNA, 1035 bp, Homo sapiens
ctttcatctaaaagatatttgggacatttcctacaaaaagactgtgacaataagtatttcagatatctttttgaactaagattaaaaccaatagtagggacctagagaatagtacataaacattatacattctgacaaagcagaaagaatgcaactaaaatataatgggatggaaaataaaaggaaaaactaaggccatgtgtggtggctcacacctgtaatcccagcactttgggaggcttaggtgggtggattacttgagcccaggacttctagaccagcctgggcaacatagtgagacccagtctctacaaaaaaaaaaaaaaaagtgtttaattagccaggcatggtggctcatgcctgtagtcccaactactcaggaggctgaagtaggaggatcatttgagcccaggaggtcaaggctgcagagagctgtgtttgcctaactgcactccagcctgggcaacagaatgagaccctgtctagaactgttctttttcagaactagaataagaataattactgtaattgaagtaatatgagggagtcagaggctaccatctaaaactgaaagaccaaatagaaaagattaggtaagaaaaaaaatacagtgtactgtaaaagctattaatataaaggtaagcgtgacgaagactttccaaaatactgagagaaatttttaaagggacaaagaaaaccatgatggaacagaaaaaaaagtatacagtacataatgcataccctaatgataaaatatgtggagaattgagagcaaacataaaggccaggacaaatatgtaccaggcaaatagaaaccccaagaatacaagactgaaaatgctgatagcaaagtagaattcaaaccaaaaaaagcattaaatcagacaaaagagaacagtttataatgctaaaaaccatgattcacaacaaagaattcacagttaaatatgtaccacataacacagcaacaatctgtataaagcaaaatctatatgaagtataagaagaaataaaaaactaaaattaggggacttt

SEQ ID NO: 21050 - DNA, 1053 bp, Homo sapiens
tttaaaagccagcaaataaatttcaccttaagccccagtctcctatttaaaaggttagactcaatttttctctcctcctcttataacttagagactgttgctttgctcttgtggacttagactgttattttatttttcatttgtttacctcaacaccagagtgtttagaaagaaaatagctgtactttttttttttttttgcaccacctccttctctgaataacaagtagcttctatctatctaaaaccccatactgattgcttgtgagtaccttgcaaattatggcaacatctgtcttgaataagtatttattcatagtgccttacgttgttgcgtcatgctttttaaccatccagtttctaactttatgtaatgtttgacataaaatatttcctctaaatctactcattagaattcagcttgtgaaaaagaatcagtagaggtgtaataatagtgtttttaacattttaattaataaggagttccaagtttttttcctgcttactttaaacatgaactgtcatgacttaagttgactgactttggagacatctgcattctaaacatactagacaggaacaactggttttatttttaagacgctgccatattctttaaagctggttatatgttgaccttattatctaaacctttctagatgttctagtgctgcttttggtccctcaataatgttgaaaattaaaacaacattttaaattgttttcaaatgtaacatagtgatcaaaggaaaatataagctatagtttaaaagtgaaaacaacatattaggataaatactaaaccactgaattactaaaagccaagagtgctcagtagtctgagtaaccacattctaaaattagacaagtgacattctttgggttgctctttgtttctcagcttttcatctttaaaatgtttgctaaataagatataacctttcacacttatgtatcattagtctgagggtttcaaaattcaagaaagaataaaaacatcaggacaataaaagagaaaggacttacaatagttaaaacaagctaagatatttc

SEQ ID NO: 21051 - DNA, 1060 bp, Homo sapiens
aaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaagtaatttatagattcaatgccatccccatcaagctcccaatgactttcttcacagaattggaaaaaactaaagttcatatggaaccaaaaaagagcccgcatcaccaagtcaatcctaagccaaaagaacaaagctggaggcatcacactacctgacttcaaactatactacaaggctacagtaaccaaaacagcatggtactcataccaaaacagagatatagatcaatggaacagaacagagccctcagaaataatgcctcatatctacaactatctgatctttgacaaatctgagaaaaacaagcaatggggaaaggattccctatttaataaatggtgctgggaaaactggctagccatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgatcaggcaacctagaaaatgggagaaaattttcgcaacctactcatctgacaaagggctaatatccagaatctaaaatgaactcaaacaaatttacaagaaaaaaacaaccccatcaaaaagtgagcgaaggacatgaacagacacttctcaaaagaagacatttatacagccaaaaaacacatgaaaaaatgctcatcatcactggccatcagagaaatgcaattcaaaaccacaatgagataccatctcacaccagttagaatggc

SEQ ID NO: 21052 - DNA, 1030 bp, Homo sapiens
agttatatcctggctcagtggagtgatatttatgtattatttttacttttctctcagtgtcttatattaagattaacatgttgttaatagttgctttgttgattaatctctcttgttggtgttttaataaatgaaataggcttgcctttagatcgggtgctgatattgcctgtttcctagtaatgggctgatcaaatgatcagtggaattcttggtttgatgataaccttattaattgaaattttttactgatgtggctttaaaagaggtttattttgtatatgtttagaactctctgattttgatgaattatatgggaatgagaaacagaagaagtggtatttgctggcgagttaaataggcaaggtacccagtgataacaccaaccaaaccactcctatctgcatgattctgaacatctggatgcctgttgttttactgtgtatattttatttttaatatattaactttgtggattcatttaaggtctactcaaaagtaacactgtcaaaaccactaatatgtatgtaaaaattgtgctgtatactacaataaagttgttacttggatttgttccactgtctctaaattagatgactgtgaagaaaaatgaatacaccctgtcacttagaactttctagtctactttttaataattgaaatgccagagtcagctcaaacattaatcaacagacattttcagtttaaaatacactagtcaggacctaatgatttcaagttttttagatgatgcatccttaccaaggtaagccttttggtttagcatatttaatattctataggactgaggtgacagtcttttatgttaccaaccagacaagtagcagattataaatcttaacaactctcctagtgttagatgccattctacctcttctgtagtgtgggaaaccagggccagagaagttcaactgcttcatcctaaatcagggagctggaacagcaaccagctctatctgattccgaagcctcccattgactataccactgcatttctagagtcagcaga

SEQ ID NO: 21053 - DNA, 1026 bp, Homo sapiens
ataagagactttttttatgtttggttcatgtttacagatcaggattgtgttcacacagcttcttcattgtctagaaaatcaagagccttagagagaattacagttatctgtagcttgccatgcagagtaacatcaaaccctttttatttttttttctctgttgacagaacaacaccgatggacttcaggaacttgcctgtgggggcttaatttattgcttgggagttgtgttcttcaagagtgatggcatcattccatttgcccacgccatctggcacctgtttgtggccacggcagctgcagtgcattactacgccatttggaaatacctttaccgaagtcctacggactttatgcggcatttatgaccaatctgtactaattctccaaaccagtattatttcaattatggcacttgggagtggggtgagagctaaacattgcacagggaaagaaaaaaaataactgcactgactttatatcttttgaatataattactgtgaaagtataaaggctgtgttctggaattttctgcctcacagcaaataaataaggtagtgaattaattattcattccattccactatcatgaaggactctgaatagacttggccaactgatgtttacaaaccagacttttatattttaattttacagattttactacatgatttttctaaattactatgtcaggttgtaaaagtcagtgcaataacaaaccttcctttttaagaagaaaattgtttctattactttcccattcactaggtaaagaatcatggacagaacttacactactttttaccatgtttcatcttggcataacatggttcttttttaaatagaaactttagttttttgtaaatttttaaaaaaatatttcattgatatgcatctctgcaggtcctcattcatgttgtaaatttttgcagcaagcagtcaacattccacaaacgaacaaacattatacctcttctgatagttttattaagcatggagaaattgccaatttttaaaaactgcag

SEQ ID NO: 21054 - DNA, 1033 bp, Homo sapiens
gaatgagtaaaaaaactctgcctaactagtagctttattaagtgcagctcccactcccaggactgaatcaccttccttcaaaccctctagagcttgttggttactcaagcattgagtaaccattagggccactccgctttaaatagagatgtcttccataaatggatgctgttttccataaccagcacttgaacctttcccattcttttttcggggaagagatgaaggccagagtgtgggagttgatttacattttacatctgcttttccatttaggttttaggagtgatttcttcaggaggctgtggaggaggcttgattgcaccctggcaggttagagagaaatgggaaaattgtattgtactttcccagcagaacaattatgctgtctatcctactgagccccagatttagagaattgcttccaggatagttacccttatctttccctattgcccgtgtcttaccctgtgcatcaggatagagtgccttaagtcaccatgggtgggatatttttctgtataactttctacttttattttttaatgtgaattattccaggtgatcagggactaagctgtcacaaacatggccatccagtttatttgtttttaggagaaaatgtgaaagtctatccctgttgctgggtaatggcttgactatttttagattgggctgccagagatataaattgctattttagtctgcagcctggtggtgggtagacaaatcctacttactgcaccctacacagagcacattcaatttcatctaactacagccatcttggggccttgctctttagccttgaaaattcctaatagggtatgctacttatagctctgttgttatgtctcaggacaatgatgtggtatatcctccaattcttgggacacttttaaagcattcttcccaagagtgtaattattttcttttttgctaataagagctgtatagcaacactcttgtctcttaggaaattagtaaaattatttaaaatattatcaggggagaaaagatgatgcttaataat

SEQ ID NO: 21055 - DNA, 1028 bp, Homo sapiens
tttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaatt

SEQ ID NO: 21056 - DNA, 1049 bp, Homo sapiens
tgggtcccttgctttttcagggctggccttcttgtagccctccgctgtccctgccccccaagagaggcccagaccagccctgggctgcagctaactcttgcccaagctgctagcggcggtgctgagccacgtctttcaggagctgctgtgcactctgtggcagccgcataaacagggaaagtaaaattctatcaacttagggccttttccacccccagcttattcattttgccttgggggaaactcgggctccagtgaaaagtgtcatgccctgagccacctagcaaatgagtgcctcgcttggctccctgctgcccaccagttaaagtctagcctcctaagcccttccctttctagccccaacatgtttcccttctcctgctgcatctgtgttcccagccacccagcttccccgatcccagcacatgcgaatccccttggcactccgtggcttcactctcactgttccctctgtctggaacagcttttctctctctgttctcctctgtctagttctcatcttctgttacttggctccaattccagcctgccagtgaaatgttccccaactgtagcatcagttgccttgtctctgtgtccctacagtgtgtgcttacccttttggcagagtgtgagtctcatggtgttgttactgatggacttgccttgcttgttggagtgtgaactccatgaggcccggcaccttgtctctctggttcatggttgtgcatcttgtgccagaatctggtgtcagtcaggtgcctggtaaatggttttggatggatgaatggacagacatacggatgactgatagatgatagatggctggctggctggacagaatggatggatgaatggatggatagatgagctgatgaataatggatgggtggatagatgggtggatggataaatggacagatggatagataagtggatagattaatgaatgaatgaatggataaatggaaaggcagaaggatggatagataagtggatagatggatgaatggaagaatggatagataggtagatagatgggtatatgg

SEQ ID NO: 21057 - DNA, 1053 bp, Homo sapiens
tattaatggccaggcacagtggctcatgcctgtaatcccagcactttgggaggccaaggtaggtgaatcacttgaggtcaggagttcgagaccagcctggccaacatggcaaaaccccatctctactaaaaatataaaaatgagcctggcatggtggcgtgcacctgtagccccagctactcaggagactgaggcacaagaatcacttgaacgcagtaggtgggggttgcagtgagctgagatcatgccactgcactccagcctgggtgacaaaacgagactcttaaaaaaaattgcatattaaattggtattagttgtcatagttattaatgttggaaggtgttttgcctactttagttggcaaaattttttgaagatttttgaaattgctttcaaaaacattttaagaatgaaaattggtcctacttttttgctttgacctcaaacgcagttatccagcttgatcatctgctttattcattaaccttgtctccaaaaattaaattggttcaattctgtactaaaaaatgtagtctcccaagcccctgattccctgttgagtctggttttaaaaaaaactgttgactgtgctcagaaattccaggtagaggcaggaggaactggttgcttggcctctcagtatatacccccggaggctaccatgtgtctccccatcgcccacgtgcatgggcagtgcatcctcttgatgcattagaaaatcagctcccacagctggagacctgggagaaggagaattgggatcttaacagtgataaagtgccttctggtttctcctggggggttgtgatcactgttttagaagggttctaaaagcatcaggaaccgaggctgcaccattaggatatatctagtctctcctgatgaatgctgtgatggtcagtgctcacttgaatatatcagcctggtgtgatttttttctccttttcccttattcagtcacttttggttccctggtgtaatctttactttcatcgagttatttaagatagtgtctgccatttatgatttaaatgttttattttgcctctaaa

SEQ ID NO: 21058 - DNA, 1053 bp, Homo sapiens
agcatttggaggcacctgcagaccagtcgaaaggtctcttgcctccctgaaggacctgtatactgtgtatgctggcattcacactctactcactggctgaatgttgagctatttttaaacagttgaactgtgtaaatgtttcttgatctctaaggtattatgtttgccttctcttagttatttctgggttgtcacaaagctcagtatcatggtttgacagaagcagttatgtgaacttttatgttaggacattactaaataaagaattccctagctgcttataaagtaaatttactttgaattgtaaataacatgaagaaacctttataaagattgttcaaatgggactcaatctgactaggcttgctttgatgtttgttagtatgtgggctggctacatctgattcccgggtacatatttcttctgatccatcagacttatacgtgtacacatgttgtggaaccttggctagctggttttgtctgcagagaatctttgtacttcttgctatagaacgattatctctccacttgagaggccaagctgacttgcgctttgtggtaagagtgaggacctgtcattgctgatacacaaagaccaaaactgtaactttaatgtcatggattgagtgtgctggagacagttaacataggcctgcacagactaggctgttcagtaaatacttgttgaatgaatgagtgaacgaatggttatatccagctaaagactggattcatatggtgtagataacaggattgccaagaaaggaggcagctaatttaggtgatgctctccaccagcatccacctgcctccctggggccaaagtgtgcctacaagtccttatcaacttccctgccttcctcgtttccccaggttttactaaatacatgaaatatccctctgagattgcagcctttgtatatgtggtcaagccagtggtttttagctgttagtagtaagctgcttcagaaattccctattttaaaactcatgtagattttctacccagtgattctttgtgtatgctctcatctctcctggtacactgtg

SEQ ID NO: 21059 - DNA, 1720 bp, Homo sapiens
tttatataatttattgaacctttatctttgtggccctctttttttttggtggttttgatatttaaaaaagcttatagagtggttgtgcatgcctgtagttccagctacttgggaggctgaggaaggaggaccattggagtctaggagttcaaggttgtagtacactatgattgtatctgtgaatagccactgcactcacaacagcctggcaacatggcaagaccccatctcttaaaaaaaaaaaaaagaaaaaggaacttacaacaaaataaataaaacaaacaaaaaagatgtattaaaatctaagtgtaaaaagtgagatcataacagtactggaagaaaacatgggagaattaaaaaaataatctgagtgataaaggtctttttaagcatgatataaaactcagaagccataaaaagaaaatattaaaattttctgtataaaaaagtactgtaagcaaaatcaaaagacagccaacaaactgggaaagatctttgcaatgttatgacaaaggactaattttctatgtatatggctacaaagtttgcttagaaatcattaagaaagagaccactgtgtaacgaattaccatagaccaggtggcttataaacaaatgaaatttctttctcatagttctggaggctaggaagtctgagatcagggtgccagcagggtcaggttctggggaggactgtcttcctgattcctcacattgaggggagcagagagtggtagcaagctctcttctatctcttataggggcactaatcccatcatgagggctgattaccatgacctgattacctcccaaagcctccatctctaaataccatcacaatggggattaggatttcaacatagtaattttggtgggacacgtttagtccatagcaaccaccaaatagaaaagcggacaaagaacttggacagttcacagaaaaggaaattcagtttgcttttaaacttgaaaagatgtccagtctctttaaaaagaaaagcaaattaaaactataaagagttctggtttcttacctattaggttggctaagatcaaaaagttggagaacatgtgtgtgtgtgtttgtgtattttttttttttttttgaggcaggatctaacccagactgggatgcagtggtgcctatcatggcttactgcagccttgacctcctggactcaagtgatcctcccacctcagcctcctgagtagctgggactacaggtgtatgccaccattcctggctaatttttaattttttttgtagagatggtgtcccactatattgcccaggctggtcttgaactcctggcctcaagtgatcctcctgccttggccttccaaagtgctgggattacaggcatcagccagcacgcctggtctaaatatatatatatatttttgctgggattacaggtgtgagccactgcacctgcctcgtgtgtgtgtgtgtgtgtgtgtgtgtgtgtgtgtgtgtgtgtgtatatatatatattttttttttttttttagagacagggtctcaggtctcaccatgttgcccaagctggtggtgagctcctggcctcaaaagatcctcatgcctcagcttcccaagcaggtgggattatatgcgtgagcctctatgctcagctggagaatgtcatttggtcagggtgtggggagataggtgctcgtatattacctatgtgaatgtaaattggtacagccactttggaaa

SEQ ID NO: 21060 - DNA, 1033 bp, Homo sapiens
tgagctgagtgaggacaagataaagtggctgctgcctcctgggcttttgatctggcatgggagcacattgttctcccccttggtgaactctgagtagagctaagtagcggtgtgggtttcagagaagggtcaggttttctggattctgtagcacccttgccagggtgaggcaggaactgggcagtgtggtcagctttcctgatgcctttgtggtttttaacagctgagaaacactgccacctcttgtaatgcctgcagtgaacatggtgaagaagacataaaagtcccttaagagtcattgctcagaacacagtgattcactcttgtctctctgcacttagaaccagaggcaaatgaatttaaactacagagggaggattcaagtaaggtatgaggaagacattccagataggatgtgagatgtaagaaaagtgactcataggcacagaggggaatggcctcccctgaaggtcttcagaaatgggaacaagtttcatttgtctttgtggtttaagaggtttcatctggagacaggaagatgaagtagaggcccctagaggtccatgtcagctcggtgatcggaggataaaaggagctggaatttttgagctagaagattacttaaatttggcctaacccctcctttgactgttggagtgattgaagaatgcccgataacactgagcagctcatccatgaatgagtgagccaaggcacaaacagagtctgcccaacagctctgggccaggtgaccctggcccgcaatgttcctggtcagcatcacccgggggtgctcactgggagggacctacagctctcggggatggagtccaagccgtgtgaggagagctcaggaaacctggaagtagtggagcatttgtcttggtattggaatacagaaagcatcagcccccatacacacagtgtttctgagaatggcactctcagttggagctagtgggttatctcctagatgcacctagaagagttttaggcatatatatgaggccctcagtaaactttgttggatgaa

SEQ ID NO: 21061 - DNA, 1057 bp, Homo sapiens
actataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtcca

SEQ ID NO: 21062 - DNA, 1109 bp, Homo sapiens
tgggatgttggtcttcgcttttttgcaagaaacttgaaagtgactgtagccgatgtgttttggcaattctcttgcccgcccactttagatgggggacccctgtttggcagatctaggctggaacttatttttttcctacttcgtttctgtttgcaaaacgaagcattcagtgggcagtagcgatgagctcacggggaaacttcggaactggaggaggttaggaagctcgtcacttttaagtgcgttcttcccgcctctctgagttattttcctttgaatacttcgtgaaatcccaaacgcgtagctggggcgcttgataccttttgaaactaacaggaacggatgcagaattttcaaaaaattattctcccagccactggattcatcctagtggagttaatatagagaattggataactcagaaattacctactgtgtagactggcctgttgttttaagacatattttttcaaatgtgggcaatttgatctttaagtagttatggaaatatatttgggcttcttaaaatctaaaatacccaacattatggaattcatgaacttcccccttttctcattctgatcagtgttgttttattgtactttgatgagcttgctaataatgtgataaaccaacttgaaaatgcattggaaaagaaatgatatataactagcatgcatccaggttggtgtaaaggtggcaaatactttccccagaaaaaagctcaaatggttattttaaaatatgggattgatgtgccactgaagtgattttcgtgtgattaaaaaccatattaagcatggtgtctatagagattgaaaaaaaaaagtgttcttcatgtaaaggaaaaacccataacacatctttggaaagctggttgaaaaatcttttgaaatacttttttaaagattatttttctcctgggtaaaacaaatgccaagcgtttattgatcaactttttaattagattttatattatttaatttttttcagctattaaaatctttttttccacctgatggagaagtgtgaaaacaaatatttaatcctgggcttggcaatgtgtgcagtgaaatttgttggaaaacttaaaatttagagccgagagc

SEQ ID NO: 21063 - DNA, 1050 bp, Homo sapiens
tagctggggacaggtaattgacaacggcagagatactttcttttcctaggattctaagtctgtaatccacatcctcaatgtattcacaggactttaaaattctctccaaatgaggaaggaaatatcctgttgctttctaatgtttactaaaagttgtgtttagaacaacagattttaataggcatcttcctttgttatgtgtcattagccctttgcccgtttaccttagggctctttgaaggagaaatggatgggagaaaacctgtcacttggcgaaagtaaaagggataattaactggctcagagcttatgtgcagagttccaagccccaaagttaatctagaaccactcgataacaccaataaaaatatttatttcacatctgttatatatctggaaaatgttctaagcatcttacacatatttctcattaaatccacaggtgaccattgtgaggtagatattttgttctaattttccagatgaggaagctgagaccctaaaaggttaggtgacaggttatacaacttggagtgtgggaggaggagagaggaacctgaacagggcaagttggggatctgacttttgtttgggtagatgtaggcacattgtatttttggcttagatgctttattcatcatggctgaaggtaataccatttactcactcaccgaaaattgtttacaataatctagatgaatttgctgtctttggacatctgtcttttgactggaccccagtatatagtctgtggaagctcacttaaggagagagctcctttttgtttggttagagaaattttctgtcctaaaagtagaaatagccccttctaggtaaggatggagcatttgatcatactggtttcattatattcctctaacagttggaaccgattgtttttgagtacttgtttcaaacttctgagtattttccttctggaaaatagctcagtgtttaaaatttacatgaacttaaaaggttaatttttttttaaagaatgtttgaggagcaatcaattctgattttgtcttatggatagaaatagaatta

SEQ ID NO: 21064 - DNA, 1028 bp, Homo sapiens
gacatccacaacttaaggctagaaatgtaaaatgttggttcgcagtgtaacaagcacattccaaagaaaactcaaatggctcctttgtactctaaaaatagtaaatttgcagcaaggtgatagtcaagttctgtgtcttcagggtgccaccgcatctatgatttagattaacctagagatgtgtttacttgccaaatagagttcttcaagatgctgtttggatttgtcttcccatctccagttgccatatcagcatttttgtctgtacccaaattcatattactgaagtgttaaagctggtttcagtgactccagatccttaaaacatgtcactcccttaatatgagttaacaatgggttatattctacctttccaatttatcctgttctcaatcacatcttcccctaccctggttgatttggtaaatacatgtattttttaactctacagacccaggaactgaatatatttatatttcccaatgagctaaatgcagtgctgacagttttaatattgatgggcgagatgggaagaatttagtattccctaaaagcaaagcactgtagaagtctgtttcacaagctattcgttaactgggtggattattggagaaggtattttaatactaataactcctcagatgtgaagccagaaaatttgaattaatctaaatgctagcctaagtccaagtataattggataagtaaatgttgctcccagaattggtcttgcaaagtaagaccaattgtaagaccaaagtaagtggttttgatgtaagctgtgcacactttcagtacagatcaccaagaattgatgacattgtctccaaaaagactaaatagttgcctcctaggtatcctttttcagtcattctcttttaagcttcttacagaggaagctttaagttgcctcagaatttagtggtattgcctcaatgagaattcctgcatatttctctttgggatggaatcattttggttgtttttttgttgttggtaactattcataaagagattaatacataacg

SEQ ID NO: 21065 - DNA, 1026 bp, Homo sapiens
ctgaaaattactgaaaatttaacacttttagtatctgtcattcccatcaccgctttctccccaggtttcttttataaaaaatggaaaggacacaaacttgtctcctgtttacagtataaattgtcattgagaatactaaaccttttaggcccatatgatgggatttagtcatccagaagacaggtgtgggacaactggccttaaaatgttaattttagaaaatcagtctgtttcaaagaataaagcactaaaagtggacaaagtggacttcttgtggggggaaaagtaatcaagtttacacagtagagatttccctgcctgctaaggtaacactaagtagcaaggaaagctacagaaggtagttactgttaactagtagtcttgctgcaaattggattgacagctgaaagggcactaactagattgaagcctgtctttaatcctgtaaatgttagctctggtgtccctttgataatttttaaataacttttgaagatgcactctgaagccacaaattaggcaaatgaaaattcagaattctccttgtagaaagaaaagtgctaaacctggagattgtaaagtgctaagaaaaaccatggtagaattgttccctcaggtgctgtgtattagaggaggagtctttatatgtcattttgggataagctttcaacaattattaaggcttaatacataagattataggatcagtcaagcaaaagggaaggtataacctttagataggactgggaagtgctgggtgaatgtcttctacccttaacggtggtagaaatttgaactataaaataacaccaagagtgacattcacattttttttgtctttgtttttgacacagggtctcactctgtcacccaggctggagtgtagtggcacaatctcggctcactgcaacctccgcctcccgggttcaagcgattctcctgcctcccaagtagctggtattacaggtgcccatcaccacacctggctaatttttgtatttttcatagagacagggtttcactatg

SEQ ID NO: 21066 - DNA, 1215 bp, Homo sapiens
gattatagtatacttaaaccagtacttattcctgttattgagaccttcacggtgcttcttggtagctttgaaagctaatgcctaacaaccctgagggttcttgtgagcttgtagtgattaaaggaaggattttttaattattataaaaatcactccgtgcttcattaatgcacagaataaaaattgaataaatgactctgtcatatagaagttaatttaggcaaatataacatttgtaatttacaacattttaataggtgctaggctgggatttcagggggtgaaaagtcattcatgacttttcataagaagtttactgtttaggtaagcaaaacaacacttagttcagcttgatactcaagcatcgggttaaaaagcatcagacttctgttaccagacaacttataagtgccaactattggtagaactgtggacatgaagatagtggaaacagcttctctaggatgctatactcatctccaccaaatgcactttgaacaaaaacaacttgtagaaataggtcttaattttttttgtttgtttgtttggtttttttacaacatgctgtactgctctccattggtaagtgctagggaaaatcacttagccactagagggagctataacacaaaattaagcaggaaataatccccattatagatacatagaacaaagtagagaccagctaactaccttgatcctctgtatcagctctaaagttagatggtttgggtaagttttcttgcaactttacctttgtcttcccatcttttgtgtaaaattcttccccttttcagcttttgcatccatttaggttttcagagtttaccttacaggcactcattttgtaacaaatctaggttctgggactaagaaaatactgaagacataagtctgcttgtttttctgcctaccttgtacatcaggtatggaataataaggccatgaatgtgagaattgggaacaggagttaggtgtgctggggaaaactagacataacaatttggttatgaactagaagaaatgaatatgcttttagagacctgcagtttgcttttatggagtgacagtttcaggtgtgatgatcttctcagtattactaagaggttcttaaagtttgtcttaaaatcctacttatgtgtcagcttagctgttttctattttctaggcctcacttaagtagcaggttgtcttgtgatcaaaaagtcagtagac

SEQ ID NO: 21067 - DNA, 1239 bp, Homo sapiens
ttgtagttaagatgaccagacagctaaaagctgtgatgggaagtatggactgctcctatttatagtctcagaaaatggacctttaggtctctatccgtattggcaattattagaagaaagttacacccttttgaaactacaaaagctgtcttggaatttccccctcttctccctatttatgtccccttagaatattttagggagcctataattattttctaaccaaggaaaaacttaagtctctttaagaagcaattacttttcataacatcagattgaataacccaccttgctgttcagcccacatcctactggaaacaaaaggtaagaaacccattttctggttcttgattgtttgggtctgaattttgtttttaaaactaagctaagtttaatgttttttaaaatgctgtttggaatatgaatagattccccgtaaaatgatttttcctaagttttatgctttagtaaatattcagtgctcacgtctgtgcatcatagtgcttgcgtttaatatgatttattgtagaatctcaacttttcttggtgtttgttgtctttgaaacattgtcttggtcattagggctggtgttttcacatttctgtggtcaaggtggatttcttatgtgtgcctttttgcttactttgtatatgaattttgtaatttaaattgcaagtaagttatatatatgtatttaccataaatagtattaaaagatgagaaactgttagactgaagttctgttgtaacataaccattatttccatcacagtatgaagactgcaaacgcagaaaacagattacagtctcttatccattttttgaaatccaaaaactacgaaaacaaaagattttctgttgttgagctaattaaatgtgaaccctgaccagaattgctgccttcattttgcacttagtgtgactaaactgtttcctgttgaacttcattattcattgcacagttgccacagactttgctgagggttttatgtaatacagggtatatatgtacctcataaagtgcatacagctctgaatcccagatatgtctgtctccaaagagttcatataagggattgtaggaactgtactagcatacacaggcctaatgcttttgtctgtaactggggtgtcttgactgaaaaacctgttattgtgaatcctttgttgattgaattttaagttcccccatctttttaggctgaagcagccacaagaaaaaaaggtatggcccacat

SEQ ID NO: 21068 - DNA, 2920 bp, Homo sapiens
cggtctgaaaacagagtggttgtctctggtgagtgtactggttgtgtggattgatgtgaagggacgaaaactacctaaaatttttctcttgcgtgacaggtttaataattgcaaatttttcatgctaggtcttaaattgctttagtttttgggtgaatttaataaacgaggattgctgctgtggtgatttaccaaattaggttgcggtactagatacgaagatcgttacaaataattttggactctggattccagaatcttaccagctctctttacctggtatcacttaagtacacctattaagtactttaaagtactctttgtcctaatgtaccttaccagcttaacgtgaaatttaagataattggtactaagaaaaaaaaaatcactttttcaggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactg

SEQ ID NO: 21069 - DNA, 1072 bp, Homo sapiens
ccaagtgctttgaaggcgccgagttgctttcaaagatcctcattcctggagaaatcgaccatccttcaagacccgacctggatgactagctcctttaacgaaagttcgttatttaacttttaccaaacggctggtcactctgttcgcaaaccaccccaagctgggaacgcgggggacttttttacccccttcgtggggagggtgacgtcgcgcgtgcgtgcgcgtgcgctgaacgtagccctcgcagcacccgttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaataggtccgagtagttggggaaggctccaaggccttaacatagagaacggggaagcgggggctcttagagaggttggggcgagactgtatcgcccatgcaggagtcgagtaaggagctgagttgatgtggcttctctggcgcctcgccttggacgtccccggagcccattcgcaggctggagcgggaaactgaggcgctgagggctggtgtagtggttgggagcctggcgtgtttctgggtgggggaggggccattcctattatgcggcgcatgtgggctcttccacgttgggtgcgcatgtgcggggggtttgctggttcccaactgagcgagcttctcctcctggtgtttctcatcccttttactttctgcgatcccgcaga

SEQ ID NO: 21070 - DNA, 1031 bp, Homo sapiens
agggctgagaacaggagggaagtgactgtggataatgagctgtcccagaatgcgccttgcagaacactggcattcagaagcactgttgattaccaaagaacgggggaggggttcagaaaaggccttgtcccttccaggaataagaagggactttattatagatgcagtaataaaaacagctgccattaagtgagcacttactaagtgtcaggctttttgctaggcactgatatccattatctcctgtctacacaaagcattcttgttcccattccaaagacgagcaatatgaggctcagaaagattaacatgcccaaggtcacacaggtaaatgatggggtcagaatctgaactctaggtctgtcttgggagggaggggaaaaaatcagaacaaataagttaaggaggacacagggagaatagactcaggaatatgaaatacaacacacaccaccgaaggacagttcacatgtctttacacagggggtataaaatatgtatgcaaagctgaattctgagtcagaatgacccaactcgtgcttgaaagcaagtgcctcttaatttgcccctcatggcagcctgtgagacagtggtgtcctaactcctggcctttgaggaagtcaaattcaccaagtttccatgagccctccacagccacacccttctcaaatcaggcaagctcatttctcttgaccctcccctggtgtcactgaggggacaggtggcccactgtagaaatcgtgtttgcatcttcatgattaggagaccttgcattccaaggagacagatgtatttgcatctgttttctcaagagcccgcttcctggctgaaaattccttggaggaagggcaaagacagcccctgtgttatacccagggaatgccaatgctgtctttcttgctaggtgctgaactgagtcctagttcaaatggctattatttgtttttaatttgagaatatttgaaaagctctcattgtaaaagagtcaagccatacaaaagtataatgagtatgattgtcataccacagat

SEQ ID NO: 21071 - DNA, 1026 bp, Homo sapiens
gttgcctttgaaaatggcaaatgttaggtattattattaatagtaattaaacttgagctattccttattcacctaattactatcagaaatattactaagtgtgaaggttattgatttagactccgttaacctatttgcgttcaatttggcatcagcttaacataactaagcaagactgtttgtatttttaatgtagccgaaaggacaaggctttagcttcaaaattttgtgggttaagggtgctgattaaatattaccataatgtagtacaggtagccttagtggtttaaagaatgactaatagtatgtgagttctggggtgggaacttaatacctgttacttgtggtacggtgaatcacttatctgccctggacctttgtatgtgtgcctgttccgtactggtaaccccattagcttccttccatgatcaatgaggtgatcactgacacaaagcagctgttttctaagttttgacttatcagagtctgagggatcctagaaccacattatatatcactcttccatcttccctttttgaaaatttagagtatttttttaaattgctgctattggctgggtgcggtggctcacgcctgtaatcctagtactttgggaggctgaggcgggtggatcatgaagtcaggagttcaagaccagtctgaacagcatggtgaaacccagtctctactaaaaatacaaaaattagccaggcgtggtggtacgcaactgtaatcccagctacttgggaggctgaggcaggagaatcacttgaacctgggaggtggaggttgcagtgagctgagatggcaccactgcactccagcctgggtgacagagtgagactttgtctcaaaaaaaaaaaaaaaattgctgctactctgggacagttgctcagaatgctggcgcttcagcttctggtgtgtagcttgcagccatgtttctaaggaccagaagggaaggagttcaggattgtgaaggggactactttccccagttcattatactgtgctggtcccaacatgttt

SEQ ID NO: 21072 - DNA, 1059 bp, Homo sapiens
ttagataccctaaagcacagtttttaatcttgtttgtgtgtgccacaggcccctttgagaatgtgatcattgttattgaccataggcacaaaatacacacaaatacttaacatacacaattttgcataaaatctcagtgagttgactctctaagacatatctagagatctaaggactccagatgaaaagcaactatcctaacataatcccaattatttcaagaaattaaaccaaattctcaaaacaaatttaccttcagtttacttaatttgaaaagtacttgtatgtattacttaaagtcagacagacaacaatattgtgatgcagttataagaaagtggcctgaccttaggtgaaggaactccagaagtaaaaattgatgtctgacaaagatcttcttatgtgtagtaaatgaattctgctctccaaatatgaagtgaaactgcatcaattcaagaaatgcctacaatcccttcagcatggtggttccactgaaaggcccttaagaataacggatattttactcacatgttttgagattagtagaaccgtcgtggctttatgtgtctatttagttactacattcagaaaactgagggtataaaacaaactttaactttgttttcttcccgtgtctttagtttccagtctttaagctccattgctttccctagggcagtgttctttaggcccttaaatttctatttgctctaatggaaaactttatatattttttaaagccaagatttgttgttgcttgcttgttttgaataacagataagctactttacatactctttttatctgggttctaaacttacagttcatggataaattttattttgttctatactttttaatatattggaatctgtgtttaatttacaaatttggaaacaccagagtaaccaaaatgatttaaaaactaaggtttttttaaaattgtaagcacaaaggcctggtgcattattcctcaagataagaagttagactacaatatttagaaattcttgtctctaggctgggtgtggtggctcacgcctgtaatcccagcacttt

SEQ ID NO: 21073 - DNA, 1079 bp, Homo sapiens
tcactttgtcagcaggtagagagcgtgattgcagtcccaggggagggagtcagagctagaacaccaattacaaaccacaggcttcctgctctagggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacaggtttgcagatttcttttgaaattcctttttcccccctccctctgcctcagcaaaagaaaagaatccatataacaggttcatgttcaattgcttggcttttcagcacttattctgaagactttataatatttttaaacttgaccttggaacacagagggctttgtgggtgaggtgtatttatatttacttaagggtgcacattttaaaaatcttattctgtgtttgtacaaagacgcaaattttcatagtgcctagaaatagcacagatctattctactcaagattatttgtattttttcagggtattctacctagagcctgtggttaatcgcctccctgctccccctaccttttattccctaccccctcagggaatttggatacatgtgaggaatagtcctttgtttttcttatgaacctagaaaattacagatcataaaatctggatattaaagtagtttccaaaag

SEQ ID NO: 21074 - DNA, 1064 bp, Homo sapiens
ttttttttttaaaaaaaaaagaagttctgtggctggcaggggttgagaaggggctattttaaggaatagtggaaatataggacaggtcattgagggcattgaaggctttaaacattacagtgaagagtttattttgattcagttgtcaataggaagtcattgtaggaagttactgtggtctgctgacagtgggatccttggagaactaatcagtgagtacagggtagctggaggcacagagaccagccagcactgctgtagtagttcagatatgaggggaagagtccctggcaaagagaaaggattaaattcagaagcactgtagagaaccattggcaggctacagaattgaaagttggagagtagaagtgaaaagtactttgggtcccaagtatctgagcttaaaaagtaggagaatattagtaccactaatagacattgaaaggtcgagaagaccagccagtttggggagaaagcggagatacagggaaattgggattgaaatattagttgacagcaaagaaggaggtgtgttgtaggcagctcaagatggagagtagatttcgagaaataattggtataaagattttaaaggaaatggtctctgtaacaactgacctgacttacctttgattctacctttccctagatcaaaaatgtccttcttcttctccttcttctccccctcctccccctcctcccccctcctcccccctcctcccccgcttctccttctccttctcctcctccttcttcttcttcttccattaaagtcataaacacattcttctatacccatctcaaatcctaccctctctctgtagccttccttgacctcctagctggatgagctctctctccttgttgtaaactcaggtattattatctctgtcaacattgctgactaacctttggtacacatagaatgagttgtggaggatggcagaatgttgttatttgaatttggatgaagagcacatggaagttaattatattcttctttttgttgttgtttgagacagagtcttgctctgtcacccaggctggaatatagtggtgcgatc

SEQ ID NO: 21075 - DNA, 1045 bp, Homo sapiens
aaaactcaaatggccgaagttcgatgtatgaaaactgatgtaaagaatacactttcagaaataaaaagcagcagtgctgcttctggagacatgcagacaagccttttttctgctgaccaggcagctctggctgcatgtggaactgaaaactctggcagattgcaggatttgggaatggaactcctggcaaagtcatcagttgccaattgttacatacgaaactgtaagtaatatgttcccagtgtcatttctccacacgttatttgggaaactagatgactggttttttcaaaagaataatatttaaataccactcttccagtgagttaagactacaaattacatgtgacttttttcttcatccaaaattgattccgtatatttttactatataatagaactaacatttcttgattgcttactctgtatttggcaataaacaagacaaaattcttaacatcatagatcttgtattctagtagtgggaatcagacattaaaaagtgtagacaagtaagtaaagatcatttcagtgggtaaaaggtgctgtgaaggaaacaaccgaggagtgggatgggaggagcagatgagacatgttctattggggtagtcagagaaagtctctgtgaggaggcagcacttgacctgagacctgaagtttaggaaggtggcagctatttatagatctagggcaagcagtgttctgggtaaacagaacagaaactgcaaagtcactgacacaggatttattttgcgtatttgaaggattgaaggaagaccagtatggcaaagaaagcagagagaggagactagcaggagacgaagtcagagagaggtaggcagaatttagatcagggagagtcttgcaaaacctcaaaaaggagttcgagttttattatgatgtaaggaggaagcctctagagaataaaaataaggggtgtttataatctgatttacactttacaaagatgactttgcttgttgtgtggagaagggtctgaaaagggttgaggacaggaattgtgagaccagtaacagcctattac

SEQ ID NO: 21076 - DNA, 1052 bp, Homo sapiens
aatctctagacagaatcttatatggaattctaatattaaaatcatatagaaattatatttaattactttcagcatagggtattacctttttgtatgttggtcttaaaaattaatttttggtttaaaatttttttttgcttcactcatttctaatgaaattatttttcccattagggtcttgtttttttattaaggttgatttgtaagagttctatatatgttaaaactcttaacctttgttgtggttgttgatatttcccttcatttttgtgccttaatagtttcactttttttttaatgcacaaaagtttaaagttgttaagaactcaaatctattggtgtttttaattatttcttccattgctttgaggcttagaagtacttctcaatctagatatcagatattatctgcattttgttttattgtggcttaatttttttacactcaaactgattattcttcttttaggatggaaatggagttgtgcgaggttactacttatctgtgtttctggagctctcagctggcttgcctgaaacttctaagtaagaagtgtaattaaataacaaccttaatgtgcatttacataccttccccctagcaatttttgttaatttttatttttgttaattactgtattggtatgtctgttaagatgtagaataatatgttcttggcatcataggatggtatttttctaaaaacaaaatatttttaagaaaacttgtattgctttgcgtttttagaaatctctttactatctggcttagaagaagactactggattctcatgtctgcttttatattcaatttttttaaaatatcattttgattgaaatacatgtatgaaatctgtctgcagagttctacaaccatcaccaacatctaattttataacattctatttactccacaaggaatccctgtactccttagcagtcacttcccattccccgtttccctcagtccctgagaaccacaaatgtactttttgacaaggaggaatattttttaaagtggttttagataattgtggatcttctttgatatt

SEQ ID NO: 21077 - DNA, 1061 bp, Homo sapiens
cgattattactctaaaatttagcatttttatttattgaggaaatattaagtcctaaatagatagcaggcatcattgtagatattggtgatacagcagtgaacaaaatggtaaaattctgtcctcatagagtttatattttagattagggtgggtgaatatgaagcatatagtaaatgagtaaataaaatatgtagtgttgcataaatatctgatacattcacttgtctggaatttgctttttgtaatttctctctatgccttatacacagctgtctcctgagatttttatcttaatcattctgggaattcccttcacatctttcttgtattgaatctcatgtttcctgattcctatggtttccactttcttggtttacttgttttgttttaacatcacacttccctcagtagctttccaggaagggtagtcagaacacatttttcttgactgcattgtctgaaaatatttttattttatctttgtacttgattgacaatttggcttgtaggattcagcacataaatatttactaaatactcttatttttcttcattatccccattcttttttccttttctttttacatacacacatatatatctgtagggcattggccccaggaccttaatggataccaaaatccgcagatactcaagtcccttatataaaatggcatagtattctcatataacctatacacatctcccatatacaaacatgtgtcaaattatgaccttttggtcaatgacagactgcatatgtgacagtggtcccacaagattaaaatggagctgaaatacttctgttgcctagtagtgatgtctaatgacatcatagccattgtaatgtagtagcacaaagcattaatcatgtgtttattgtgatgctagtgtaaacacacatactgcactgctagttgtataaaaatataacacattattatgtatggtatataatacttgataagcataataaacaactgtgttactggtttatgtatttactataccataccattcattattctagaatatattctagagtttactcctacttttt

SEQ ID NO: 21078 - DNA, 1052 bp, Homo sapiens
ttgattctccaagattttagccatgtctttgtgtcatccaaaataatgattttatccattttatttttaactttttaaaaatgagatgcaaatatctttgagtttgtatatttgtatatcatttcatgaattgcttttctattataatcctatactatttaatatctgatttttagtttttttcccacagaccaagtagcaaatagtcttaaacaatcattcttctagtagttagattggaaagcacagttcatccacccagtggagcaattagacaaaacctgtaggtattgattgtactggtcacaatgccacttatatatttcatgtaaatgaaaatcgtaattgttcttagatcctcagttgcagtcatacatataggtgatcttagtttttcagaactctagataatatttgagatctctttaagttcattaagccatgtagagtactggatgttgatacgtattaggactttaaaattgaggggatcttgactgttgatgtgatcttcagtcgtagccaaataaacatttgcatgtggtcttgtttttcttgagtgagtttgttcattgcttcatttatttaattgaatcaactaaaagtcaaataataccacagtacagatctcttaagtttattaattttactacctgtataactgtgaaataacttccctttctaataactgaacttgccctgcttttgtggctttcaaattatttttcattatgaaaaattataatttgtgatttccaaggtagcttttatgattaaataggattctttctaaggataagaggtggggaaaaggatattttcagggttagtttatctttagaatagtcttataagcctcagatttttaattcataccataatatctgccactaatttattattattattattattatttgagatggagtctcgctctgtcattcaggctggagtgcagtggcactatctcggctcattgcaccctccgcctcctgggttcaagcaattctcctgcctcagcctcctgagtagctgggactacaggcacgtgc

SEQ ID NO: 21079 - DNA, 1050 bp, Homo sapiens
attagtgtatgtgtatggattttctccccagtgctccactccagctacgagaactagtaaattgtcgttgggcagaagaagtaacacaacagcttgatactcttcaactctgcagtctcaccaaacatgaagaaaatgaaaaggacaagtatgtcctcaatttctttgttcaatattgaatggattttgcctttgtattgtttaatgacactatattggtagttgccttttagttatttatgaataagtagtgttatatttcttgtttttaattctttcagtcatgcgctgttactgttaagtaacatattcttattgtgtttatttaacaacagttatttcatgccatgtatacacagatacctctcgccctcccctccccccacacagaaagtactttgctagatgataggcatacaaaggtaaatgagacatgatttctgttaactgtttaatggggacacagtgataatacagtgttaagtcatttaagggacaagaatgaataaatggtcttatgttccatgattgaagaattttgaacatatctggagagttgttatggggagcaggtaaagaaaggaaagagtgatgtggcagtgattggtttttatagatgaagaagctacaacatggttaattgtaaggcttcactgtccagcaataataaaataacttgaattaggtgagattccaggacccctgaatgtttagaaataaagccttgtcactttctgtagagtcacaacatggtaaagcaagaggttgaaacctcacaggtcattagaaaaaaatttatctgtttcttcattatactgaggaaatagaaccatagaaataagagaacagggtgtggtggtgtgcatctgtagtcccagatacttgggaggctcaggcaggaggatctcttgagcccagaggatggcttaggtaacatagcaagaacccatctcttaaaaaaagaaaaaaaaaaaaaaaaagaaagaggcttaattatggtagtataacacattaatgcataatcagaattaaaacctactattcgggcgg

SEQ ID NO: 21080 - DNA, 1061 bp, Homo sapiens
ggagcttttactttggatcaagttatggcaaacaagaagaatgatttaaaagttataaaacttgaaagaggtggtcatattttagaatcaatgatgaccaaattgggaaatgttggatatagtgagtcttgtacctactgctttaaaaatgaggtagtatgctgggcacagtggctcatgcctataatcttggcactttgggaggccaaggcaggaggatcagttgaggccaggagtttgagattagcctggacaacatagtgagaacctatctctaccaaaaaaaaaaagaaaaaaaagaaaaagaagaagaaaaaaatattttaaatttactgggcatgggagtgcatgctggtagttccaactatttggggcagaaggatcctttgaccccagaagtttgaggctgcagtgagctatgattgcaccactgaattccagcctgggtgacagggtgagactgtcccccaaaaattttaaaataaactaaaataaaaatgagatagtagtagaaagttcagagggaatacagatatgaaacttaatcttctgagagatgtttaaaagggtagcttaataaacaaaccattatattgataaatttttatgatccaaatgtgaatgggaatgacatctgtagagctgataaccaaaaacagttatatgagcccagagtttaaaggacttgcaaggtacaatttgtaaataaatttcaaatattaaaaggtcacagggacaaacctgtgaaattagttaggaaagccaaagaggccgggtgcggtggctcacacctgtaatcccagcactttgggaggccgaggagggaggattacgaggccaggagatcgagaccatcctggctgacatggtgaaaccccatctctactaaaataacaaaacattagctgggcatggtgttgcacgcctgtagtaccagctactcgggaggctgagacgggaatcgcttgaacctgggaggcggaggttgcagtgagccaaaatcttgccactgcacttcagcctggcaacagagcgagactctgtctcaaaaaaaaaaaaaa

SEQ ID NO: 21081 - DNA, 2734 bp, Homo sapiens
cagattgggaactgatgaacctgaagcccttgctcacttttatcccctctggttgccaattgcctgaaataacatgtctgtgacctggtgttagggcatgttactgcttatctgttttggacaagcatagtcatgcatttgttctgtttggaagagagaatgggtaatagtcaatactttctccagcagaaaaaggcaaaaaccaattttgattgtggagacatgatataagtggtccttagcttgctgggaacttgaaatatttcccttaaaacgtgttttaaagggtagttgggttcccaggtggtttgttctttcaaatgaatgaatgtttgttctttcatctattcccttttgtcactgcacattaggctgtatattaaaaactaaggatacaaaaaagcgatctcttgccaggaagatgtttgaaaccatgtggcgacattaccatgtaaacatagattaaaatataatacagtagatggtaaaccaaagccatgaacaaagtaaaaggagagtagataaaggtgtttctaaatgtacattgaagagaagaaaatgtacaaaaagtagattctggccgggtgcagtggctgacacctgtaatcctagcactttgggaggccaaggcgggcagattacgtgagctcaggatttcgagactagcctgggcaacatagtgagcactcatctcaaaaacaaaaaaaatttaaaaataaaaataaaagtaggttttttgattatagccaaactagttccattaagatacttaattctcccttaaaatgtttctatggaaaatgcatttcttttttttttttttttttttttgagacggagtcttgctctgttgcccaggctggagtgcagtggcgccatctcggctctctgcaacctctgcctcccaggtttatgccattctcctgctccagcctcccgagtatctggaactataggcatccaccaccatgcccagctaattttttgaatttttagtagagacggggtttcaccgtgttagccaggatggtctcaatctcctgacctcgtgctccgcccgcctcagcctcccaaagtgctgggattacaggcgtgagccactgcgcccagccggaaaatgcatttctaagcctgtttagtaagtccagaacacacctgtctaccaactcttctctatgcctagcccaccataggtgagactgaaatactttttttcactttatgtaatttaatgctgttgagataaggtctctcataagaggatgtgtttagagctttaagggcactggtcctttgtaggagagcatacggtggcaatgagaatctaggggttgtttgtaaaaagcaagtgttttaaaactgaggaccacacagtatattgtgacaaccgcaatatattcttttctccttgctgcctaatagttgagtagtatggaataccttgtgccacttacttaaagccttaaactggtcatattgaaaactagactagaacaggctgggcgcggtggctcatgcctgtaatcccagcacttcaggaggccgaggcgggcagatcacttgagctcgggaggtcaagactagtctgggcaaaatggtgaaaccccatctctaccaaaaatacaaaaaatttactaggcgttgtggcgtgtgcctgtagtcccagctagtcgggaggctgaggcatgagaattgcttgagcctggaggcagaggttgcagtgagctgagattgcgccactgccctccagcctaggcaacagagtgagacgctgtctcaaaaaataacaaacaaacaaaacaactggttgagcatccctaatccaaaattccaaaatctgaaatgctccaaaatccaaaattcattggaccatttcagattttgaattttcagattagggatgctcaaccagtaattattatgcaaatattccaaaataggaggaaaaaatcagaaatctaactggcagaatgtaacctggtttcccttggggtgctttcatgatgatttccatagacttttttcacctaattttgtattttatataccacttttcagatcagtataaaacttttcccctttatttttattactgattttagagaaaactggtttctgaaatacgaatatcttgggctttacaaaaatcactagttttattttaaatattccattgcccctaaaaagttaaacaataacctcactgatttccaaggcttccaggaggctgatttgtaactgaaagggctgtgaatgatgtttatcagaatcaaatttgcgcgatttatcagacactaatgagttttagattatcataattgcttagtgaatttctgccatctaactaaaaaaaattctgtttatcaccagatcctagaaccctatcaatattgtctctgctgtgtaaatagttctgagtagtgcaatattgcttatagggttttggtgtttggaaagaacaatgggcaggctgcagaaagtatgtagcagaaacaagcaaaagtcatctttaggaagaaaacaaggaactagatttcactataaacattaaaatctgaggcttaaatgtaaatttttaatttattagaagaaggtaacttttctttttgacaaatgggtttatttgtagtataaagaaataatggaattttagtattgaaaaggatcttagattccaactcatttgataggagagacccaaagaaatgagggacttaacctagggacacatagc

SEQ ID NO: 21082 - DNA, 1024 bp, Homo sapiens
cccagccctgtctctctttttttttaatattaaaatataaaaattaaaaaaatacatacataggctgggcacggtgactcacgcctgtaatcctagcactttgggaggctgagatgggtggatcacctgaggtcgagagttcgagagcagcctgaccaacatagagaaaccccatctctactaaatatacaaaattagctggatgtggtggtgcatgcctgtaatcccagctacttgggaggctgaggcaggagaatcgcttgaacccaggaggcagaggttgcggtgagccgagatcacatcattgcactccagcctgggcaacaagagcgaaacgccatctcaaaaaaaaaaaaaaaacccaccatatataaactaaagaatttatctgaatattcgtgcaataacaccatccctgtcacttacatgtactaccatgacctactctgattgttctcaaagaaaatagaagaattgtggtaaagtgaataattcaccccatttcttcacttctgcctgtatccacatgtttgtcatgacttcatgatgggcagagtacatttttctcctcttgatgtgctttggtcaatggcatgtgggtagaattgacagtgtgcagctttgaacttgggcctttaagagaccttgaatctttctgcttactcttatgtttcctctagctccatgagaatatctcatgggttcaaagaggatgagagacaccagtagcaaaggtcctaccaggcatcctccagaattgctgtgtgaagcaaagccaccaaactcagcctagcctagagtacctgaaccgggtcaatgtgcaggtccatgaaaataaatgatcagtttttaagccactgagtttcttggtatcacgtgccataattttgaagtatgcctaggctctcttttttttttttttttttttgagacaaggtctcgttctgtcatgcaggttggagtgcagtgatgtgatcaccactcaatccagcctggacctcccgggctcaagcctatttcagcc
